United States Patent 11,913,074 (METHODS FOR ASSESSING RISK OF DEVELOPING A VIRAL DISEASE USING A GENETIC TEST) - sequence listing, part 28

SEQ ID NO: 2767 - DNA, 56322 bp, Homo sapiens
  source 1..56322: mol_type = genomic DNA
tctattaaaaactcacattgatttattagaatatgaaaaagattcagtttcttctgtacaggcagcagagtggcagcagctgcggtggcttggtacgtggttgtcgatgtcacccttgcatggtgactcctgcccaaacagcacttgcatggagaggaggatggacagatgggccgaggacccatggcccagtcccctgcaaaaagggacactctgactattgcacaatcctgggggagtgccccagggacaaggggaaggagtgtgtgtgggcaaaggtctctgggggcccaggattctgcccaatccaccagccccaggggacaggggatcctcaggggaggccttctcccccccaccgcctccacaatgggctccacagcaggcagggtgtggtacacacaagggaaaggttccaggggccaaacccagggtgggggaagtaagagcaggccagcaggactggaggtcaggcccaagagctaggcaggtgccaagaggccagcatctgtgaggctggagagactcttgattaggagtgggagttacttctgatgtcacagtcttcgagcaacagttaagagcccagcaggcagagagacgtgggggaggggttggacagacaggcacagatgaggaagggtaattctggagtgtgaggagggagttagaggcagagcactgttcagccaggggttttcaaaatgttttaaaaacaggagcgccctctgtgcaaacaatcatatataggagtgtgaacaaacaaaacttaaaaaggcagcacattctggagccacggccagtccttcccctagcagcttcccctgaggggcccagtggtccccgtgggagcacagttcgaaaagctctgagtcacgtcactgtcaccgtagaaaccacccctgctccaggcagagacactcagagatgccctcagcccgcagctctgagtaaggacaggttgggtggtggccagggtgacagagctggcaggaggagtgtgagaccttggtgggtcagcagtccctcccccagccatgtgcctggtacccctggtttgtcccctgataaagcagggcctactcaagggaggcctcagctccctcccttcctgggtgggaccacagctgagccagagactctttggttagaaactaagattggtctgaatgaggaggaggatgaggcagagggaggagcctccgaggccctagtccaggtccgggagaagcctggatctagggaggggcagggccggcctcaccagccccagcagttctgccaaatggattggggaggcagctctggtggggaggatgcttcccgggaggcggcaggggaggagctgtgctggggtgggggctgtgggcccagctgccatgcggtagggggaggggcagggccaatccgggtcaggaagggcaaggggagcccccagcagcccctgctctggtggaagagtctgtgaggggacaggcgctgcctgctggccctggtgttactgccccttggggaagaacggttctccctccccaggctcagggtgtgggcctgggtcactgaggcagcgctgtatcctctgggagctggggctgtcactgggcgcgggggtgaagacatcgtcggttcctggggacgaagtctccttgctccgcatcatgatgcccccatcgtcgtcctcgtcctcctcagccacctttgcaggatcccggctcaaccctaagactttgcccttcagctcttcattcaccaggtccacagactcgggtgactgcggggaagccgggtcgatggtgatgacaggcaggtcctccttcggctcataggccagtgggtctggggaccaagagcaaggcacaagctgggttccgctctggagcccggcccagcacgtgccactcggccgcgtcagtgcctccttcaggccttctcatgagcacagccgtcccggtcccaacaggcctcagaagcaggcctctgcgaccttccaccccacagcttctcttcctcagactgtggccctctcctttgacaggggctcccagaggtgtccctccacaggccaaggcctggggctcctccctgagtcagtctgccctggggccctgccctcacgttccccacacgtgttgggggtctcgatggggcagataccctgccttcctgccaggcaccgtggctctcccagctccccacacagtcctcgcccggaacgtctctctccctagggatggcccctgacgtagaagcagctcatggcttgggaggggatcctgaggtcagcgagggccaggcctgtcctcccagtggctgaggactgttcctgtggagccccatcctcaggaggtggcagctcagagtgcccagtcctgaggcccctcgccaggcccttacctgagccgatgcgggcccgagacatggtgggtgagtccagcttgtgggctggcaccgtcaggtagttgttgatctgacagagaggacagacggggtgagcacaggcagctgggcagagggagcccctcaggacagaacccggccagtgcacaccccacctttcgtatatgcagggcgcttgctccccctcccttgtgcctgtgtgggcacccgtactggcccctcaggagctcctaagggctcatcccaggctcctgtcacagcctccctgaatacacctacactgctcagccttaaatccacccattcctctgtcccctgccactgccctaacccaggccatgccccacaaccccacgccaatcccttgcttagaactcatggctctccatgcccttacactgctaaaagcccctcgaaagccaaaccctgttcctagaatgggtacatttccttagaggctgtggcggagcttgggcgagtggggtgggatacagattcccagaggaaggcagaggctaccttctgctccagctgccgggccttctgcctccggagcagcatctggttccaggcttcctcgtaggggtctgccaccagcgtgtgtctgttgtaggaccgcagctgtgggagggacagcgtcagggcagtgcgggccccggaaggctctgctcatggaggggtgggggcagtgctggaggccgggccagtcctggggtgggtgccgaggggcacgggcagggcagggctgccgtagagaggggctgaagggctcctgtaccctgggggtcgggctggggagcaggccctcacccgctgcctggtcttctgcaagttgttcctcaggattttgcggatctcctcctccttgtccttggacagtgctggcaggatgcgctcggaaggcagggacttggggtggatgttcctggggcaatagggcatcggttaggtccccaagattcttgggatcctggtgcctcccaggtttggccagaaggaagtcaccctagggatgacccaggtgggcgccaaagcctcaggtccttggtgcgagcccacagctctcttgtccgccccaacaggacaacagaagaccccgccccccaggtggccacctccaaccgggcttgaggggccggtgtgtgggagcagaagctgcctggttgccccagcactcactgcatggagacggtggagacggcagaggggatcttgcccatgcccccgctctccaccagctcgatggcctgcttcatctccatcttgtggtagaaggcaatgagctggggctccttggagcgctcgccagctatcagacacttcttcacatatttcttattaaaccggttgagcctggtgggaggaggagggagacggatggcgccagcttccaggagtggggagatgcccaggcccaggagacccttgcctgcccctccctgcctgcccaccaggcctgccacctacttgtccttccagtggtggtgaccgtagtggccacagatgtcttcgatgcctgtcagaaggtggtccaggaactgaaaggggcccagggccaagtcaagcctcgctgtggggcgccttccctaccaagacctctgactagccccactccctcccgtagctgcagccctgctgggtccagccctgtggttccatgagcagccaggaggtggcgcccacactccactcatcgaacccagcggccctgactctgggtatctcgaagccttgcctgtgtccggctgagcccccttctctaatcccacctgggacctatgcctgggataggtttcaaatggaggcagagatggcatgatgccccctcctcaggctcccagctgctcacaccacaccttcctatggctagaccctggcggcctcctggggcagagggagcccctgggcactggcacagggagaaggggctgatggggggcagagacttgaggcccagctgctccctatctccctgttcctccttctgcaaccaagggcccagcccgcactccagtacctgtgtgtggatctcttcgttgatggagcgcttcgtctcttgctttttcttcacagccaacaggtctaccaggggccgaatggtcatgccctggggggcaggcaggtgtcaggcactccagttctgctacccaggcagggaggccacagagcctccctccctcaccccaggcccccaaggctaggatgccctctctgctctgctctctcccaggacccaagggtgtgagaactctcccacctcccagcacttatctaaagacaggtccttaaggcctgcttcttcctggagacacggtcagaggtttcactgccaaatgacccccacactggtcatctggcctgggccaggcagcagacagcctgggttcagatgtggactgcaccacagacttgctctgcaaccccatggaagtcaggccccacacacagggaaaactacctctgcactgcctccccaccaggactgtgaggaggaccgagtaataacagcagcagcagatggaactgcacacctgccatgtgaccaacacacgtgcttggaagtgttctagcatcaatcagctctccaatatccgcaacactaagagggaggtccttccattgtctctatttaacagatgcagaaactgaggctcagagaggataagcagctttctaagatcccagagaagcagtaaagccatgatttaaacccaggcaggctggctctggagggaggccccctccccaatgttgccttcaatgaaaatgggcttggaaaatcattagcacatacaactgcaaaatcaaggtaaaaaaaattttttgaagatggaagcagggcaagaggacaaaagtggcagcctcctcctctttttttttttttttttttttttgagatggagtcttgctctgtcacccaggctggagtgcagtggtgcgatttcagctcactgcaacctccacctcccgggttcaagtgattctcctgcctcagcctcccaagtagctgggattacaggcggctgccaccacgcccagctaatttttgtatttttagtagaaacagggtttcaccatgttggccaggctggtctggaactcctgacctcaggcgatccgcctgcctcggcctcccaaagtgctgggattacaggcatgagccaccgcgcccagcctctctcctttttcttaactcgagagagagtctcactctgtcacacaggctggaggagtcacacaggctcaatcacagctcacagctgcctcaatctcctgggctcaagctatcctcccacctcagcttctcaagtacctgggacttacaggtgtgtaccaccatacccactaattttttttttattttttgtagagacaaggttgccatgttgcctaggctgctcttgaactactgggctcaagggatcctcctgcctcggcctcccaaagtcctgggatcataggcgtgagccactgcaccagggtcccctctccctttaaaggacagaaaataagcccagccccaggtttcccctatttttttttctcaagagaatgcaaagatgtatcccatctagggctttttgagtatcagtgcccagaaaagacagaaaggatggtaaagaaatggaggctcagacagagtgtttcttatttgcccaaggtcaggcaaagtcaggtaaggcagagcaatttgcaccatcacaggctgggcttccttggggaccttaggcaggagagtggctgtcagctaagcctgagccgtttaaatgtacagaaatcactgagcagcaggctggaaggattcttgggaatcatctcgcctggttccctcactttacagatgggaactgagacccagagaagagtgggggtctttcttagggtcagagggacaccaacacagagctagggctgactccaggcctcctgctgcctggctcatagccctttccagttccccatgctgtgatattattcccattttacagatgcagaaactgagaccctaagatatgaaatctcttgcctaaagccctacaatgagttagtagcaaagagagatcttgggcctgttgactgtacccacttctctctctttttctttttttttgagatggaatttcactcttgttacccaggctggagtgcaatggcgcaatctcagctcactgcaacctccacctcctgggttcaagtgattctcctgcctcagcctcccaagtagctggaattacaggtatgcatcaccatgcccactaattttgtatttttagtagagacggggtttcaccatgttagtcaggctggtctcaaactcctgacctcaggtgatccaccccctcagcctcccaaagtgctgggattacaggcgttgagtcaccgtgcccggccagtacccacttctcttaatgctctatgagttccaaattaagttgggcagcattctggttcctttacattctgatcagtcactctgcaatgactcatcacaattctcactttacgattgaagaaactgaggcccagaaagggggagtggctcgcccaaggtcacacagcaagttagtggtggagctgggactagaatcgcatttcaaatcacacgctttcctctctttccacgggaacagcctgtgagggtccccaaggcaagggcctgccctgccctggcccagcacctgcacaaagacggtgaagaagatgacagtgatgatggcagtgaggaacaggtcacacatggggaagtgcttcttgtccaggaggtagcccagagagaaggcgatggcccctcgcaggcccccataggcgatgatgaactggtccttgggggtcagcttcacgatacggaacttgttgatgaaccaggtcaggcccagcacccctgcaggggaaggcagggggtgatgagggtcaggtcgggctgtccccagtccctcctggattctgcatcagtgatttctctgtgcatccaggaagtctccattacgaagcccaccccgctcactcaattcctgggtccctcagcccagagtgctctgaactcctcaatccaagagctgggtggatccttaaaggacttccccaacctggatgtgctttagagacatcatggaggcctccagtggctggagggctgggggcaggaagagggagaaaagatcaaacaagatgggtcacaggtcaatacttgttaaatgtgatgggtgtgtggggggtcatgatcctattctctctacttttctaagtacttgaaattttccataataaagcataaaaaatgcagagggctgggcccaacctccacccacagaaccagaatccctggaggatgaggctcaggaataaaggggatttcaaaagtgcaccaaataaatgtgaggtcctgccaggcttggggacatggacctaaccctcagagaggaagtgagagatccagggaggaggcgactgaggcactggggtgaggcatgtggggcacatgtgagtggaacccatgcacctggggcctggtccccacgtgtgccccggcctgctgcataggtttggaggactgcacgtggctctgcatgcgattcggcacatgctcacgtcacctgtcttgagacagtgcagagagcactcagctcagagtcacagacctgggttctgtgggcctcaggcccctcatcaggacagccacagccacaggctcagagtctcagggccccctcactttgacacagcctgactctgtccccagagaccacagccttgctgtgacacaggcttctccctgctgaagggcccatcatggaaatgggaagtccctcctgtctagctgtgctgggagcaggcaggagccaaccaggaaacctccaccacaaactgcatcacacatatacccccagcccctccacacacacacacacacacccaggccctctacacacacacacccacaccctcacagcccctccacacacacccacaccctcacagcccctccacacacacacacacacacccagcccctctacacacacccaacccctacacacacacccagcccttccacatatacacccagcccctccacacaactatacacacactgcaccacagcccaatccctccacacaacacacacatatatacaaagccctccacacaacatactacacacacacacccccaacccctccacacactacacacacaccatacacacatccagcccccctacaatgcactacacacaccacacacgcaatacgcatacacacacacaccacagcccagcccctccacacaatacttatacactgcaccacatgcacacaccacatagcctggcccttccacatagtgcactgcacacaccacacacacagcaccacagcccaccaccccccacacacaccccacaccacaacccccaccccgccccagccctggccctcacccagcacgcgggcgatgaggcagaagagcagggtgctgatgacgaaggtccagttccagtggtgggagccggccaccgtggagacgccgaggaagatgaagatgagggtctcgctgacgctgctccacatcttcaggaagtatttgatggtggtgtgggacttgtgggagatgttggcctccacataggggcgcatcaccactcctgaggctatgagcctggagcaggaaagagcggggtcagggctccgtgtcgagctgcacctgctcgagcccctccactgccaggggcaatggggccacgaccaaggtgcccatgtcccaagctcctctatgggccaggggcccgctgtgtgctttacaccctcttgccactcatcctcacatcaaccctatagacacggtgtattcctccatttttttttttttttttttttttgagacgagtctcactctgtcacccaggctggagagcagtggcgcgatcttggctcactgcaacctccgcctcccgggttcaagcaattctctgcctcagcctcccgagtggctgggaatacaggtgcccgccaccacgcctggctaatttttttgtatttttagtagagacggggtttcaccatcttggccaggctggtcttgaactcctgaccttgtaatccacccgccttggcctcccaaagtgctgggattacaggcgacgagcgcatgcccggccctattcctccatttttaaaatgagtgatcttggctgggcacggtggctcacgcctgtaatcccagcactttgggaggccgacaaaggcggatcacttgaggccaggtattcgagaccagcttggccaatgtagtgaaatgcagtctcttctaaaaatacaaaaattagccaggtgtggtggtgggcacctgtaatcccacctaattgagaggttgaagtgggagaatctcgaactcagaggctgcaatgagctgagatcgtgccactgcattccagcctgggtgacaagagtgggaccccgtctcaaataaaaaaatgagagatctgactctaagagaaatagtcacctctcccctgtcacgctgcctgcaggcagcaaagccaagacacacaaaccacagtgtccaactccaaagcctgcacctttgccccaaggccacactgcctcttgacccaataggagtcaatgacacagacccatggtctcctgggttcattcccctcaagcgtggcatctgccattacacaggggtctccacagggagctttgttccaagcagctgcttggagctcggagtcctcccagcccagtgctcacacccgggctctgctcctgggagccaggggctctgaaccccagttctgccttgctcggcactggaacaccttcacccctcactgcctccccacatcccattctccccatttccagacccggtggagacctcaggaccgccaggactcaggcctggtgagcctcctactggggctgctgaggggactccctttgagacaatgaagtagcagggctgtggctttcctcaacctgaagcttagtggcttccaaggctctgctctcctataccctgggcttgccttcatgcaggtcattcttgcttcatctgctcatagcctgaaatgccctctcccgattcctggaccccagggggcgctgcagaagtgctcctcttctaggaagccactgatgcccttggccatttaaatggctaccaagcaggtctggagcctggagttcatgtctcatccctggagctcaaggctgggccctgggagctccgtgaacctacgagcctggggaatccaagctggcagcccccgcccccaccccgccaagcccactgcctgctgcacgcagactcacgccatgatgcctgacaggtggaagagctcggctgacaagtaggccatgtagctgtagaggaagacgaagagcggctcgatgacccggatgtgggaggtaaatcgggaggtgaaggctgcgatgaccccgtagaccacgcccacaagcaccccgcccagggccaccacgaagaagctcaggaagccgaggaagatgtccacgatgcccacgtgttcgtagttggcaaactcctcaaagaggtgatacaggacctggggagggtgtgcaggctggtgggtgggaggagagggccctggccccacggttccctggggtccacccagggcaatcctgtcccctccgttaaccatggccacaagaagaggccacacggtagcagagaaaccctagtgccaagcaggtgctcaaaacctcagcctggggctgaggggcttgctctgggccagccacgtgccccactggtgaagggtgggccctgggaagctctgtgaagaccctgaagccaaactgcctggactggaatcctggctctgccactcctgagttgtgtacaggaagcaaattcatctccctgtgtttcagttttcctgtctataaaatgaggataataataccaaatcttaggactgctgtgaggactaaatcagcgaatcaagtgctcggagccttacctgatgcagtgttagccacatctggtgctatcaagtctgcctctcactgcctgaccttgggcacgtcatgcccatcactgggtttcagtccctccttcagcacaaaaaagggacgttcacacaatgaactagaatgtcatttcttaacctctggagctttctgaaaatacacatgttcaggccatactggacttggactctctgggatagggccaagaaatctctatgtaacaagcaccccaggggttgcaatgaacagccaagttcagatgctatggaattagaggctaaggcatccctgtctcctggactgggaaatagatggtcattgcaacactaccatcagatgtttaagtggcacttcatacactgtaaagccctttgatagtctttatctgagtcgacactcaacaaccatgcgaggcaggtgggtcaaggatgctcctttgctaaaccgaggctcacagtggtaaaacaacacgccagggggcccccagcccaggagcagaagaactgggcccagaacttattccctgacagccatggctgaggcctccccagcaggctcagctttgaggatctgcccctcctattgctaggtccctgagctgcctggcctactcaagtctgtcctagacagctctgccaggaaggagcagggagtttccaggcctgggggaagggagggaaggacgtgaggatccatgacagggaaccctccaaagcccccaggacctggagcaggaggaatggaccgtgaggagtgacctgtctagggcacagacctgagaccaggcagctcagggtcagcctctggctttactctctgggaaatggggcactcacacctatgccaagagctccagaaagacctgacttgggccaggcagcaaggggagatgcagagcactggccaggcctggtgcggcctggccccagctgtctgggggataggacagggctccagcggcagacagcctcttagcaggtgcgtactcagccgtgggctaaactcattcctggcctgaggggattcatgggtcctcatggtctaccacatgggcccatggagtcggcacagaggggaaagtcctcctttctggcctggtgctattacccctggaactatagagaaacagagtaacacagtggtaagcacttgggctttggactcagactacggatttgaacctcagctatatcatatatcaggcttatgtaacctctccgttcctcagtttcctcatcgcaaaaaaactggaatataactgtgtcaacctcatggagttactgtatagattaaatgaggcaacataggccagacacagtggctcacgcctgtaatctcagcactttgggaggccaaagagggagcatcgcttgtgcccgggagcttgagaccagcccaggcaacataatgagaccccatatctacaaaataaataaataaataaataaataaattagctgggtgtgatggccagcacctgcagtcccagctacttgggaggctaagaggggatgatcatttgaggagtttgagggtgcagtgagctatgattgtgctactgcactcctgagtgacactgtctgtgtgacaggagactctgtctctaaataaataaataaaaatgaggcaatacacattcagacaggaagcacccaatgaacaccagcaatcactaccaccgctgccactgcctttgggagacatgaccatgggtccacaaatggctgggtctgttacctgcttgatgcaaccatgccccaagctccacagcagtgctcacctgaaccccaacacccagatcccactggagagggctttatctttggcactcactggcttcacagacattagtgagtatgactcactaatgtaagtaatcctgtaagaagcctgggaggatgacaggctgagtactgcaatccctgtgtcacagatggggaaactcaggctcatgtggtaaccctgggcaagagctagtgctagaggaagccaggatggaggcctgcctgctcaggtcaggctattctacccagccccatgaggaggcgtgggaggaacaggaagctgaggctgccagcagctgaacaccacagtctgtctctactctgaggtgctgcttcctgaaggctggggctgcagaggagggagtcatggcctgggaatgcacatgtgcccttgagctttcctgtgtgtgcagctgctctgagcgggacagctcaggagggggtgggagtgttctcacaacacaacgtgagcatgcacatgcacacatctgtttcccaaggaaaccagctgggaggaagggcatgtgcaggtgtatatggtgctaccacgtgcagaccctggaggaaagcactaatcctctgccactttgcagctatcaaaggtgaggctggctgggcgcagtggctcatgcctgtaatcccagcactttgggaggctgaggtgggcggatcacctgaggtcaggagttcgagattagcctggccaacatggcgaaacccagtctctactaaaaacacaaaaattagctgggcatggtgacacacgcctgtaatcccagctacttgggaggctgaggcaggagaattgcttgaacctgggaggcggaggttgcagtgagctgagcttgcgtcactgcactcctgtctgggagacagagcaagactccatctcaaaaaaaaaaaaaaaaaaaaaaggtgagggccacagaggtatagcatttgcttaaggtcacacagcaagcaagtggccaacttcttttacttatcaccttctagatgttttggagacaaggcccctttccataatctccgcccaaaaactgtgcacaaaccgaattctaacttaagatatagccaacatgagagctgaaaggcccctcacagatgatatggtctgtgaagagggaactgaggcacagagagtgtaagtaatttgcccaagctcacatcaaaatgcaagagaagggccaggcttgttggcttaggtctgtaatctcagcactttgggaggccgaggcaggaggatggtttgaggccaagagttcaagaccagcctgggcaacatggtcaaaccccatctccacaaaaaatttaaaaaattagccgggtgtggtggtgcatgcctgtagtcctagccactcggaaggctgaggcaggaggatctcaggcccaggtatttgaggctgcagtgagttatgaccgtaccagttcaccagcctagaagacagggcaagaccctgtctcttaaaaaacaaaaagcaagtcaagtcaaggagggagcatataacctagcaaaaccaagagcttaggccctggagtcagtcagacctggttcaatcacaaactggttcatactccaacaggttatttaacttctttgggcctgtgtctcccctggaaaatgagaataataagcacctcttaaggcagccatgaggacttaaatgagataatccatgccgaagggctcagcatggtgcctggcatacgggaagcgggaatgtgcctcagctgtttttattactgttattagcgggtggatgagggattcactggtgggcctggatttgggtttgtaccgtttggacatgggcatggcccctggcctcctcaccacagtgacggcgtcattgagcaaggactccccaaaaacaaggatgtgcagcagctcattgatgtgaatttcctcaaagacagccagaaccgccacggggtccacggccgagatgatgctgccgaagagcaggttgtccaggaggccgatgttgttgatctgctcaccgcccaccaggcacacggcgtacatgaggccgcccaggaagaaggcgttccacagcgtgcccaccacggcaaagatcaggatggtgcccaggttttctgtgaactgccgcagtggcaggaagtagcccgcatccaggatgatgggcggcagcaggaagaggaagaagacgtcggactgcaggaaggggggtgtctcgcctacacccttgatcaggccccccaccagcagccccaccacgatcagcaggcagctctccgggacgatgcttgagatagtggggatcacatggaaacctgcggagggcgagagaacgggaggccatgggctttcggaggagccaggagaatagaaggttggggatgggccggggatgaggagcgcagttggtgagaggtgcacaggctgggtctcagagggctgctctgttaactctctgagcctccgcttcctcgcctgtaaaatggaagggacaatgctagcttcacaggtttgccatcataaaccaagtgacagtgtttttaaagcacttttttcaaaggatatatacatgctatctctgtcactgtcataaaatgttagaaagcagcagttctatatgcttccagaaggcagaaattataaattgattactgacgtgccaagtacctacgggcatcacctacgcctgaacccaaggcattattccaggcacaagttcagggaggcagatctgagctcaacctgaggaataacaatctaacaattctgtctgagggaagatggtagttccctatcacggagctgtttaagcagaaggcagacaaccagctggtggggagtggcataggagacagaagaaagcacagaagaatctaagaataccagcgtgggaaggaacttggggataataaggcctggggtctgcaaacctgcaaaacagtaggctttcctactgagtccaggcagctgctcaagacacggctcaaggatgtcagtggcaaccagctttggcaggtgagataaaatctatttgctatcccgcttctagctcaatgccacccactttaaagatggggcaactaaggctcagaaaagggaagggacttgcccaaagtcacacagcaagtggggagcagaactagaatagaacacaggtctgatgccccagttcccatcaaactgcacagttctgtaattcaagctctcctatccttccctcccatcaaggcctcctcacacacccctctgcctgggacccaccagccatctccccaggccgtgtcctggccagcaacaggccgctctgctgtagtccaccttaaggcttcaaacccagagctgaggagtagcaaaaatccccgttgagagggcctctctcaatatcaggtatggccagagaaccctgagctcctgtgagtggtttacttgtttgttttgttttggggtgggaaagtaggtggaaaaaaatctgagcatctagttgtatgttgggtactatgctcccagggttggcatagccaagagggtttgtccctttgctcaagaggaaagctctctctggcctggcatggtggctcatgcctgtatcccagcattttaggaggctgaggtgggaggaacacttgaggccaataatttgacaccagcttgtacaacataggagacctcatctccacttaaaaaaaatagctgggcatggtatgcacctgtagtctcagctagttaggagggccgaggcaggaagatcacttgagcccagcctcaaaaaaaaaaaagaaagaagaaagcaaagctctctctcctccccttccctatcttgcaagctctgtgcaggcagatcccataactgcttatcattatacacccagggctaggacacaagaagtgctcaacaaatatcagctgacttgaaaatacacagggctgggacatcacccaagatttccgataacctgcatgcctggccaggcctctgctctcattacttactcttgagatccttgggacagaggaggaacttccctctccatgcccaaagcccttcctactctcaggtaggaatctgggcagtgctagtacggtgacaagtcaaagttcacactgctggctgggcacggtagctcacgcctgtaatcccagcactttgggaggccgaggtgggtggatcacctgaggtcaggaattcaagaccagcctgaccaatatggtgaaaccctgtctctactaaaaatataaaaattggccaggcgtggtggtgggtgcttgtattcccagctacttgggaggctgagacaggagaattgcttgaacacaggaggtagaagttgcagtgagccgagatcacgccactgagctccagccaagatcactccactgcactccagcctgggcaacagagcaagactccatcttgaaaaaaaaaagttcacacactgaacactatccaggcccagaatcctggcacagtgccaagcaccctgaagacactcaaaacacattgggaaaaaaagatgtctccatcctaggccaagaggacctcgaaggcaccatgtgcattctcctgatttcaaaatagacatgaccaaaagtcactttttgttcatctacttcccacatcaataaaagggaaaataattccaaaatcaccccttttgctgaaaagtcccccagtctttgtactgtccaccagtcaacatccagtgtgtagctggctggtccactgggaagggctagtcatgttggacccaagtctctcttgctgtagaggataaagcccacattttcagcactgcctctgtcatctgctcttgcctcatgtcccattctccccactgtcaactcttaggtttcagccttgccaaattccttgcaattgccccatatgagccacatcctcttttgcctgccaatcttcacctagtctagttcctctctctagaaatcattcctctacctctacccccaccatatgtggctgacaccatatcctctgcctgcctcctccttcaggaagcattccctgaccaccacctgtctgctcaggttagggcaggaatcttctggtgcttccctctctcataaccttcaatccacagtcatctcccaggttcctctctctcttcctggcacccaccgagatcagtcagacaacccaggcagaagcagctgagacaagacaatggcatcagaccccaaagacctgcagtgtgctggaggggagacaggcacagcgcagcggagataagcaggatgaagatttaggggagcagagctcctacaggcaggggccagaaagcaccttcccaaggccggaagtccagctccagccagctgcatgctgacccccctccacagcctccctgcccctgtcctggcgttagcaccaagagctgccttaagagaaggcagagtctaaagagatagtccagggtaggcagatgatggcttccacctccacctaaggggtcgggctctaaaaatgcctcctaccctcactctgtgccatcaacccaatccacagagctttcctggccccataaatcgccagacagtgcctgggagacccagagaagagttggccacagctcctgcctggggagggggcaggcatgtgaaacaagccaagaacagcaacatgaagacggctcctcaggtctgagggcgtcccatgagccagaactgtgctgggagcctggcacgcaccatctcattcagtcctcaccacagcccttgggataggtattgcctccattttgcagaagacaaagctgaggctcagcaaggttatgccactcccctagtgtctaagggaggacctctattctagcttaggtgtctcaaaccggtagcagagagcgctaattaattctttagtcaaagctcggtattttctctgagccaggccatatgggacactgggaacattgaggtgactcagactctgaacctccgtgagcagctgatggggagggccatgctattccagcccttggagcttctatgaccaggtgaacagagagctggcattcctattgaacacaagaaaaacgagctctgagaggaggctgcatgcactcagccaggccaaccaggactgggtcccgggcctcctgactacagcacagcgacctccttctccttcagccagctccagagtacctggggctggagccatgttcctggagctggtttccctggctttcctgttttgtctctggcgctcagtgagctgaaggagctctaggccctgatgggctctctgggcctgaggggagggccgggccgggccaggctgaggagaaaggtctgagatccacttttggctccctgcctgtgggtaggtggcacattattggaaagcacttctagggctgggggaggaagggattctgtcatcaagaggaggctccttcaggagcaacggctcagggaagtgggaagcagcccctggacctgcgctggcttgtccctctcctaacgccctgactccaccaactgcgctcactctgcatccctgcagagtccccacaaagagcaggatgcttgctgacacccggtgtggtgaaaggggcacagaaggatggctgcggcccctggtaccctgacaaaagccctgcatggaggcaagatcccaggatgccaagagatgaggcaaaactttcagggcccaaacatgcagcagcagtgatgtcaccagggtgaaatcagggatgggaagaggcagttagagtaagaaccagagtcgtaagagctggaatggatcttggagagcatctaaattctccattatatagtcagggaaatggagacagagacagccagtgacctgtcaatgatcacatgtccagttctaccccagcagtctgtgacactccaagccacacagccttcttcgaggacgtccagtcctcccagaacaaggaggcacgaaagtgtggaattcaacatctccaagcacagccacaggccaaaccctctgacacagttcagagttggcgctccttttagaagaggctgggggatgggagaagtgtttttcattctatctagtgtaggtggtagctggaacgaacacacacacacacacacacacacacacacacacacacacacactcttgctgagcagacacctcaccaaacttccaattgatggaggctcccagccccctgcggctgctctgcaccacaagaatgttttatttatatctcctcggacggtccccatctgttgagactggctcagtggagcaggcaaggctgtccgacatcaccctgggttgccagggtgaccagacatgcctgatcccccttcccgcaaccctcctctggcctgggaagtcagaggggagtgctgggaagaggggtctctttggcccatagtgccaggtcaccagggacccaggggcacactgagggctctgtcgccctacttccaggcctgaggactgctctggggctgcaactcggccaggtcccaagggattcctagttgcacaatgattccatttctttaactccctcttcaactgccccagcaaccagtctcaactgcagcaatgaaaggtaatacttcccaatgaaagcccagcactctacagtttacagcggcacactcttaacccatttgctctccaccatagttctgggaagtcacaattaccatccccttattttacagatgaggaaactgaagcacacaaaggttaagcaacttgatcaaagtcacatggctggtaactgggattcaaacccaggtagtctggctccagagtctgtgttcttggccactcactgtattatccctggctttattcttactttgtttctaaggggcgtgtgagcctaggactaaagaggcccaaagcagttcccaaagggccagcggtaggtttttctttccatgagctcttctccaggaagtctcccactgcttctactctagtggcctagtaaagacttcatgaaatccttcctatcttcaaaggctgccctctccaggaagctctcctaagttaactcagccaggaggggaaggttgcagtgagccaagattgcaccactgcactccagcctggtgacagagcaagactccacctcaaaaaaaaaaagtattattcattgagtttctgctgtggggatgggaggttttttttgttttgttttgttttgttttgttttgggggggcggagtctcactcttgttgtacagtggcgcgatttcggctcactacagcgtctgcctcccgggttcaagtgattctcctgccttaacctctccaggggctgggattacaggcacccaccatggcgcctggctaatttttgtatttttaatagaggaggggtttcgccatgttggccaggctggtctcaaactcctgacctcaggtgatccacccaccttagcctcccaaagtgctgagattacaggcgtgagccaccgcacctggccaaataatactttttttaaaatgtagcagccagctgggggtggcagctcacgtctgtaatcccatcactttgggaggccgaggcgggtggatcacctgaggtcaggagttctagaccacagtgaccaacatggcgaaacctcgtctctacgaaaaatacaaaaattagccaggtgtggtggcaggcgcctctaatcacagctactcaggaggctgaggcaggagaatcacttgaacctgttaggcagaggttgcagtgagccgagatcacaccatggcactccagcctgggcaatagagcaaaattccatttcaaaaaaaaaagataaactctccagcacccaggagacaaacactggacacttggagaatctgatgcaaggctctgtgcagggggcttatacacaccccctctcatttcatctcacatcctgacccccaatttgacagatgaagaaatccaggttcagagaggtaacttgtccaaggctacctagctgggaagtggcagggtcattattagaacccagttctctgaactgctagttctttgggccatgctgcttcaaagaaaacagcttgtcaggatcaccaggaagagaattcaagtctgcaataaatatgcctcccccacaaaaacagccataaataaatctgttccaagtacctgggcaagcatccttccccatacccgggcaatcagtctctctctgtgtttttccccatcattcttccaaacagcacttctatttcttgcttgtttcaatccacatttcagggggtcctactatgttggagagaaagggtctcaccctctgggaacatcaggtctggatgggaaagcaggtaaaaagctgtcagaaaacacaagcagcatacactggactatctgagtcatggaaaagagaagaccgtgcaaggaggccaaaaccccaggtccagaccccactctgccctttagtaaccatgagctttgcgtaaatcactataccatggaataacctccattttcttgtctgtaaacaagtgagaacagggactagacacaggagcaccttgtgcactgaaacgactgagaaaagagaggtcaggcaggctggggggcctgggcggcccctggagtaataagcagcgattgagccagcagcaactgccttagagacctggcaagagaggctgttccggaggcaggcatgttgtgatagaggatcacagcctcagcaaccctggcactgggttacaaatccctcacaatgcatagcctctccctctctccttcctttctcctctcacctgtcccatctacatcaactccttgactccagtgaccagaagtccccaaatcccacctctaagcaaacagcaggaaactcttcctcacctggaacttctacccacctttcaaaactcagtggagggccgggcgcagtggctcacacctataatcccagcactttgggaggccgaggtgggtggatcacctgaggtcaggagttcgagattagcctggccaacatggtgaaaatccatctctactaaaaatacaaaaaattagctgagtgtgcgcctatagtcctagctactcaggagagtgaggcataagaattgcttgaacctgcaggcgcaggttgcagtgagccaagatcgcgccactgcactccagcctgggcgacagagtgagactccatctcaaaaatacaaaaacgaacaaacaaaaaaccccagtgcaggtgtcacctcctctgggaagccttcctggagccacacccccgccctccccaggctgagtcaggtgcccctccaaactgaggagctgtgttcggtgcctcagccagcctggcatcccagcacacagctctggacccccaaaaagtgatgctcagaaaacacgggttaagggaatgatgaacacttcctgaaggatgtaggactagagtttggtctcaaaggtgggtgactaaagggggaagagtgtgaacaaatgaaaagagaggggacctcaaaagccttttgaggatcctgaagcctgcagccagcctggaaatgagagtgaacagtgcaggagatgctggcacacaggcctgacccgggcagatcaaggaaggaactgagtcaaggagcctgagccaacagagcaggcctcagagggtcccctgaccttcagcctggccctgaatgccccatcctagcctgcagcctggttctaccaccaccagccttctccctgggtctcaaggacccatttctgtaacccctataccactccaagctggggcagcacctcttggtaaccagcctgaccttcccaatcatccaagctctgcataaacatttgttgaataaatttcactccagcagattgcccctccccctgcaggaaaggcactggatcaagagtccccatgcagtgaagcagaggatgactcacaggggagagggagggacagggactgggaccggcagtaaagagcccgtgttgtgttgacaagaggcagagctccaacaggcccaacagtgcctggcaagggagaggtgccaggcagtggggtgcttacctggggagggggttacctggggaagcggtggggggcagctcagggggtcggctttacttggggcaggggtaggacctcaagctccaaagactctcatggctggattgggtgtctggtaggtgaccatatgatacacactggtttcttttgattttctcaaaatggaaatatattatattgctttggtgattttaaataaaacttatggtcattaaaatttttttctaacagtcatataagtgtttaagtataaggaaaatcatctcacagtgattctcccccttcccttttaccaactataccagtctcccccacaaccgaatttctgttaagtttggtatatattcttgaagacttttctgtatctataggttatttaaaattatgtgtgaatggtaaatcacacatgctgtgcttcaactgcttctatggggcagagactgcactaagtactgaggcatctcatttaattctctcaacaaccctaatgcagtaggtataattattatccactttttatttttattgggcttttttttttttagacagagtctcgctctgtcacccaggctggagtgttggagtgcaatggcacaatcttggctcactgcaacctccgcctcctgggttcaagtgattctcctgcctcagcctcccgagtagctgggattacaggtgcccaccaccacacctggctaatttttgtgtttttagtagagatggggtttcactatgctggccaggctggtcttggactcctgacctcagctgatccacctgccttggcgtcccaaagtgctgggattacaggcgtgagccaccgcgcccagcccttttattgggctttaaaaaaaaattttttttttgagacggagtcccgcacagtcacccaggctggagggcagtggcacgatcttggctcactgcaacctccgcctcccgggttcaagcgattctcctgcctcagcgtcctgagtagctgggattacaggtgtgtgccacgcccggctaattttgtatttcaagccaccatctccctcctttcctttcccagtgtcccggatgtgtggctccccagctcaggtgctccgttccccactccatctctatccctggcctgtccttgcctcttgccagactgctgtcaggacttacagatggtatcaggtgctccaggtaccagtttgccccacacctggggtggggcagaggtgggggaagaaacagaggctcagtaagagagcttccatttctagaaactttagagccatgggagagctagatttttctttcctctttgctgggggtacagtagagcttgcaaaatgcaaatctgagagaaaaaaaaaattgagtataccaaatatctgttgttcttagtattgcttccagttgaaagtcagttagcttagaagcttaccaatgtgttaaattcattatatataacttcaacttgcttgaaatctcatcctacttggctacagaggtggaatataaagaggtaccagtaggaaagcaacacaaaaagaaattctacaatttccaggacaattgccctgcagaaagcaagtcacagtgtcctattttcagcactacaaggaatgcgggggaccgcaaaggaagaacaaaacacaggcggcactggctgggtggggaagacagaccagcagcctctgggaggcaactggggccccttctatccctagtagctttatcagctttatggggtctattgtgtgccctcacagcatctgagggcagtgatgaagaaggggtgttagccatcctccacttggacattttagtgacctctcagaagggccagaaaaggatcagtgagagaaaatgactctcaggggacagagcctggagtagggcagaaaagatggggggccttcccagaggtgggggcatgagcatccttaggctggtgtgttacggtgtgcatggggtggactgcagaatggcaaatgcacaggagctgggtgctcctgacaggaaattcttattttctcgtccccaaacctgctcctcaggccccaaattttggagttgtcctaactcctttcttcctctcactcctgacatccaatccatcaccaaaccctgctggttctgccttctagacatgaacagaccctgacacttctcaccgcctccactgctaacacccatccaagccagcacaatcacttgcctggaccactgcagcagcatccaatcagtctctcttctcttttccttccttccttttctttcttttttttttttttttttttttttttgagaaacagtcttgctctgtcatctaggctggagtgcagtggcgcaatcttggctcacttcaacctccgcctcctgggttcaagtgattcttgtgcctcagccacctgagtagctggcattacaggcacatgctaccacacctggccaatttttgtattttcaatagagacaggatttcaccatgttggtgaggctggtgtcgaacccctggcctcaagtgatctgcccaccgtggcctcccaaagtgttgagattacaggcctgagccactgcgcccagcccacatatccactcttgccccccaggctcttcctacaccagccaagagtgaagctttttttttctttttgagacggagtcccactctgtctccaggccggagtgcagtggcgcaatcttggctcattgcaacctctgcctcctgggttcaagcgattctcctgcctcggcctcctgcgtagctgggactataggcgtatgccaccacgtccagctaatttttgtatttttagtagatgaggtttcaccatgttggccagggtggtctcgatctcttgacctcgtgatccgcccacctcagcctcccaaagtgctgagattacagtcatgagccactgtgcccagccaagagtgaagctttttaagaggtaagacatactactgaaaggcagggactacatccccctccgcgtctttccaccacacctgaatctccactcactgtcccctagctctactggcctccttgcttttccttgagcacaaacatgcccccacctcagggcctttgcatttgctgttccctgtgcctgagacactattccccatgtaggtgaatgacagattccctcccttccttcaggtccctgctcagatgccacctccccagagaggtcctcccaaccctctctatccgcttacccttgccacttcctgacgtctagatgtgctttctgaccgttccccacccagaacataagcctcgtgagggcagcctctgtcccaatcactgttgtatccctggcaccttaggctgtacctggcacacaggaggttcacaatcaatgtttgctggatggatgactttctcttacctcagtgacctcacaaggttgtgaggattacatgagaccacaaacacaaaagcactgggcgaaccacaagatgttgtcgggggggtcaccatcagcttgtcccttggagagccactcttccaaggtgctgctcagcagtttttcctaaataccccagggagcagaacccagtcacgctcagttctgtggcctgcagagcctgggaccacacagccctctattaagagtctgatgacacggcacagctggttggtctgtctccccctccagaccacaagcaagtttctacctgcaagcaaggctagggaccctgtcctattcatctttgactctctaggcctcagcacggagcctgacacatagtaaggataaagacttgttgagctagcagaactgtttgagggcagaagtcatgtctggtttaactttttttccttcccttttgtgtatatatttttgggtttaacttaatctccagtgtttggcactaagcacatggacactaagctccagctgaattggccttttccttgaaggaagggtgagagttaggcaccaagaaggcctggcaggcaaatcagcagcatctggaaagacaggacagggaaacgagtgtggtacaggtagaagatttattttttgcggggggagggggcagggaaaacagagtctggctgtgttgcccaggctggagtgcagtggtacgaacatggctcactgcagccttgacttcctgggctcaagtgattctctcacctcagccccccatgtaactgggactacaggcgcgtgccaccatgcctagctagtttttgtattttttgtagagataggggttttgccatgttgcccaggctggtctcaaactcctgagctcaagagatctgcctgctttgcctcccaaagtgctgagattacaggcgtgagccactgagcccagcccaggtagaggctttctattggagcaaatggcagtggactggagtggaaatcattacttagatgctgtaaagcagacttttctctcgccctcacaacatgccctggcagtgggcaacagatgagagaacagacattgagagaggtccagacacaggcccaagatcacatgggtagcagcggaggcaggtcccaaacccagaactactgactcccaatccagcgctcagccaaggccagttatgaaaggccacaaataccctgcagggagagaattcccaatcaccctgctgagccaggcagagccactggagggctctggcctggggaacaacatgaaattctgccacttcagggaggtggtcaagggagacagcgctggccacccaggctcagcacctggcatagggcaaagttgtccaaatgcacagccatttagtctcagctccagggacagctggcactgcctcctgcacaataccagcaggatgggtgagcaccccctccatcctacctccaaatgcctcaaaagaccagaaaactacaattctgagaaaagaaaggcctgagtcaagcccaggctggggatcaggggaactgggcttcagtctagactcagccactaacattctgtgggctttgaacaagccgttgcttctctttggtctcagtctctccatccttgggggcttgttgagagcctctctacctctgacatctgactgatgaactctgcagctggacaaagtcgggctctgtgatactcaccatctctgtccatgccagcaactgtggcatctgggtacagaatagcattcgtgccatagcaagcttgcacgaggcagcagcgggcagcgtaaagagctctggtccatcaatgagggaggtagtttctgtcccaattctaaatcttaacttctctgtgacctaataaggcaaatcacggtactgccctgaacctcagtttcttcctttctaacattgggataaagaatgtctatggcacagcgttgctgtaagaggagagaacagagacagaaacactcagaaaaaagcaaaaacaaaaatatatgcccaggccaggggaggtggctcacacctgaatcccagcagcgggggaggccgaggcgagaggatcacttgagcccaggagtttgagagcagcctgggtaacgtggcaaaacccatctctacaaaaaatttaaaaattagttgggcatggctggtgcatacctgtagtcccagctactagggaggctgaggtgggaggatcacctgagcccgggaggttgaggtttcagtgagccgagatcatgccaactgcactctatcctgggcaacagggtgagaccctgtctttaaaaaaaaaaaaaaaaaaggccaggcgtggtggctcatgcctataatcccagcactttgagacgccaaggcgggcggatcacctgaggtcaggagtttgagaccagcctggccaacatggtgaaaccccatctctattaaaaatacaaaattagccgggcgtagtggtgcatgcctgtaatcccagctacttgggaggctgaggcaggagaatcacttgaacccaggaggtggaggttgcagtgagccgagatcctcacgccattgcactccagcctgggcaaaaagagggaaactccataaacaaacaaacaaacaaacaaacaaatgcatgcacgcacgcacgcatgccagacactcccgtgcagatctagattcccagaaaccagcagcggcagggtcccagaggcaagctggcagcactagggaggcaagagcttctcctaaacaggcacctgagggggaagctgtccaactgcacagcattaaggctccatgggcagcaggcactgcctcctgcacaataccagcaagatgggtgagctttcctgatactggatcctctatctcaagggggtcccctaagggtctcccatacacttctgataacgatccagctggctgggctctgtgtggtgggagagacagggcatgcttggagggcctctccctgcctcctctcccaccacactggggatagtttgtcacttcaggcctctaggagccacgagatgtagagtggataggagaactgagcatgctcagaggaggctgccctttagaggacactgcagagaaaagatgaggacacggccagctgcagggcttggtcctggtgccaggaaggcccagggctctagaaacagcaatgggaggtcagctctctcctgtgggagaagaggggcagcaagaagtcagagattagaagagggagggccctctgagaccatccagtgcaacccctctattttacagatgcaaaggatgaagcccagagaggggacggaacttggttgacgttacacagcaaagtggtagcagagctggcacacacacccaggatggtccactccaaaactggtccttgcttggaacatggtgccaacccccccattccactcccacttcttttttttaaactaccttctattgagtgcctcactttgatgctctgtatacttcaatcacgattctcctagcagccctctgacacagggatcaccctcctcattctacagctgaggaaaccggggcagagagaaatggtctgactccagagccatggccccaaccatgctgcctgcagctctgagccccagttttctggaccaaatggtgggtgtggggagcaggagccctggtttattgccaggtctgtcactcctttgctgtgtgaccttgggcaggtcactcacccattctaaactgttggtctttcattttgtttgtttgtttgttttttgagacagagtctcattctgtcgctcaggctggagtgcagtggcacaatcttggctcactgcaacctccgcctcctgggttcacgcgattgtcccgcctcagcctcctgagtagctgggattacaggcgcccgccaccacactcggttaattttttgtgtatttttagtagagacagggtttcactatgtcggccagactggtctcgaacgcttgacctcgtgatccgcctgcctcggcctcccaaagtgctgggattacaggcgtgagccaccgcacccggcctaaactgctggtctttctaagatccctagcagtaccagtgtgccctggttctgtgtgtgccttgcaaggagagaagcaggagctatttggcaccctagtaatgggaaatggagctccactgacagcagctccccagactgggtctagcctgcaggcctctgctcaaaacccatgtgcaatgcctcaggagacacagtgcagccctccagcacatgccactgtgggaagggagaattactacgaagccctgtgccttctcatttagcctcagcaatgccatgaggtagacactactgtttcaattttccagtagagaaattgaggctcagagcttaatgaactagctcaaatgacacacagccaggaaacaaccaaactggtatttgatcccagaagccaagctctgccctcaagccgggcctggttaactgcttcctgctggcactctggtcctcagggcacaggttctagagcccactggtgataagctgagcacaaagggccaagggctccaggcaggctgagaggttgcctgcctgcctacttgtctgccaaccagttcaccccatagaagtgccccatgcccaggaaggagataaggaagcctttgtcagtgcccacttccgcctggcctgtgctggctgctgagactgggcagggcccatcgtgtgatcccacacatggcactggcacaaggtgtacatgcctccctccagcagggcaggggagatgcctggggcagccagaactggggaagcagccaccactgggcaggacaaggagggtcaagaattcaggcaagagccgtggttcttttttcttttttgccacccacccccagaccatggttctaacgagccctgtcacgcagcgtccagttgaaatggggatgttaataataatgatagtggctgggtgtggtggctcacgcctgtactctcagcactttgggaggcttagggggagtggatcacttgaggtcaagagttcaagaccagcctggccaacatggtgaaaccccgtctctactaaaaatacaaaaaaaaaaaaaaaaaaaaaaaaaagaggcagggcacggtggctgatgcctgtaatccgagtactttgggaggccaaggtgggtggatcacaaggtcaagagatcaagaccatcctggtcaacatggtgaagccctgtctcttctcaaaacacaaaaattagctgggcgtggtggcgcgcgcctgtagtcccagctactcagaaggctggggcaggagaattgcttgaacccaggaggtggagttgcagtgatctgagatcgcaccactgcactccagcctggcaacagaatgagactctgtctcaaaaaaaaaaaaaaaaaattatccaggcatggtggcacacccctataatcccataatctcagctacatgggaggctgaggcaggagaactgcttgaacccaggaggcagaggttgcagtgagcatagacggcaccactgcattctagcctgggcaatagagggagaatccgtctcaaaaagaagaagaagaagaaaaaaaaaatatatatatatatatatatatatatatataaaattatggctacacttattgaaggcttcttaatcctcacaactattcaaagaggtaggtgctatcacaccaatatcacagatgaggaaactgaggctcagagaggctaggttacagggccaagcaggactcaagcccagaaactgactctagagcagacaggtactcatgctcaactacttcctcatacgagccacagagaaaatgatctggatgagtattttctcaattctccaaaaggaggacataaccacagttctcccagaatgttcaaaggagcaggctgggggcctcagtataatggtgactgttgtcatcaatggagaggaaagaacactgtccctgagcaccagtccccatactaccctctttcaggaagtgacactctgggtctcgggtttgctcggccatataatgaggggaatggactatgtgacctcaaatggctcttttgccctgactccctaggattcaaggtcacccggttccactgctttcttgtgtgtgtgatcctgggtaagttagttactctctctggacatcagggtctttatttttaaaatgaagatgcctctcccctcctcacagggtcaggtgaggaccactcaaaatgatgaaggcagagagcctagcataggaccagacaaagcaagtactgaaacatgaggtgggggtgcctcctacaattagagcaggactttttctcatcactgttcactgccactggaatgagtgtcactccatgacctcatcctgaaagcagataccagggctggcagtccctccccaactcccaccctaggccaacagggcactttcggacagccccgcctggctccctgattatcattgccacagtgcttgcttaatgagctgtggctccagggaagggcggacgctggagcaccaggagccatttccactgcctggtacctggtactgcactgtgacgtggtagctaaacacccgggagagtgggacccacctggccccgtaccatggaaatcttatcatgccaaatgcttcctgggagggagcagggtgggtgaggcaaaggcctagcccaagcccgtcagggttttgtttcctgattctttttttttttttgagacggagtctcactctcttgcccaggctggagtgcagtggtgtgatctcagctcactgcaacctccgtctcctgggttcaagcgattcttgtgccccagcctccccagcagctgggattacaggcatgcaccaccacgcccggctaatttctgtattttttagtagagatgtggtttcatcatgttggccaggctggtctcaaactcctgacctcaagcgacccacctgtgcttggcctcccaaagtgctgtgattacaggcatgagccatcacacctggcccatttcctgattcttgacgtcaacctaggttgtaatctcataagtatgggggccccctctttattttcctgaagctgaggagacccaaacactgagctagaagaagtgtaagagactactcaaagccaggacttcatctgactaagaggtgagggagtggggtcctggcttgacttcttggggatgggagtgagcctggtgggagcagggaactgaggcccaggtttagaggtagttaggacgggaagggtgctatgtgccctattgggtcagcatctcccgccccatccaaatggccactccactgccttcttagaccagaggatgttgggcatacttcactgcctggaagtccctcagctagggaaggggagagaagaactggagccctggtaatttttttttttttttttgggacagaatctcagtctgttgcctaggctggagtgcagtggcgcgatctcggctcactgcaacctctgctgccccagttcaagcaattctcctgccgcagcctcccgagtagctggaattacaggtgcctgccaccacaccctgctaatttttgtatttttagtagagacggagtttcaccatcttggccaggctggtcttgaactcctgacctcgtgacctacccacctcagcctcccaaagtgctaggattacaggcatgagctaccgcgcccggcctgagccctggacattttctaaagtgcctttccactgtagcaggaagccctacagttaagaagtgagtcggtcagagctgagctctggcccagagagagtgagaaccctccaggggagttcccactgcccaggaagaggaacagtgcagactcctggggttcagaaacccttggttcagttttggctctattacttgctggctctgtgaccttccctgggctacagtttcctcacagataagatgatggggctgggttaacttctccaagctttcctctagctctgacagcccacgattttacataataaccagcacacatcacttttcattttgctttgctctttcatgtacattatttcatttaaacctcatggtatctctccgagggtcctcctacattaaagatgagaaaaccaaagctcagggcatttaagcctgagaacatacccagacagggagcaacagagccaagatttacaccctgggttctggccagatcctgggttccacctagaaggaaatctgcccggccagggtgaacggccgcaagtgactggtttcagggtccatcccagactctcccctcttgaagctgttctcttgatgccgataaggaaactctttcaaaagatccgatttaatttaaaaagttaagctgcaaaagagtacagacagcacgattttgtttgtttcaagagcaaattgctctgtcacccaggctggagtgcagtggtacaatctcggctcactgcaacctctgcctcccgggttcaaatgattctcccaccttggcctcccaagtagctgggacttcaggcatgtgccaccatgcccagttaatttttgtatttttagtagagatggggtttcaccatgttggccaggctggtctccaactcctgacctcaggtgatctgcctgcctcggctcccaaagtgctgggattacaggcatgagccaccatgccagaccagcatggttgtttttatgccaaattttttttttttaaaggcagggtcttgctctgtcaggctggagtgcagtggcacaatcatggctcactgcagcctcgacctcttgagctcaagcaatcctcccacttcagcctcccaagtagctgggaccacaggcctgtgccaccatgccctactaattttttattttatttttgtagagacagggtctccctaggttgcccaggctggtctgaaactcccaggttcaaatgatgctcccaccttggtctcccaaagtgctgggattacaggggtgagccactgtgcacagattaacattttttatgaaaaagtggttcacaccactgtagagaaaagcccaggatgaactattcagagtgctcggcccgagaagcaagggagtaaaaggggtataacttgcatttttcttctttatatacttaagcagtgtttgatttttttttttatttcttccttttttctggaaaaaaaaaaaaaaaaaaaaatctggagggaaaatgttctgagcacctgctctctgagtcaaaattcagtactaaacactttactgtcacagattatttcatttaattctcacaaaaccctacggagtacaagaatgctcagagcagctttattcacaattgtcaaaaaaagggaaccaatccaaaagcccatcaacaggagagtgagccaactgtggtgtattcatacgaggcaacaccgaacagcaataaaatgaacaaacctctggtacatgtgacagtgaagaggaatctcacagataggctgagcaaaagcagccagacacacaagagtacctatgattccattcagatgaagttcaagaacaggtaagatcaactgatgatgatccaagtcagaactgtggttaccccagaattatctgcagaaaaatgacacaggtcagataatcagcctacaggcatatagcaggcaggtagtagagctgggattcagacaggtctgttggactctgcagtctctattggcccctgactgcccagaaggatgccttgaatctccacctgcagagccttctgggcccctctagaggcagtctcgctcctggcttcagatgtggggacccccttatcctcagcgctaagcacacatccctgtggttcagtcactaagggaagcctggctctccagaagcctcagctcatggagaactgctgcttaactagcaaggggacagcagccaggtccacgactcaagctctgggtctgctgggagcagggggcaggaggaggactgctctgtgccaagggaggatgcccagtgcacactcaccactcctaactagccctggcccacaataagggaatttccaagcagagctgggcctgggcttggccccgcccactgggccacactgcctcacactttccccagctcttgttgacccagaaaagtcagaccctgccagtcaccctaacccctctcctcaaccgaggataagaccaggagttttgagggactcagctcccccagaagcacctgcatcttcctgctctaaattcccagccctgcccaggcttccctccctcccctctgaagggagccaccacctgctgcttggcacggatacccctctccggctacatcctctccactctcccctcaactcctacacaatccccgtcccaaacaatttcctgcagtttcccatctgatcagtttcttaggaaggataattatccatggaaggaggaggcggaaaattcccagagccaagaacactgggggaaaagcttcatctagtcccttctccatcagccaggagagccctcatcctaaacacaggccagtcatggtcatggctcctccagaacctctgcagttcccccatcttcaggaaagagcccacacttctctgcattgaatccaaggccctcttgatctgttctaacttaggtttgggcctcgttgccattccattgtaagtggtagtgccagatggagccccatctgcccccagggcccacctgcaacgtgctgtgtccctgcggcacttcagcctgccttgtgttttagttgtttacatgtctgtctcccacacacaagtgtcagtgccagcgcttccagggtgggaaccaccaaccacgcaactgtgtctgctgcatggtaggtgctcagaggcaggctgaaaagaaagtgggacaggcaggaggccgcctcacctctgcggagggaacgatgtgggaagaaggaccacttatagcatcacaggagagcctggactagaggtcggggagctgagctcaatgcagctctgtggcccttaagcaagtcacttccgccctggcctctgcttcctctgtgagctgagggggatgggccgggctctgtcatcatgtcagacatttagaagcccttactgctaggtgctcgcctcagcattctcatttaacctccacacctttgcacatggggaccacaaagttgcaagtgggggaggggggtttcagtcctggtcttttgattccctaaccccttatcttctcctcctggacttctgcagtctctaggatccctcccagtgctaaagtctggttctgattctaggtctgccctttcctgacctgacaactccccaggccacgaccatagggttcagcagggaacacgcatgtccaaccctggtgttcagcaatgccacgcctcccacatgacaggtctggtgactgtttgcctgcaggcgctgaggctcagcaagggaggggtggccagcaggagtccagcagagcctggtgcccactcagcccctccctccccaatgtgcccctgactccacgcccactctgctccagcgtcctgctcgcccctccctgctagcagctctcctaggctggagcttccatcccactgctggcttggccagtggtgcctgtcgggaagctttactctgttgccctcatagacccagcttgagctgctggcaggcaggacactgagtggggccagcccagggcctgagccgactctatcgcactcccaggctgtccgcacatccctccccaggtcagaccatgtcatgctactcaagagcctttgatggtgccacacagcaccatgaatcctagccccaggcccacgggcctggcatgatctggcccctgccctcttctccattctcacaccatgcttcccctcttcccccgcacttcaggttcctcaagcacacccccctcaggggccctggtctttggaagatgagctcttcttgtcctttgggtctcagctcagacaccagctccttagagaacccttgctggccatccagcagccccacctctccctcatgtctgccttcttcaggacacttaccactacctgacactgctttgtccacatccaatgctccatgctggcatgggagccccctgacatcaggagcctcttctgtcttgttcctggctgtgtcctcagatccagaatagtgtctgacatgggggtagaggcagctggtggggcgtgtgctgcccgttagactggacagtcagggaggcctctctgaagagatgacgtttgatctagggcctgaaggagagcaccggcgcgaggcagtctatgggcagtgctccaggctggggatcgagcaaatgccacagctgtatggaggaacaggcctggcaaggcagatgtgcgttagggacacaggaaggccggtgcgactggaacagggaaagggtagtggggcatgaagtggagaaaggggtgggccacactttccttgcattttctcccaagttcatcaggaagcatttgaaaggttttcagcaggggaaacaccatgctctggtttacaggtctcaaagctccctgcggctgctctggggagagctgcctgcaggcagacagcagtggagccgcaagaccattcaggaggcccgggaatcacccgggttggagaagatggagtgaagaggcaagcctttgacaggtgtggttgtgtttgccaccagtctgaggagccctggccaagtctacacccctctggagttccagatgcttcatccagccccgcccacctactgtcttatttctcactgactcctcacccagacttttcctgcagctggctgggctccccaacaggtgcctgcccatacctagtactcagagcctgcaaagagccttaaccggtgtcacggccattgcctgattggtcaccttccctccctcttagaagggtctggtgaaggtgtctgcacaaagatctctgctccatgttcattccagccacatttctccccttcctaaaggtctcctgttctttgaggcaacagcacagcaatcctcgagcacttaattattccctgtttcactttcctaaagtagctgtaagctaaataaagctagataccatgactcgcacccttcggggccgtcacatagtgcagaaggcaatgatgcactatgcgaagccctgagcacaaagccaggcactggcagggtctcagtaagtggtaggtagctctgtcctcactgcctataccagggcgacagccatcacaggtgctcagtgccccacaggtgcagttagcttctctgcccagcaaaacaggtgagtgaggcgtgtttgggggtgaggtggaagggttggaaacatcccaatgagttttagaagcaaaggtcaatggttctgcatgatctgtggctctgtgtcattcacatctctgtgcccttctccagttctcccctctatgtgagctaagcacactcattgtttttttttttttttgaaacagagtttcgctgtcgcccaggctagagtgcagtgaggcgatctcggctcacagcaacctccacctcctgggttcaagccattctcctgtctcaacctcccaagtagctgggattagagacttgcaccatcacacctggctaatttttgtatttttagtagagatgagctttcaccatgttgaccaggctggtctggaactcctgacctcaagtgatccgcccatctcagcctcccaaagtgccgggattacaggtgtgagccaccgcacctggccaaaacactcattcttaaccttcaggacccagctcaaagctctgggaagcctttcctgacccacccacctccactcctccctcccgcacacccacagctctgcaggctcctgctgcagcacttcacagcacatcacaagtgcctgtttacatgccagcctctcccttgaggctgggattatatttatccatctttccatcttcagtacagtatttatcagcacgaatccatttgctgaacatgtgtctccccacctcccaactaaagaacgagctcagacaattcagctaatggtctcatttgcacccctaacctcagtactcagctcaccccaatgccctccagtccatatacctaaaaccatcctccagtgcttgaccccaccctcacctcttcctttaaggctccaggaatagtagcaactcccattagtgagcacttacaatgtgctcagggctttacagacatcacccccctttagactggggaaactgaggctcagacagggtgatgtagcttaaaaagggcacaccttttccccttaatactggcatcactcacctagcacttatcatagctgggactatttttaaaaccatcatctgttctgcaaaattgagtgcttttatagctacacatcaagttgtcatacaaaatcaccctttgctcattaaatgtttcagacgatcagtcttgctactccagctaggtggggtaacataacataaatgttatgtaggagaaatggcacaggacttggaaggggaagtcctggagtccagcttcagctctgccacagtcaggctatatgacaccaggcgggtcacctccacagcccaggcacggcagctcacgcctgtaatcccagcaatttgggaggacaagctggggggatcacttgaggtcaggggttcaaaaccagcctggccaacatgacaaaaccccatctctactaaaaatacaaaaattagccaggcgtggtggcacaagcctgtaatcccagctactcgggaggcaggagaatcgcttgaagcagggaggcagaggttgcagtgagccaagattgtgccactgtactccagtttgggtgacagagagaatctccatctcaaaataaaaaattaaaaaaaatttttttaaaacaggataagtgacttgcccaaggtcacggtgctacaaagtagtagagctgagatttgaacccaggtctgtcaagctgcaaagcttgtttttctaaccaccatgcctgtgggcatgtttccaaagggaactgctctgggacattcttctgcaatccagaggttctgccccaagtagaagcttctggctgtgcccagtgagatttcattcaagtatctcatctaaatcctacatatacttcaaggcctagctcagtggtcacttgcacagcctactgggatcttcccaggtacgaaattctctctcccacctctaaactcccgtagaattccatctgcacttcaaatcacaccccctttctactgtctgactgttttgcatctgtaccgcatttctcaaacaagtcgttgagcttggtaaaagaagcagttctcatgcatctctgcaccttccaccagccaggcaggcagtgctcagtcagggaagcgggtggggtagggtgcctgctcccctcccccatcttgctgtaacctgagtcttaggctttgcccagttaggtgagttggccccgcctcatgctggcataacgcctacctggtacagcatccagattcctgtgggtcctggccaccggggagataagatcttattccctggcttgatggcaaagatgctataaaaagcacagcacccaagttcaacattggcttgtgatggactacacgacctgagggattcaatgggtgaaggcagaagcctctgggctgtctcagaggtcccaagacctgtacttggctcccctgtaaggaccagtgtaaggaccaatggtttctctgccaaggacagctccctaatagataccccaggaggaagctgcccttctttaggcttaaagggcccactggaagaactgaggtttgccaatgctaccaatatccaagccaaaaaccacagcccctcctctcggtccactgtccaggtcttactgcctagggactcctgagttagttaacagagcagggaagaagactgactctgccattaattcacgagtggcctggggccaatcctctctgggcctcaactggaaaaacagagaacttgatcaaaacatctccatttccctttgggcctgggggttacaagctatgataaggatttttccatctctaacattctagaattagaatattctatactttcattcctagaagcagagtgagaacagagaacagggaccttcagtccaggaaacagcagaggccagtcagggcttcctagctgcatcctcaaagcctgtccaccttcagaggctttctcttgcgtctgctgcctcaaaggtggttgcttccccactagcagagcctcagaggtgtgcctgggccctagccgctttagggaaatgggcaggtggcctgagtcacctactgtgtgtgagctgggctcaccatggcaacccagcagacccagagggcataaagaagccagtaccttccctgctgcacagtgtaggcggagcatgttgcatctgctttgatttccaacttagaaaagtttttctctactttaaggactcatttccccttcccttctctcaggacacagcttactcactctggggtccttctccttgcctggaaggtattctgcagtcccacaggcaaaccccactcatcccagaattaagtaccacctcctccaaggattcatcccagaccagttagtcctctacccttcttcaagttcccaccacacaaaaggcagaagctcttaaccttcagaatctgtggcttacacactgacaatcaactgtgtaaaaaaaaaaaaaaaaaaaaaaaatctgagtctatcatgggccttctcccttgataaaatcacatatatacaactgtctgcagactattttgggagctccacaaactttatcatggactcagaaacaatcttagaaacctagatcctagaacaacagatcatccagtccatcctctcacctacaccagaatcccttagcaacccctcctgaatgatgttcctcttctacccctggcccacctctcaaggccgcctccttcaagaagcttccctcatctctcctctcctctgattcccccaagcatccagcctgaaccacacaatttcccacctgtgctttctcccttgtatgttgtctcacttccccagcaagaaagctgactccctgtgggctcatttcttcaaccttgtaaccctcagctggacttagagatgaccgtgatctgtacttgtacaaagccctgtgctttgaagccagggctcaatgacagcactggcccactcccaaaggatagagctgtggaattccccatctgagggcctcacagtctgcttaggcctcaacggaacagaggcttccctggaatgaccgcctttcccacaggacagccccagagagcccttcaagatgaaatcgacagatagggaaactaaggcccaggaaggcaaacatagcttagcaaaggtcaatatgcaggaaagaggcgagctaggactaagacccaggtccccagttaccagcctagagctcgtttcctttatgcaatggctttatgaaaactaaatttgccttgcatgcacacacactcacatactcaatatatacatggagaatttctaaaaaagatggacaagacagttaacagtggtaacctctggaatgtatgacagtgggggtggtcagagaagtaatgagggggacttttccctttcacctcaataccctctgtactgttgggttttatttttgttgttttgtttttaccattgacatgttttatttattcatattataaaaataaatctgccatagaaaggagattctggcccagcccacccattcccaacacacattaaagcaaagagaagccataagtaaatctgtccaggtacaactataaattaacaagattgccttcttgtatggtttaaagccactggtctcattaattcacagtcacagtgcagtttacggcttgaggaatcttcccaggaaaagcttaattcaattagggctctcggcagctccccaaggaagctctggtatcttacttttacttacacaaattgagggcagaccaaacagatccagatcttcccagagagaccccacccggcccagagaagatgcccttgcagaccctccattagagccaagccgagggaggtggccaaggcagcaccacttaaacactggctggcgcctaaggcatcattctgtgagtgtcgctcccagcgagctcagttaaactccttggcttggcagtctggtgccaaggagcctctgcaacctttgctctccctcctctctgagcagtcaaactggtttcttgtctgccccagggctttgcagggatcctatctttacactgaagtcaatcacatattcattcatgtattccttccccaaatatttatggagcctttactctgtgccaggcacagataagaaagtgaacaggccaggcgtggtggctcacgcctttaatctccgcactttgggaggccaaggtgggtggatcacctgaggtcaggagttctagaccagactggccagcatagcaaaaccccgtctctactaaaaacacaaaaaattagctgggcgtggtgatgtaagcctgtaatcccagctactctggaggctgaggcaggagaattgcttgaacctgcagctactctggaggctgaggcagaattgcttgaacctgggaggcagaagttgcagtgagctgagatctcgccactgcactctggcactccaacccaggcgaagagcaagactccatctcaaaaaaaaaggaaaaaggaaaaaaaaaaaaaaaaagaaagtgaacaaacaaagtccctgtcctcaagaggcttacattcttatggaaattggtactaagtatagcctgcttatctaattcctttccatccttcaagactcagactaatgttccacctcctttgagaggctttctctaaacaccccagtcctcagggactgcttgctccctctgtactttgcctctgccaggagtccgcccagccctggcaggctggaagctcctaaagagcagggcctgggtttactcttcttttgttccttgatggccatatgctaaatgcctgctagctgatttcagctgacctgcctcttccacccaggatcttagcgagctgctcttggtcctggctggctgatgcaaagacacagcctcttccagcttcacttggcatacagcaaatgctatgcaagtgttagctatttattggtttagtgaacttgtgggctctaacacacagctgtgatatcactcctccgccttctgtggcctggtctcaaacaggctcagcactgtggcaaggccagtctgggcttaggggtaagtgcttcccaagggacagggaagggggcctgggaaggaacagagcttttcatcctgaatctcagttagaactgcttaaggacatatcttttcaggaaagaatttgctggggtaatttggggggaactctggattcttggcaagtagtataaaaactcagggctcaggtctggcctaatagaccccaaaatcggctctgtatattagatgagctttagggggaagaaaatgaagtcagcatgatcccagggaaggcgggcagcccactgatccaggcccaacccaaaacttagttcagttaaaattagattagcccataagattaaaataccaacatataatcacgggctgctttaaagtatcagttgatgtttatcggcatctaaagagacagtttggcccagtgcagtgtgtgcagacaaccttggggagacatgcctgactcagacatttgcagggggagcgagtgctgcaaaatgaggcccacacaggcgatggatgactcaggaataacccaggtcctgggtgtgctgagcgagccttctctccctgcctcaggaggaaagggggcaggtgggagaggcggtgaggaggaaaggaggctgtgtatgggctggcattcccagagacagcctcaggcccccagctctagttccccgtcactcctgtatttttctgcatgctgccacctctgagaaaggttatttgcttcacagtgggacttggagtgggtcagctttttccccaaacccaagaagtgatccacagaaagcagccaaggctcaaaatactaaagtctttaaatctcccccaattcaaaatgattatgggaaaaattgaatttctaaactgaaaaggcccttggaatcagggcatgaggatgaaaagaacacaggctctgaagtcagacaaatctgggcttaaaccccaatgttttctagctgtgcaagtacctttcacaacctctaaactagatatgaataagtggcagcttagctggatgtggtgacctgtacctgtggtcccagctactcaggaggctgaggtggggggattgcctggagccagggaggttgaagctgcagtgagccgtctttgcgccactgcactccagcctgggagacagagcgaaatcctgtctcaaaaataaacaaaataaaaaattaataagtggcagctaattaacaagtatttaacaaatatatcaccaattaccggacgggtgcagtggctcatgtctgtaatcccagcactttggggggccgggacgggcagatcgcctgaggtcaggagttcaagaccagcctggccaacatggcgaaaacccatctctactaaaaatacaaaaattaggccgggcgcggtggctcatgcctgtaatatcaggactttgggaggctgaggcgggcagatcacctgaggtcaggagttcgagaccagcctggccaatatggtgaaaccctgtctctactaaaaacaaacaaacaaacaaacaaacaaaaaaaccaaaaaattagccaggcatgatggttggtgcctgtaatcccagctactcaggaggctgaggcagaagaatcacttgaacccgggaggcggaggttgcagtgagctgagatcatgcctctgcactccagcctgtgcaaaagagcgagactctgtctcaaaaaaaaaaaaaaaaaaaaaagaaaagaaaaaaatacaaaaattagctgggggtggtggcgcatgcctgtagtcccagctacttgggaggttgaagtaggagaatcacttgaacctggaggcggaggttgctgtgagccgagatcgcctcactgcactccagcctgggcgacagagtgagactccatctcaaaaaaataaataaaaataaaataatagggagtcaggtgtgatggctcatccctataatcccagctactcaggagactgaggcgggaggatcatttgaggccagggattcaaaaccagcctggacaacaaaattggaagatccccatcccccatctctaaaaaaacaaaacaaaacaaaatgaaaaattaagtatctatattatcaattagaaaacgggctcaggccaggagcagtggcttacgcctgtaatccagcactttgggaggccaaggtgggaggatcagctaaggtcaggagttcaagacaagcctgaccaacacggcaaaaccccatccctactaaaaatacaaaattagccaggtgtggtggcacatgcctgtaatccccactactcaggaggctgaggcaggagaattgcttgaacccaagaggcagaggttgcagtgagctgagattgcactattgcactccagcctgggcaaaaagagcgaaactcttgtatcaaaaaaaaaaagaaaaaagaaaacaggggctcagagaggttatgccttgcctaaagtcacacagctgggcaacagagagctgagactagatctcaggtatcttaacctttcaccccatcctacatgttttccattgtaatcatttctctgcctctccttttctctcccagagggcatgcaacattctgggggaaaggacaagtcctccatttcaaagatttgctgctccacagataagggctatgagaatgtcagtccccagtgcaactctggccctcatcctccttcatgcaaatacaggtatgttcaagttgtagaaaagaacttggagctgagccaaagctgtcaaggctccagaccacccagaccctttagcccttcctgcctacaggaggaacaggtgtccctcctgacaacaatccaggttaccaatgtggatgtgtctggtcattgactctcctcaaagcccctttaaatctctcatcccccttgatccaacaagaacccagcatgttggcctggcaggagagagtttggccttgagtgattagtcccaggcatgctaagtgacctcaggcaggtcacaaccgaaggctcaatttccttagatgtaaaatgatgaacacatcaataccacatgctattctaacccacaggaccactgagaagatctaaattaaatattgtacacacaagtgctttggaaacaaatttcagtgctaatgagaagtactattaaactcctcctgccttgtagagctaaacaaagttgtgccacctgctcccaacagaggctgcctctcaggggactctgctgggccctgagggtaaccaaaagcagcctgtcacctttctgctcagaggcgggaggtcataaggtcagccaccccttgtggctaaaggagaccaccctttacctggcacttccctgcccaagcagggaagaagcaagctctggtctgatggctgagagggcaccggaagagagatagcaggcagggttgctagcagagaacaagggataggcctcctgaatgcaggattcaggtgcatccaagaagactcacaaaaacaaaggacaggtgcacagctggacacagaacacctacagctttctcaaggcagggacagggctcccaccaacgacatgtgcccaactcctagagggagtcctacaattcctgagtgcaggtgcagtgagctgggcgcttctcagtgcagggccatgtgcatctgctgcgggaatgccagaggcaggagatgcagctgcacccctctagcaggctatgccaagactcgaacagacaataaatagcaatttgacatcactgaagataacctctctgagccatttcctcatctgcaaaacagagacagcttttatctcatgtgatttgagtagggattaaataagattgcttttataaagtgcctgacactactctgtagatactaagtggcaactattattaaaacacacacacccgttcaacacaggagatgtcacagggcaggcaaggcctaatgccactgttatggataaacaataagggaaaagggtttgggagagaaagagaaagtgactgctgtgggctgggaagacctcccaaaaggggaagaatctgcacggccctgaaagttactacagtgagctgggcactctaccaggcattcccacgttcagcctctacgttggtcttaaggatgaggcaagtcaggttcagagaatgaggtgcatgaacctcaaggttcatggtcacacaggtactgagaggcagcatcaggagcagaacccagggcttctgactacgtctttcctttgtaccagggctggacgccatggggctggcttggaaggagaggaaaggcaaacttcgagggtgctcagctgaatgaagtctgggcaatctgaccaactaagccctctaagtgccttggcactcctagagacacatgtcctacctgaagccttcctcccagtccccagctgacctccctcccactgttctgcagtcagtctgctattttcccaaagagaaaaaggtcatcgcttcctttttagagtcctatctgggcttcttgagacagtttcaaggtgacctttaggctatttgttcttctcttcttttgagaagtgagagaggcaccttctagtgtcatttttataggaaaccagttgctgggtctgatatccatgcatgtgaagtgggcagtgaccccatctcccctattcacagacttaatctacagaggagatggcaggattcgccttgcaaagaccaaaaccaaaaaaagctataagatataaagggacaaaagaagccttttgtgtccctggtcaggagacaagatgaatacctgctttatgggctcccgggcctctgccaggcattctgggtcaggaacatgggtaaacaattgcaggagatgccagtggtgagctgagttacagtgaggctctcctctggaataagtactagcctgggagtcaggtgaacatggaacaaagcagagttcatgcggggtccacagcacaatgtggggtggggaatgcacctaactcctaaggcttggagtcattcccacagttttcccaatagcctaaatcctcttcacaccactggcccctccccaccaaggacaagcaagaattcctgactgctggggagagaaaaaaggtccagagagggaaggtgacttacctaatgtcacccactgagtcagaggtagactagaacccagaagcaactattctagaacttcagctcccaccctgctcctcccaccccagtctctgcaagagtctacccgaggctctgctccatggttagggtaggaaggagaactgcaaagcactttctattcttataggaggggtaacctgcaagggaagcagctgccatagatgacagaatgagggctccaacggaactcctacccacgcaggggtgttgagagaataggcaagaccccaaaatcagctcccaggctcttgggtatctgagagtgcagagggagcatggcctcagccccccacccttatccctacaaggcagctggtgtcatcttccctcccgccatgaccagctcaagtgaacagtataggacacatggaaaccctgataccctaaggaaggacattggtggcagcctaggtttgagagatttgtaatccttcagctcagaggaaggttgtaggaggctgaggtagggatgcatttgctgtaggtggttaaaatattaacaggggcagctgtcactcattgaacacttcctgtgtatacaaacttttatgtgcatttatttatgtaataatcacattaatagcactataactggatactattagttcccattttatttttttttatttatttatttagagacggaatttcactcttgttgcccaggctggagtgcaatggcgcaatcttggctcactgcaacctccgcctcctgggttcaagcgatcctcctgccttggcctccagagtagctgggattacaggcagccgccaccatgcccagctaattttttgtatttttagtagagacggggtttcaccatgttggccaggctggtatcaaaactcctgacttcaggcgatccaccctgcctcagcctcccaaagtgctgggattacaggcgtgagccactgcgcccagcttagttccccttttatacatgaggaaactgaggctcagagatgctgctaagtggcagagtggtggctgaattccacactgcaaaggtgaagctgggaaaaatgggctttcatttttgaggcctgaacagggactcttcagatctttagaccacctttctctccactcatggccagatgctagaactcctgttttcagaggcagaaaaatgcctttccaaggcagaaacagacttttggaaaggagaccacatccagcctcatcattttacaatgggaaaactgaggtccaaggctgagtgacttgccagagtttccagagtcagtggaatgacagaaatatcacacctggaagggaccacaaagatcaactgatgggtagggaggcgtgactggtccaaggacagagggaggtaggaagagaagccaggttttcctgacttctagactgatattgttgccatgacaccatctctgctctccagctgcccagggtcccgggcacagcacttgggtggtgacaaagcaggccaggccaagctgacctcattagcactagagataccaggcctgcagggacaaacttctgactgcctagagtggggtctctgcagtcatgctgtcatcccaccagcagccactgacactcaaagtgtgtctgccagccctgaatgccctaatgtaatgccaggtgtggtgggcaggtgaggggatcggggacaggaggcaatttatagattgcacttgtgaggtctcctcctggtctcacacagtcaaatgacatcactgtcacttcagcttcttacagcaaatcagacgacatttcatgactcaattggtgtggtcaaattgagagtcttaaccatttcacaggtgagggagacctgcagaaaaaggcctcagctattcaaggtcatgcatttatgtcagaatcagtacacatggttccccttgtccagtccttgatttctctccaggaagctaactgccatcaaggtataggtgctgatggcttagttccatgtaaggctctgctactgtgaccagcttggcacaagagccctgcaccaggaacccagctcctggatctgtcaaattagaggcaccacttccctcccgctgcatgtcccagagcctgcctcacaccagcccggcagcaccgctcagctcctgcatgtccttgggagagctggaaggtttcctgccaaattcccaaacccaaatctcaggcagaggggacagcagagtcccaggacctcatgccttccacagccagctgggggcaagctgaaaatgcaaaggcagttgtcaaagtccccctgaacaccactttcagggacttctgggcaatgtaggctccagtaagctcccccaatcactcagcagaacagagtgctcaggcctagcagggagaccaatactctgagagcaaataagttgtctgtttccttctccccaaaagaaggtttcaaagtctcttcaggcctgaacatccctaggctcccccatctacctcatctacttgattgagcagcaggccagacagcaccctgagacacagccaggcagcgacctgggggtgagctggggtcagaccaagcctcaacctcctctactctccctccacttccaaaacagacttcagaaatttccagggccccttgtcccacagattctataaagtatggcattcctgggccggaaattgactcaggggctcctaactagcctggacaagcaaagctgacagataacattctggagatgaaggaaaggtgggaatatggggatcccctgtgttccaccacacttgtaagtttcctgtgcccaggtctccactatgcttaaactcctcaagcaggccaagtagaaatatactccatcctggaacacgctccagtgaagcctgtcataaattgcactggttgctgttgacagagcagaatgtgccactcgccagaagacactcctttctgtctcacacacagcggggtgcctggctcccctgggggtctggcccagccagaggagacttgccagtcgtggaagccttactgaagggacctaggatcagaggcatcccattctctaatcctgctctcttctgtgcacagtgctggctccaatcttgggaagcctcagatcacagatcagaagccacagaactggagcctgagaaggaccaaggtggcaggatggagactgcctactttatgggggtagttcagatccttactcctggacagcctcaaatggtgcgagatgaggcaagaagctcaccagtctggtggcggccgcagcatcggagcaaacgggacttacctatcttcatgaggcaggccagaaggatccagagggagatctcgaagggggtgcgcacgtgtgtgtagtcgatgcccaggactggaaaggccttgcgcggcttcatgccatgatcagtgacggaatgattaacagggcggctctctggggtgacctccggtggagcggtggtgacatccccaatcgagcgttctcgtggtggctctgagcttcgaatggtgctggcagttgggctgagctggaggccatggctcctgagaacaggcagcagccccaccaaagcaaccaccacgagtaaggaagggaagatccgatgtggagagaggccacagatgccagaccgcagaaccatggtgctgcttccagagccagcctcgaccttacccaaatgagagtaaaaccgggcacataggtagcaaagggtcagcaagtgggaagagagactggcgtagtctctaggaaaagttcatgttttagagaggcatttccatggaagcaattttctgggggtggagggaggctgggtttgcaatctggaactccaaagtggggaaagggggcaaggacccaggaacgaccacgaaaggagaccaaaaggtctggaactccgggcctgggaagggggaggacggatgtgggaaactgagccctagggatagaggaaggggcaggatagggatagtgcaaaggaaaggaagaaggaaggctgggacctttggctgaggaaagtgactgaggagctgggactctgggctgtgggctaaaggaaggggtagggagcctgagctaaaggaaggggaccgaagggggtgagagccagtccaggaaaaggagagagggggctgggagcccaggctgagaaggagtgaaaccgggaagcggccgggagcttctccacccagagaggggcaggggtccaggcgcgccgggctgagattccggggaaatggaaagaggcggaaggcaggcggcctggcgggaaggcgcctcggcgcgggctgggggcggctcgcggtgggccagcagcaacacgcccctcctcgcggccctggcgcgacgcggcgctccgccccggcccagctgcagctcctcctggtccagctccagaactaaccctagccccggccccggcggcagcagactgaagc

SEQ ID NO: 2768 - DNA, 56322 bp, Homo sapiens; identical to SEQ ID NO: 2767
  source 1..56322: mol_type = genomic DNA

SEQ ID NO: 2769 - DNA, 70302 bp, Homo sapiens
  source 1..70302: mol_type = genomic DNA
gatcgtaggggtgggagtggggcgtggcgcccgcttaccttgaggctgggtgaggctcgccccgaaatgcggggcgtggggggcggggggcagaggtccctgcctagaggggaagaggggcgtccatgtggcggaatggatttatggtttggggctgatcagtgggtcttatggccgagtctctctggttagtggagacagcttaccaggcctgggatctggggagtttggaggtgcaggagatccctggttggaaacttaggcaggagtgtgttacccagagagactgagggcttctgctgtgcacctccaaaaccttttcctaacctcttcaccccttcctaactgctaatggttggagaaggtggaagttctctggggatagatacttcgtggtgggggaggggggaggggggttgggttctggccaaagggagccccagcagggaaggaaggctttgaaccctatagctgcccagaggcctaagcaatgctactggagtacccctacatcatcattgtaaccgttacacagcattacattagatgcagcctatttagtctgaaccaagccagacaaattggtgtgtcctgcccgctgcttctaaaatattgtaaacatgtctcagctcataggaaaataaatgttccgggtaaattcatggaaaaaaataatcagggtgcaatatggaatgtttacaatgatcctactttataataaattcttatatctcctaaatatgtgccattttgttatggatgaaaaaaaatccgaactatatactctaaattattaatttcaactgtggttattgatggctggtaagattacagagtaattttattcttttttgtttacatctttatgtagcatcttaatttgcacagtgaacacataatttttttttttctgctccttattttcccaggagagtcagtcagttgctccgtgtgttgtgttggaagtcaggtcctaaggccagctgctctggcttgcactgagccacaggcagactgatttgccaggaatgataaaaaggggtgaatgtgaggggagaattcagtgtgcaggctatgggaggctaatgcttttttccttcttctaggttggaaaaagactatgttagcaagtgtcacgccatggtatgtggttggttggtctatttcagtctaatctattatgctttctggttaaaaatgtcacctttctcattatctgatggatttacgttgcaatgcataactttcttaggttctgataactcaccttggctgggccatgtgagttatcagaagagttactcaccattttggcagtgcttcgaaccattgagttaccatgtgagttaccatgtgagaaggagagaaatattgcctctgaaatgcctttttagctttggatttgctttttgcttttttttttttctttgagagttttgttcttgttgcccaggctggagtgcggtggcacgatcttggcttactgcaacctctgcctcccaggttcaagcaattctcctgcctcagcctcccaagtagctgggattacaggcgtgcaccaccacgcctggctaattttgtatttttagtagagatggggtttcaccatgttggccaggctggtctcaaactcctgacctcaagtgatccacctgcctcagcttcccaaagtgctgggattacacccgacctgctttttgctttttgatcagggtctttatttcagcatatgctgcctactatttcagtgtgtgtgcaattataaaagaaactttaatacatcctttagttgtgctcattatgcattttctgggacaaaagcttgttaaaatcatggttggagtatgacaattaatacatgtaatgttcatttcattcttcttactttcttccacagcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatggtaatgtcttcatttttcagctgtttttttttttttttcttatttttggagtctcttttaatctaacagtttctcataaatattaagagagtgcattggcacatgctgtccatccagttgttaaaaatttttcaattttagcttgtttcccttcataatagtcattcccttaaacagctgccaaacttgatggttgtcacgtggccatctggagaacagttgaatgttactgagaagacgcttcctctgccaggtgctttatatgcattgtagcacttaagctgaacagcagtttttttgaaataagtagatgttattttagtttttaaggtgatggaactggcccagcaagattaagtgacaggcccagtttcattggtctggaaaggcagcgtcaggatgtgactagctcaattacaggccagagccattactcctcatactgctttgcctgaccacactacgacctggagaacttggattctagtcctaactctgccctcagtcctcttaggtgaagttcataacttcccagggcctgagttggattccactacatggaataaaagaattatctatatttactatttgtcctctacagagatttttatagatcagtgggggcttgctggtcagctgttttgaacttggcgtccttcattcattcatttagaagacaagcttgtgttgagtgcctaagtacaaattgtcaacagtcatcagtcctctgttttgtttcagatcctgacaccaagacgtggaacttcagcatgaatgactatagtgccctgagtaagtagacacatggttgtctcatggagggtggcactggtgctgaaaatctttagagtatcacatgtagtccagcttatggagtgcatggctttacaggtggtgaaagctttcagggcaccccccccaacactccttcccactctgtctagcctaatgaggcagctctgtgggtgaaggccgttagtagtattaacaaaagctagcattaaatgatgcttgctttgcattaggctattctaagccccttatgctaacttttattccttataatgacttttttacagatggggaaactgaggcccagggacgatgagtcagtaacacagggtcacatagccaataagttgtacaactgggattcaaaccctgacagtctgacttcagactacacgttcccaccagactatgctggccccagcagtgacaggcagctcaggcagcctgccagcccctgctcccaggaaggtaacagttcagcaaacagcacagatcctcagagtactctctgtgcagctaactactcaaaaatgcaaggagggggcattggccaggcaagttccagctaatgcagtgtctggtcatagtcagcacctggttacgtccctctgtcttctgagaaaactgtcatacactaaagtttttgtcacttgatcctggtacatggagcttgcacacctgtgtcaaagcgtcagccctgtgtgttttcatcttccatttattttactcttctcccccagctgccatttctacaccgtctcttcctccccctagcttaagaaaggaaaagataaggatgtatgcttaggtcactttgcagatttggggtatgaggtaggattatctggaggcaccagtacagtttctgggaaaggtggtttgggccagtgatgggacagctccctgcagaatttcctggttttctccttggcctccaattcttgaaatgtgtacattaggcgatatctttctttggtagctgctagtgttgttagtttgcgagggctgccgtgacaaagtaccactgactgggtggcttaaacaatacaaatttattttttacagtcctggaggctggaagcctgagattggtagggttggtttcttcagaggcctctctccatgccctgcaggtggctgtcttctctctgtgtccttgtttggattttcctttgtgtgtgcaaatccctagggtctctcccttttcttagaagaacaccagtcattggattatcgcccaccttggtgacctcatttaacttattaacctctttaaaggccctatctccatatacaatcacattctgaggtcctgggctgtgtgtttaacatgaattttggagggacacaattcaacccataacgctgctgctgctagctccgtctagtgagggctcattttttaatcgatttatttggtgttggaacggggagacccaaggctctggataaagattgcagattttgacacctggtattctcattgctggtgatcttaaaccagtggtttcccctgttgcggttgttttgtctttttactcttgttctgaccacggtgcatggtgacttagatgacttctgcttttgcagattcatttaggttttttgtgtgatatcgttactttttttttgagacagagtctcactctgtcgcccaggctggagtgcagtggtgcgatcttggctccctgcaacctctggcttccgggttcaagtgattctcctgcctcagcctcctgagtagctgggatttcaggcgtgtaccatgcctggctaatttttatatttttagtagagatggggcttcctccatgttggccaggctggtcttgaacccctgacctcaggtgatctacctgcctcagcctctaaaactgttgggattatagatgtgagacactgtgcccgactatcattgctttgtgtaatgctccacatgttttgaaaaccatgtttattggatacaaaattctccatatatacttctcaatgaagctcatagaagagaaaaaaaattctccatatagctttcagatgaatttttctaattgtttggctcctctgcatctttaccaatgtgttacacacttgagcttttgcctgctgagataaaccttgaaattccttgccataattatggatttgtgaatttctccttgtatttctaagtttcagataggttcatgattgtgtctcatgattggctttttattggtataacatataaaattgtctctgtgtcagtctttctgtcattttgctttaggtatatctctggatttggcttcattaaccctaccacatactcactgtagaacatattttgacgtgtgaagaagaaaaaccatcccccgtaatctccccactcaactaaccattattaacattttggtttcattccctccagccttttttctatgcgttaaaatataaagttttatatatgcatataatttgtattttgcccttttaatttaatactccagcataaagcatatttactttactgaatgttaacagttaattctaagtgatgaaaatgtgtccattatcataatgggccattttgaccttcaagaaatggtttcgtgttgttgaactacttttgtcttttccagaatttttaatacaaaataaattttgatagctgtataacattctgtcttatgaatgtgtcatacattgcttaaattgttgttgtttattttttcctgcttgattttaattggctgccagtttttccagttttaaagctgtagaggaacaccttcgtacctaagtttttgtctgtattttcaactggtagttgggatagattcccagaagttgaatcattattcttagagctcttgctataattgccaaattgttttccagcaggttttattcccaactagcaatatggatatctaattgtttctcatcctgcaagtttgagaagtaaaaaagtatcttatttttctgattatttgtgaaggtgaacatttcttcaaatgtttcttagtctttttcctcctgttttgaattggctacactaccctcttcttttgtggtcttagtacttttttaaagcatgggttctttttatatttctttactcagggtttttttcctttcactccagtgtgtgtctgttgacagcttagtgttacacagctgaatttgttcattataaaatgcatctgtagtagatgaaataatgttcagaactgtgtgtttgtgacctggtgatcctggtcctcactcctttgttctctgagcagtagacagagtagcgacctaggagtgggcttaactgggtgatttgtggtgtgctgacttcagtggcttctccgacaccgtgccagaaattatctaataagtttattcatcctggcgagcttcctcttccccttgttaatttctgaattttaaatgttttgatgtgaaaaatgtagggaggccaggtatggtgcctgatgcctgtaataccagcacttcgggaggctaaggtgcgtagatggtttgagcttagggatttgataccagcctgggcaacatagcgaaaccctgactctacaaaaaatacgaaaactaaccgcatgtggtggtgcacgcctgtagtcccagctactggggagtctgaggtggaggataacttgagccagggaggttgaggctgcagtgagccatgatcacggcactgcactccagcctaggtgacagagcaagaccccgtctcaaaaaaaaaaaaaaaaaaagaaaaaaaaaaaagaaaaacttacggagatggaaagttacattcagcaaatattgaaattcccaaagccccaactaaaaaacactttcaagtcttcctaatctaacagtgccttttcttgccttcctgccaaacctagtgcctcttgaccatgtcccttccccactttctccctcttcccttgcctgtatttcaaagccacatcatagtcccctgctttatcacttctgttcgattcttcttctttggcagtgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatggcaagtaattggtctttgtctgattcccagaatgtgtagtggtctgtgatctcaacatagggtgtttttctctacctcgaatattcaaaaattactttcttgggaaagacttcctgttctgctcctcttcctatagaaagatgacacgttaattgttccagatagtaaacatacagtggtggctgttttgtcataaggcctcccaaagagaagacctcataatatccccctggtcaatatcttcttggtagaagcaggtaaattcctgcttcagccatttaaaacccatctgtttttattttggcctttgcagagcagaaaaacaggtggttgccataaaaataaatgcttttccatatgcaaacttagtagttttcaaacttgagcctgcagggaactgcctgcaggggttgttaaaacgcagctagctgggccccactactggagtttctgattctggaacttgagcatggagccaaacttttgcgtttctcacaagttccctgagctggtgctgctgctggtgatggtgccacagtttgaaaatgctggtggttctgctctcggcctgcccatcagcatcacagggccacttcaaaagcaccgatgcctggttcttacccagagatgtttattttgtcggaggtggggcttggacattgtcggggtgttttttgtttgttttggtttttttaatcttccgataagcctaattataagccagtcttgaaatctactggccacaacagaatagttttgctgtattttattttatttatttttgagatgaagtttcactctgttgcccaggctggagtgcagtggcgcaatcttggctcaccgcaacctctgcctcccgggttcaagtgattttcctgcctcagcctcccgagtagcagggactacaggcacctgccaccacactgggctaatttttgtatttttagtagaagtaaggtttcatcatgttggccaggcttgtctcgaacttcttcgcccaccttggcctcccaaaatgctgggattaattacaggcatgagccaccgtgcctggccgttttgctttagtttttcatgaggttcttcataagctcccccttcagaataggggagaagcagctatagattctggactcctgggtgtcattctcagcttgggccacattgttttttaaaaacgatgtagtttttatggatcagtgtttccccattcttgaattggtttaatcttgttcttaatcaagtagaactcaaatacttaaaacctcatgcctttgagacctcacattcaagcattgtcctggaagaagcctctagaattgcttgcttaacaagagctttcatcagggtttgggttccggaggaggctgatgctggttgctacgtcatcatccttagatggatgcagtttggactgatgagggcagacgggtgagcagggcacaggggagttgtgcgaggcccaggcaggtcgtgagatgagctgctccacgacagtctagatcctttgcctttcctgccccctcaggtgtttggcttcagcttggggtggcccttaaaaggcaactacgggccgggtgttgtggcctgtaatcccagcagtttgggaggccaaggtgggtggatcacctgaggtcacaggagttcgagaccagcctggccaacatggtgaaaccctgtctactaaaaatacaaaaactagccaggcgtggtggtgccatcctgtaatcccaactactcaggaggctgaggcaggagaatcccttgagcctgggatgcagaggttgcagtgagcctagatcgcaccactgcactccagcctgggtgacaatctcaaaaataaaaaaggcaaatacagtgatatgtgtctatcaccagcctgtgagatcacactcctgacatggtctgcattctgggagtgggtaccatgaaggtatggatactgatcctgctcacacccaggtgtccaaaaaccgtgattggttcctttgccttagctgttgttcacatcttttcctgtttgctgctgtgccactgtgagaatcaagttgtcagaaagggccttccccttctagttctgcatttacgattagtctgtctgctttgttccttccatcaggttgtacctggacgacctcgctttttcctgaaactgactctgtgtccatgatgcctttttctgaccaccttgcttttgaaggaatcatacagtgaagaatgaacttttgctgcccagatagcatttactgagaccaagctttcttgatttttcaaaagatagattagtagagaaattcctctatttaaagaatcagccaccattgggtagaaagatgctcacctttcttagttgatattgtgtgtaatttatactacacgatgctgattagcagatgatgtaataatcccactaacaataattcataataactggctttggggtgctcattgttttccagtcatacttttataagcattttcctttaatttcatgtaaacagtaacctgtgaggtaggggttgtaatatctttatttttcagatgtggaaactgagggagaggtgttacagtgacttgcccaaggtgacatagctagcaagaggcagagccaaaattgaaactttggcagtttgaccactgaccacatgcaacttgtttcccatgtgtaaaatggagttaacaacagcccaccttacagacttgggaggggcagatgagagggtgccactgagtgttggcacagtgccgggctgaatgcgaatgctgcataggtgtgagctacagttaccatccctgtcactcagggcatttctgacctgctagaccctccccagccatgtatcctgtggcaccttttatcacaacccttacaacccagtgttgtcagcatctctgcctctttttcctcccagtatactggggaagcctccagggaaagtactctcctaatttctgtatccgcagtgctaggtacaggaccagctgccacattgtctaagctgaatggaagtttatgaaaccaaggaataaatgagtaagtgtgatcacgtagcagaagggcagggtgtcctatttgcttatttatttcttgtcattgcagatgtcaagaccaggaagtggagctttctcttggaagagcacagtaaactaagtgagaagccttccttacttgttttatatcatgctattgttaagctttaataattcaccttaaatttgatgtatttttgaagaatcttctcctccctttgctgtggtgggatgcttgagtacagggtaagtaaaggtgaggatgcagccttgtccacatccactgagatggtggctttatgacagcccagacaaatgccgggcctcttctatcataagggtgaggtggcagtagtgaaatttcccaggcctgtgaaatcttcctgctgtcatagaagtgctagaagcatgggtacatagactttaggaatcagaagtgagctaggattgcttagcttaggtggaagtgaccatagattacttctaagaataggctctcagtgtacttctagaactggatgggatgatcaagaaagataggagagtatcactgggaatggacttcataatagagttctgtttggggcagaagtcaaggccagggacttaggcattttaacaagcactttacagactgaccaaggaaaagggatatgtgtacagatagcataagtgcaagaagaggaagccattttgggtttatcatttttcttctctgtgttttgcttagatggggcaataaattctaatatgcctggaaaaaggaaatatggtcatatctcagactgtaccagaataccagtcccttatctatctggctgtaacaattctgcattgggtttgcagctagcatggcttatgttcctctgcttttctcctaatcctgatggcctgttgggcctcccaaaccaaggaaggagtcatttgtgggtaccaatcaggccaggacagacacgagccaaccctgggagctctgagtcattggccatcttccctggcaggctagggcttcaatgtgagggaaaaactgggttccttccttttgtctccttcttatgtgacttactatgtgacattgggtaaataattaaacattctgggtcccattgtccctttagtaaaaaaagcggtggtctttaatctctatctgctctcctgacataggaattaaatataaaggaagagcctttggttccttgagcaaaacttgctgtgaactacatgattacgtttgaatatgagatggtaacttaataaatgctggctgaagcagaaagaatggctcacggtgatcttgagactctctggctgctactatttggaacttgtgatttagagggaattatttggcaaaatctgaatttttttttctttttgaggcagggtctcgctgtcacccaggctggagtgcagtggcatgatctcagctcactgcaacctctgcctcccaggctcaagcgattgtcctgtttcagcctcccaagtagctgtacacagaatccttttggtgccactttgccagctgggcttgccactgggcttgctttgcccactcgacctggcaggctgcgctcggctcacgctaccagtccagattccacacccactgagggcgagctaggcatggagcagcagagggtttgtgagcaagtgagtgtagagtctggccacagcacatagccaggtgcgccagctgctgcagcagagcgggcagctccagactgtggcacaggcaccagctctgtatgaggctgcagctggactaggcataccacaagcagcttctgccttgggcaccagcggctggatgatgggaatgtgctggtgcctgaaaacttgaagacaccagcaaccatggagccctaagggggtgttacagcatgttacagctctggccgagggagtcccaaggtctgggctcccagaaaggttgccactcttcactcctgtggttcggcagacaggagcatgtcactgcctgcagcttggcgagcagaccaagaatgtgttatagcccttttctcacctgccattcagcgggtcccagattcttgtcctgcgtccaagaagaatgaggttacatgaacaactggagagtgagcaaggcagagaagggttttattgagcaacagaacagctcttagtggagaggggacccaaagtgggtagtcccaacatgtggctgagtccagggtttttatgggctcagaatgggggtgtgtgtgctgattggtccataggcaggcctggaaaaagcaccattcgattggctaaaaggcattgaggaagttcttattctgggttgtggactccacctggaactgacagcctggttttcaggtttcagtctgtctttggcttaaaggttgggtttcactgtggacccacccctgtctgcctaggaagttgtctgcctcctgctgttatcagctggaattataggcgcatatccccatggccggctaatttttgtatttttagtagagatggggttttgccatgttggccaggctggtcttgaactcctggcctcaagtgatcctcccaccttggcctcccaaagtgctgggattacaggcgtgagccaccgtgcccagccacaaaagctgaattttttaagaaaaatagaagtgagttctttccttctcgcttttgtctttcaaccaggaaacacacacatgttagctataaagtctttgacttttatggaatgacaaaaagcaggacatttacagcattagtagataaatgtagtgttgaaaaaccatgacttgtgactcacatagcattgtagagtggttcctgatcttttgcagacaacagactccttgaaatatctgatgaaaagaatggattcttcacccagaaaaaaatgcacataatggccacaaataagattttgcacttgataaagatgattccatagatcctgagtgaagattctagatttagagtttttacctgctatctcatcatgacagtgtctcacggaagataagactgagaaaaggttgggcccagagaagggaaacagtggctttccttactgggagcattgcaaggttacagtaaagtcagtgacagaaataagagtaaaattgccatctgcctttgtaaaatgacccattatggaatttagaagccagctaaactaagaagctgggagtggaagcagtgagaatagagcccagttccaatttagttctgatttctccgccagtactgtgaacctggggaatgcgcacctccttcctcaccccatgctgtccttcctcatgagtgaaattagatcgatgaccctgagttagtgaacgtgtgcataggaaactgatgaagaaatgacaataagacctgagtacgtgaatgctcattggtgaagcagtgggagttattttctttagtaaggagaatctaagctttcctcctctctcttttctaagtgactcaggccttttgcccccagtgaaattggcataagtccttttgttttccccttgctgtcagtccagaagggttctcaacaatcttgtcttgttagctgctatttgaaaacattagcatctctgctatgtggctagtagcattctggcaaagagctattttacagaaatgacttctagatgactcacgaagccgacaacacgtctgtcatctcctagtaccagggaaaggacagtagagacagtcgttgtcagggaatggtgtctttctcaggaacactgagatggctgaactagcagcataggattttggagacagtagttggtaggagacagagtagatgttggttttattcctcttaaatggccgaaggaacataacgcttacaaagccctgccttttctaccagccagttcatcagccctttcttagctttcatcaggtatttgagttctgaagatcactagaattaaaatgaaaatggtttctgaaagcacaaggagtgctcagcctcctgaagtgtgtagaaatcaacatactcagatttaatttggaggtataaaatgtatttctgcatcaatatggacagtctgttttgtattaatgccatcaaccttccctaatttcttctcatggtgattatttttgtggaaactatttccagaaataactggtacttatatttagtggaggagagaaatggacttaaatatattgaaaatacaaagcaattggaggtagcagtagatggctcagccctgcacgttcacatcagtatttacagtggtaaccaattgatggttgtggcaaaagacttttggaatcacttgtgagggtattcagaaaacatatgatcacacatgttttatgtacgtgtatgaaatagagaaccagccttaggatttcaaataatattggatagaagtaaaataatacccagtttctctttgtagtttcctttactggataccggaggacgattagccttttggtgggttactctgactcccagagtgcccttgaaaaggtaaaggataaagagcaattgatgatctgtaaataatggctactcttctaattagatttttcaaaggaaaattataaaagggaagaacatcctgaaagtgatagcctgcaggacagcaggctatggttagtgatttaactgtagttccactgccagaggtctctaggtctgtcattttttctctgcatttttaatttgtaattcagcctccttctcccaagaattatgtgttttatttatctctccggtttattctttttctgtttctctattgaataaaggggttttttcccctcttttttgaagtttaaaatcaggtgagactacattctttcaaaaagcaaggtcagtgcaattcatttgctttcatttccatgtagatcccaagtaatttatttttcccatttgggttaatggtcctgactagaagagatttctccacccattatatagggacctaggaccagcatcactggaaggaaatatatatatcccaaagctcctctttctccaaatcttttgggcatgaacactccagctcatatgcttctgttcttcttttcagttgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaagtaggttcttgatcttcctctctcttcctctgttgctcaaatttcattactcaccacagactgcattcagatgcttcctgttttatgaacttttatttaccatggatagatgaaaatttagaagagtctaggcattaaacagccaggtgtgctgttaccaaagctttattgtaaccattgatttcaaattccatgggttaatcaagactctgaattgcagctatgcagaaacccaattcaaattagcttaaggaaagagatttctcagtgcctgtaagagaaaatccagcatctctaaagatctcatcaggctgctctcctctctcagatctgctttctgtttgtttgctctgttcccaagcaggtgttactcaagtgtggcagctcgggccgccaggggcttccagcttgcattctcagcttagcaacacacagaagcaccatttttctaatggggctaacactgcaatggcttaagtctggtaccaatgttggagccagtctttgtggccttggaggcttgaggtcttgttgattagacttggtgataggcctgtccctagaaccagagggtaaggcctgcccacctaaattactgggattgaaagtgggaggtggcagttctccaaaagaaagtcaaggtgctcttattagaggaagaaaaaagataaacctacatcctgatctttcctttttttccagagtttcttgggagaagcaaaatgccgtatttgaactagccttctcttaaaaatatgggagttcaaggagaagaaagaggaagtcttgatagtctgtctagaaataagaagctgttattagacagtgtagttgaacatagagccctgtgcaagggaaggaacctaaattaacaatggcactgacaaaccacaacagcctgcctgctcgaagcctgattgtggtattttggtgaaagcttggctaccgtctctggcaggatttgggtctcggtgtgccgtttgggcacagtgcactttattatgttacctggccccagcccttccccctaattcttttcttcatttccttccatctctcttacatagcacactctgcaaaacctcctctggcattgccattccaatgctccagctggtgagatgtcctttgggccttgttttaaccaggctcagggtggttttttcctttcatctttctttctctgggcctctttattaaagctgcagtagaggttgcccagccccaccccctgggcagcccctgccttcagcatccaagttcttcgtggcactgttagccatccttgggcccacgtgttgggtgctggttttaccagttaccccattacccctgagagaggctctgtgtgtgaggcgccccagggcagatctgtttctctctctgtggctctaaagtacttgtaatctttcttcagaattttctaaataaactcagattttaactttcatagtctgaagaggtgggggtttggcattgggggaggagggctgtcaattctatgttttgttttgttttctttaatgcaagaactacaattgaacacacccattaatttataaagcaaaatctcttagaaatatcagcatcttctaatatccaagtcaccctcttcagcaggtgaatgaattgaggcttagaaaggcagtcagttgcctaaagttattcagcagtcagaagtggagttggggcttaaatctgtgttttctgattgattaatttctgagtatgacatttttttctattgtattcaactgccctgtggaggatgacatttacttatgttattgttcctctgttatccaggctttttctgtctttgttgtcattttttggccactttgttccttagttgggctccctctaggcaggggaaaaaggagagaatgtgaaattcagggggtccattctgctctaaggatgcggatagaccaaacttctggaaattatagatggtaaagctgagaaggctgaaacaaaagacgctcaaagggcgtggggctctccatggattccgttgcttaggtactgcctgtcctcgctggccaccaattttgtaaatcagaaagtgaggtaaaaaatacatcttttcacacctgccctccccccatctgtctgtgttgtgggttgatcccagaaatggtccagaagatttcatagaggtgggtgtacagggaggaggctgcgcctgttctggagaggtgaggcagcccactgctcggctccgttcctccccagtggagggtgaggccgccaaagctgggctttgggaagggctgccccctctcctaggcaggcccccgcccaggctgcagggagaacagaagggtgccacgccatgatgcctgttgtccccacactctactggcttcgggctgcctggggatttgctgcccagttttccatctttggaaacggtgtttccaggcaattcagaaagggcaagtgcagcctagacttcttgtccgccctgctagctgctgattagaagaggtgacattctctgttttcactgtgtgagaaggaaagagaaagaactatcccagcggcttattatcaggattctgagcaaatgatctatttttcagagattagatgaaagaagactagtatttggcacagaggaccagacatctggcacttgggatccttttagcttttcactgtttcatcatgcgacacgagcaagtcatttttactgtttgtgttttgattctttttctttttgtggaatagtagttatgatagaagcacttccttagcacttatgatgttgccaaccactgttttcagtattagctttattaaccctcccacagctccatgagataggtactgttattactcccttcttactgctgagggggctgaggcatagggaggttaaatcatgtgcatgaaggtgtacagctgctgagtgatggaattgggactccaaccccagccaatctggctctgaaatagtggaatacacctttattcatgaactattagcaagggatgctgcacttaagggctttagggtcctggaggctgccatagtgaaaaactcagtgctgaggttggtgcttcctgttggacaagcacccttcctcccatccttttctcgcctctgtcctcattagcagcatcttctgtctttgccagcccctttctctgcctttatgcatactgagtactctctgatcttcagaaagccttcttttcaccctaccagctcttctttccttccttcctttctttttttcttttttttcagatggagtttcgcttttgttgcccaggctggagtgcaatggtgtgatctcggttcattgcaacctctgcctcccgggttcaagcgattctcctgcctcagcctcccaagtagctgggactacgggcatgtgcctgtagagatggggtttcaccatgttggtcaggctggtgtcaaactcctgacctcaggtgatccgccccactcagcctctcaaagtgctgggattacaggcatgagccaccgcgcccgaccctttccttcctttcaaggcagactctggagtgagtaagcatgccctcctcagtgctagtcctggactcccaccaccctcctccatgtacgtcccctgtgccctgcctacagtgggccgaggcaactcctctcactggaaacttccttctttggcctccacgacctaatcatcttccagatcttctcccttttgaccacattccacatttttcctttttgggctttctctctctctctctctcttttttattctgctccctatttggcctatgtacctttccttctggggagcaagtctggtggtgggctgggcccgggctggccagtgaagtggccttcacccagcagtgctgacccaccggacatgagggcagatgaactcatgccccgggaaatgtgccatcctcaccttgtctgccttcagttttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggttaatggtcttcaaattgcagttttcacagagaaggttttcttcagtgttagagtcataaaataatggtttgcagacagggcctagggatctttaaggatcctgtctcaagtaaaggcaaaggcaggaagagagatgagatgccacctgagggcaggctgggggttttctggattagaatcaggttacaccttgagggaagaaagccaaggagaaaccggcttagagacttgtgttcatctgtcagcaggcacttctgggacctctgtgccctgctaataatacttttcatctgtaccacacttaatttttttttatttttcttttttattgttttttaaaatttttatttattttgaaactggattatgagactggctagtttttgtactttttgtaaagatgaggttttgccatgttgcccaggctggtcccaaactcctgggttcaagtgatccacctgtcttggcctcccaaagtgctgggattacaggagccactgtgcccggcccacacttaatttttaaaatatttttacctcctgtattttcctcaatcccatgacagtcctgtgcagtaggtacaatagatagtaaccccatttatagatgagaaaatggaatctcagaggttaagctccatgcttcctcttaatgaggagccctggcggatcttgatgtggcatcttctgacttcccaactcaggggttttgcactctgtagaggggggagtgagtgggatgttcactgtctgccaggtagctttatggatccagagcctgacaagaaaactgtatcactcacccttgagctttttttgctgtaaatccaggaatcagagtgcttttgtgaaatgaataaaaagcccatgaacaaactcagtgaagaaggaagacctggtccatcgtccacagctttttctagctttatgccactgacgtcagcctgggacttcttcctgaggcctccatgagccattcatgcagaagaggcagctcctcctactgccggtcagtccaaggcccagatgtgctattctgaccgaagagatggcaaaaaaaaaaaacactaaaaaatgtgcaccttgttttttttctgtcctggtgatctgagttctttttttttttaattttaattttttattttattttttaatgagacagggtctcattatgttgcccaggctggtcttgaactcctgaggtcaagtgatccttctgccttggcctcccaagtcttgtgaattctgccagtgcctgtagaaagtaatcttcagaacatattttgtgtgcgttaggttcccacagcaccctcagaaattctaggaagagtcagccagacggtgaccagcctgaggttagagaaaaggccagccctccctgtattgaacagtgtcaccccatgtgaggcaggtgagcacccagatgcctgggtgggtttggctagagatgctcagattgccagagagagaaggtagatttgtagaaatatcgacataagtagtctcgtcatcatcaataaatgtttatgatttgccttcagtgtaccaggctctgctacatcgttcataaaattcctcttaaaaagagtcgcattctttccctgcagaaacttaccatctagttagagatcacagaaatgaaacccagacactgtgaagtgactgttgacaaaggcagggagatagcgaggcatggtggttcaggcctgtagtctcagcaacttgggaagctgtggcaggaggattgcttgaggccagtacttcaagaccagtctgaacaacatactgagacccatctctttgaaaaaaaaaaagaaagaaagaaattagccaagtatggtggtgtgcacctgtagtcccagcaacttgggaggctgaggcgggaggatcacttgagcctaggagtttgaggctgcagtaagctgtgatggtgccactgtactccagcctgggcaacaaagtgagaccaacacaactctctattttttttttttttttttttctgagacccgaggtttctctcttgttgcccaggccggagtgcaatggcgcgatctcgtctcaccacaacctccacttcccgggttcaagcgattctcctgcctcagccttccgagtagctgggattacaggcatgcaccaccatgcccagctaattttgtatttttagtagagatgggatttctccgtgttggtcagcctggtctcaaactcccgatctcaggtgatccgccctcctcagcctcccaaagtgctgggattacaggtgtgagcgaccgcacccgtctcccccaactcttaaaaaaacaaaaaagggagtgtcctgttagtggcaagtgaaggggcacaggtaggtgagaggaaggtagaggtgatggctgttgatgggcatgagactgctgctgtcacaaccaacagctgctgtgctgggtggtcattgtagctttgttccctcctgtcatccacaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgtaagaaacttggcaaagtctttaagtactttatctctctggaaactttctttgtaaaagctctgagaactttcatgtctgtaatctccttgagccccatttagtttctagaagaatagaaatcactgtctttattttgtggggaactggaaattcattcccctcaaatagccattctcaactctggctacgtactagaatctcttagggagctttttttgaaattgtgatttaattagtctttgctggggatttctagctcatctctttcccagcgtgactcatggatggaggccagcatgtggaccccaggccacctgggggctctgggtactacaacctggacggcaagggggtgtgcctacatctggtgccatcttactcaaacaattgagttttcttccagccaatgtgaagatacacccccaccccacaaaagcactttttactctaactgttttttggaggtttttctgtgttgttttttttgagacagagtttcactcttgtcacccaggctggagtgcagtggcgtgatctcggctcactgcaacctctgcctcccgggttcaagcaattctcttgcctcagctccccaagtagctgggattacaggcacttgccaccacgcccagctaagttttgtatttttagtagagacggggtttcaccatgttggccaagctagtctcgaactcctgacctcaggtgatccacccaccttggcctcccaaagtgctgggattacaggcatgagccaccttgcccggcctctaattgttttttaaagaaggtctgactggacctgcttccagatttgacaacatatctttcaattgcaggctttcctacttttaactcctcacatacttcctaaggaaagtctagacagacttggtacccagccatctctgtcagtactgagtatatttacataactcacacaaatattgtgggagcttagagaaaggaaggagaagataccgttactgacctcaggggatctattattctgttttggacatgagaaccacactgtgttcttagcataagcaaacttgagtgttgatagttttgcaaagtgatataggtaatgagtctttgggggagtcatttttggttcggcacaaattcaagtgtggctttgaaaagatgtcagcatacatgtgaaatgaaaacattccaagaagtttcccaggatgatggggatggctctacagtgtgtgggaagaataatgctttcaattcttgagtgttgccttgtgttaggtactgacatataatcatctattttcccagtggcccctgagtaggctttatcttttatccttgtgaattatccatttcacagctgatgaaactggcagtgagagtgggtacataaatttgcccataggcacaaagctagcaagttggaggttattgaataaagctgggttgcgtctgccttcagaattcatgttcttctctttctggcccatcacttaacctgctgtatgatttttggcaagccacttaccaccattgttggtttgttcttcagttaagtaagagctctgtcctctttctttcagagaaatgttgtaagaaagaatagagtgatggctctgaagtgtcacacttttcagaagaggcttcagtttaaaccattctttgagatttgttccagtattggcacatttttacccattggttgaaagggcccattctcttccatatcctctgtactttctgtgttttttctccataaatacattttacttgactgtaatgaggtctcatgatcagaaaggcatatgaccgtaacactccagctttctggacaggatactttcttgatattttgagggttatttcacactcccctctgctgtgcttttgtggccctttttgctcatgatagctgaaatggaataggggatttcttatagatcatctttaaggacagcgttgggatctcactggtatcccagctataggaaggctgataccattgagtgcttactgagtaacagggctgtgctaaggacttcacatgtgttagctcatttcagactcacagcaacctaatacataaggaattatgatacccattttacagacagcaaaactggcattacagagaggtggttgctcagagtcacacagcaaggaatttgactctgtaccaaactagaaaatttccacttaaatactcatgtattagttactcatttggctttagaaaatatgatcaactctatatttgcttatgcaacaaaaagaaaaaaagaataaagaaaaacaaactatatatatatatatgtatgtatttgcttatgcacagatacagagtggttaatcagacttcatgttctaaacatagcagttccttgagaataggaatcatatcgtcttctttccgtctctcagtttccccagcactttgtttacactcgcctcagtgacagtactgataatacagcctgatcggttgtcagtgtgtctggcatccttcctgcaccctgagcccctgagggcaggggctggacaccccagagctttgcaccagtgcagggcccattatggggcacttggtctagtgctccacaggtgggaggtgcctcttacaaagcagcaaaccaccttctagtggtttctttgagcagcctctgaggtgggcggagcagggattcatgaatcccactttatagatggaaaattgtccccagagagctgaagcaacttgctcagaatgcagtagagaagctgccaccagacccctgggtcctgacctaggcccagtgagccatctccttgaatgagaaagtgctaagggagcatccaccttgcacttgccatgccagggtcaagcctaaagtgacccatatttctgtccactcaggattggatcttgtacacttatgtggctacttcttttcaggatgaatctcacttcctcaaaaacagtaggactgcccgctgtcgagcagctatgccggtcctaaaggtgagtacttctgagaactgagcccactgagcattggcatcccataatattttgctcaggcttgcatgtcgtcctagtccagcaggggttgcaagtatagacctgtgggccatggtcatgacttggcattgacttagggcatctgtctctctccttagggctgtggtaccaatttcatctttcttcctaacatcctgctaaggaactagtaggcagtactagtagtcagtagtgctgcctttgtctctcgaaggtcaagactgttgaggctgggtgggcattggactccagaatcctcctctggcttcctacttagataagagagagcctctagcagcttgtccactaattagcttagaaaaaactgcctgtcttctaagtcacttgtagtggcaaagctgcctagatgctggaaatcagggaagacgagttgtattaatgaaagtaatggcaaaaaaacgcaattacttttgcatcaacctaatacaaacagaactgagcaagggctggcggggtcagcgagatacactggcaaagctaagatgggccttaaaagctgatactgttttctgtggctaccctgagcctctttggttgacagaaggggcagccatcccccttcctccctgtggtggcctaaactcatttctgagtgctttggcgggtgtgagttctggcttcacagcaagcaggcgtgggtatgtgatgcagattctagtctttaagcatgttctgatgtgcaatataggctctgtatttcatctgtctctctcttctgtgtttggtttcttagtcccccatcccaacagagggtagtcctccaaatttccttccattatgggggggggggatgatttttttcctattattgtaagagggaaggagaagtacaattagaaaagtagccttttctcttgtaacaagttagaagtttctcacagattactttggaggtatccactttggtttgtgtagactgagcaaaccaaagtgtgtgtttttcttgtgctcaaagcaacctttgtgttgtaccagcattttaaaactatggcttttattgattaaaagaagctttaacttttacctaaactagggaaaacaaatacgctgaatgttaatgaagcttagcatttgaacattaatcttaacatttcctcacaaaacacacgtaagtgtccactcatttcaagttttcatgtgtttaggaataacggaatatgatacatcttccaaggcagggtcatgtcatgtgccaaaccaaagaataaaagtcttttactgcaaaagcttggttttgctggggtggtggctcacgcctgtaatcccagcactttgggaggccgaggcatgtgggtcacttgagaccaggagtttgagaccagtctgagcaacatgacgaaatcccgtctgtactaaaaatacaaaaatgagccaggcatggtggtgcacaccaagctgaggcaggagaatcgcttgaacctgggaggcagagattgcagtgagccgagattgtgccactgcactccagcctgggtgacagagtgagactctgtctcaaaaaaagaaaaaaaaaaaaaaagcttgattctctgccagtattacctataaatatttatatgtcaatagccattgatggacacatttaaataaaatgtttttcctaggttgatgacccttcttttgggaggccttaatatgctttccataggaaaacaatagggttaggtattttggtttcagtatttcagccataactaaattaaatctttactcctgattgtttagacaaaagaaaatgcacaatagatagattctatcattaaagatacaatgtgaaagcttctagcaaccacttgttaatgtagtcattgcctggctgggcaagctgagccagatagtggtttctgaaatgtgtgcctctcagccagacctttggaagcagcatatacctctttaatatcttgagtgtgtttcaaagtgacatgtttaaaagaaatctctaaactgctaactaatatgtactactctgcatttgctgtagaacttggatgaattaatattttaaaataagcctcatgaacatggcctgtgtttatgaaggtgtcttggggccacgctcttccgcaacgttgacttcatataatgctggactgtggcaggattgggctgaaggagtgggatggagcattctgtgctattctgttaaccgaacctttcatctctgtcttattgtattttcgtctagattggagtctctcaaccatggtactgttgacattttgggctggatgactctgttgttggggggctgttgtgtgcattttaggatgtttagcagcatccgtggcctctacccactagatgccagcagttcctccccagtcatgacaaccaaaattgtctccagatgccaccgaatgtcctctgagggaggacaaatcactctctactcaccttgcccttctccaaccccatggagaaccaccaatctaaataaggaaatgaatctaaatgtttttggaataataagatagttgggaaaaagtaaagtatgtctttgaaaagccatataaggacctaatttaataccacttgattgttcctctaatatgaacatctcttagaactatattctgataattaatattacaagcatattttcagcaaataggcataatgaggtatttagattaaatcatacagttcgttggatagcagggccagatcgtgtccagaaaaatgtggattttgtaaatagcaatagcagtcagcagagagaaggtgtgttagattgtaagaaattggtgtcactgtcccctgggaaacgtgacatttttcttcccccacagcactattggctggggctactaatcctaaatgaggtaaatctatttttatatataaatatatgaaagtagaccagatagaagctaaaaagaacaaagttaaaattacctttaatccctccaacagaaaaagccactgttaacagcttatttttccagcatgtcaattattgagcaagatcatcatttttcaataactatggagcatttacatagtggagacacatcccataatttaatcctcagtatcagacatgcggttgttttccatttttgctattataaataattctgcaagtgaacatcatctatatgtaccttgcatatttatcctattaggacaaattcctacaatcagaattgccaggtcagttttcatttgacctttttaggggaggcctctgaagtccagtctggccaggcataacaatcttcactcccattcagtcttcaatcagaggcttttttttcccacatgactccgccctcaggattactggcactcttttaaacagtgaggtgtgtgtttggggttttttggtttagtttagttgtcttttgtctacactggcttttattgttaaactagtgtaataacaaaattaaaaatttttcaaagggaaaggcccctagagtcctaccattctttcctaagaagcagctgtttctctttttctgtaagtagagagtactttttatatctctgttgattggctggatgagatagtggctaaaaggtataaggtttttttctttttcctttgttattaaagtagtttaaatagatgataaattcaaatggggccgggcgcagtggctcatgcctgtaatcctaacactttgggaggcctgaagcaggaggatcacccgaggtcaggagtttgagaccagcctggccaaaatggcgaaaccccatctctactaaaaatacaaaaattagccaggcatggtggcacacacctgtaatcccagctacttgggaggctgaggtgggagaatcacttgaacctgagaggcggaggttgccctgagcggagatcgcaccactgcactccagcctgagcaacacagctagactctgtctcaaaaaaaaaaaaaaaaaaaaattcaaacaatacaaaaggatggacagtgaaaaataagtctttcaacccctctaggttccctagtccccagtctctttcctcaaaggcagctatagttaccagttttcaggtttacttccataaaataacctgcacctatggaagtacgagtgtgtgtgtttcctttctgcctccttagagtgttttacaaccattgttttacacttgcctttatccccttaataatgtatcttgaaaatcattccatgttgttccaaatgacttctaccgcattcttgcaaatagcattctattggataaatttatcataatatgtattatctgttctcttttgatggatttgtaaccaaattgcagctattacatgcaacactgcaatgaccattttttcatatgttagagaagtggggagtagaaaatgcaatccctgtgtgtctgagatggctttttgcctatcaggccagaggggagagcagtgtcagctggcagattctgttttcttccctagtgtgatgaggctatagaagtcccctgaggtccggccattctcatttatttcctcactttcattacataatcagacttaaaaaggaaattattagagtttgaaacctatagtaaaatggattgtcttttccagagtaaaaaaatctaccttaggccgggcgcagtggctcatgtctgtaatcctaccactttgggaagctgaggtgggcagatcacttgaggtcaagagttgcagactggctggccaacatggtgaaacccacctctacaaaattaactgggattggtggtctgcgcctataatcccagctatatgggagactgagggaggagggtcacttaaacctgggaggtggaggttgcagtgagccgagatcatgtcactgcactccaacctgggtgacagagtgacactctgtctcaaaaaaaaaaaaaaaaaaaagcttggaatggcatagctttaatcagctataattataccatttgatatattctcattataatattttggtatttttggtccaatatacatgcagtcactgtcttcattctgtctgttcttacccaagaactgccttatatgtggcatgataatttcatttatgttacagcagcaatgctcacttagcttgaaggcattatggttatcatagcaaatcagtttagttaaggttagtactattcagatttgtgactggaactttgttttttttggaacataggctagaacctagagggaaccatttatgtgaaataagctgacctaaccagagattcagaggccatgtataaagtatcactgagtggtaggtggccttctgccaatacttagggcagcctctggtcagcagtggccataattatgctgctttcttggtttgtcctggtttgttttggggggcaccactcaggagcagagtaaagaatacacccgtggtctccctccccgactccaagcactggctttcttctgaatgtcaagcttttctttttgcccttaggctttcgatttaactacaggtgtctcttttgtagctccttgtatagtgactgtgatcccacatttattcttgatctgtgtacttttggtcacttgtcctcaagctatgcttgccactatccttatttctgaagattgtatcatgacctctgaactaattaaaacacagcttcaatgtccctgccacatcagggttactgagtatggagactttccagcggtgtggacttgaccttctctttgatattacctgccttcttcatgtcttatttctaaattgaatatatggtattgtataaatttatttagagtaccattaggaataattctgggtataagactggactgagctttggagaacatgatttttttcctagtctagggttttggcaaaatatgttacagcccatcagaataattcagtaaagcaagttactggctcaattggaaaaaaaaaagagatcacataaagtgatgaagaatttctggactgcttcttatataaacttaagacttcagctcttttttctacagtagaacattctcttggctcttaattttattttttatttaattttatttttttgagacagagtttcactcttgtcacccaggctggagtgcaatggtatgatcatgatctcagctcactgcaacctctgcctcccctgttcaagtgattccctgcgtcagcctcctgagtagtgggattacaggtgtgcagcactgcacctggctaattttgtatttttagtagaggcagggtttcaccatgttggccaggttggtctcgaactcctgacctcaggtgatccgcctgcctcagcctcccaaaatgctgagattgcaggcgtgagccatcatgcccggtcaactcttaattttaaaactatgtatagattatccactttcaattacgacattgaattctctgtggcgaattatgtatacacgaactcagcctattctgcagggttttcccacccccaacccacgaagaaactaagcctatctttgagggtcatctgatcccaacagtgtctgcacatgtgaatcatgttatctttctaacaccacacagaaagtatttttttacattgttctatcttcgatttcttgggtgttgcttttctcccttaggtgggggagttcactgtaaactgttcaatttggtgttgatttatgtagttttatagatttctgttttcctagatttggaagttttcagaagtggagggtgacatatgacacctttgcagctgggcatgtgttaaaagcccttgtgggtgatcgtgatgacatacacacatgttggggctgagctgggagcaggccaaatcaccccattacagacgagatgccattctggtttctttttcaaagctggactttttctttttttgtaatgctgcctctgcctttttgatgcccacaaacacccattggcaacgctcccatcactctctagtctagggagtgtatgggagaagcgatttaatactaactacatcctataagtatctgacagaagaccctggagttaatttccatcatctgattcatgaactgtttttgccctggctccatccccaggccagcacagtgacatgaagaataggtttggggtgatggggagattttctctttttgataaaacttttcattttcccctttttcattgaaatgatcttaaagccaaggcaagcgatgctaccaacgtcagctcattgttattttaatgagtctgcattaaaccgtgcaggaagttagaaggcctaggtaattgaactgtggaaaattatagctggagacattcatagctctcccatcataatggaattagatattggcgattgctgtgagggcacaaatgcgtttagataattgtgtatattgtatatttataaagaatgatttttcttttcactgttgcacctttatttatttatttttatgaggcagtgtatccatctgtaaacctaatttattctcctaggtgatttattacatgcaattgccttgtattactgtcattaactcaaggttacagtggttaacaagctgtttctagacaactgagctccatggtagggtccgttcccagagctgaagtgaattttacgtccagtaatttgtagtgattctgtgttctaatacagtaggaagagtctctttttttttttctcaccctctttcccatcttaataataggaggtgggatctttgggtctgatgcccatgggtcaggttggtgtctgggtagtgaggaacttggaatctgtcattgctgttgaccaactattttttcccatcttgcccatgctaagcaggctgctgcacatctgggctgagtttagggaaaatggaaccaggtatcacctattaaggttcttattgttaataactgcaaaatgagcctgagtcaggatctgtaggcttgaagcattgtgaagctgagttagtaaaggccttattttcctttaaagaaagtcacatggagacatatacattggcaacccctgacacttcctcttgggaatgggagagggctgattgtaattgtcattatctgagttcaacttgcatgtcacagatccactctggaggaagttcagacctgccactgtcttctcccacttcctgtccaatgctggattctttgagtttactctgtgttctccaggatactaattagcttccttgtgaattttttgcagcatacggtgaacatttattggttacttggcgtcaggcatatgctacagaaaataaaggtgaatacagcccagtccttgatctcaagaggcttgcagtctaacaagggagacagaaaagttataattcaatgtaatatgttaagtactaggatagagctcagcagagggcaggcagggaggatttaaagaaaaggagatgccatctaactgcttgcattggcaatgccattaggttctcgcgacacgcacgcggtctttttctgggggcatccagctcctccctcactggggcattttgaacatttcctgtgtgctcctccctgtgttcagagcacctttggctgtttgtcttttaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacgggtatgtattatctcttccctcccagcccacccatttctcaccctgattttgacacttatctttctcttccttctctctggccatgatatggtcagaagagcactggccaggggaatggattttagtctttctgtttcttactatggccttggaatgacctcaggggtaagatgaaaatggtcatcttaccctttaaatctagttttaatggttatggttatccgaagtcatcgttttccagtaaggggactagtggctgatgtgtaggtatgtggagctctgagagccggcttccctcttgcccagggtcacagctctgcatgaggcacagtgctggagctataaaaggaaagtccttgtcaagtgctggccctagagaagatgctggcactgaggtgagctaggagtgaggctgaggccccaggcagagggaagaagtaggtgagggggtaagggcttcctcctggcatgggaggaatatgaagtaaaggtgggaaattcctccctgtgcaaaaaaaaaagaaaaaaaaagataaaggtagattgaggagcctgatcccaaactgccttgggtgggctctgtgagtgcagtgccaatggcgcaggcacctcaggacctacagtcggcactccagaaatgctctcccaaaatggcagggaagccctgtaaacaccaatgcattgccatggaacccttgtttttaaaaccacattaattcagaccttagggattcttgttttgtgatcaagtcacaaaggtactggcactttggagaaatagctgcaacttaccctacaagccatctatgagggaaaagccttgctgtgcaagtacatgatataaataagagtgtctgccttattttttaaatttttaaaagaagaaaaaaagttttcaagtactttaaaaatatccacttacattcaaacgaagtacttataatggaaattgtagtccttagcatagttaattgcaaaccatttttagctggttattgaggcaggaaatttcccaattattaaatgtatttaaaagccgtacacttctttaatcatatatttagttcattttccctgtagatcaatccagattagactgatgctatatagttttcatggtccctcaaaactcttcatgtatgatttggatttctgtcctattcgcaaacagtccactttctaaaaaggatcttctctttcttgactatatgggcccatggcataataatgttcagctagtgatgaaaggggctaaagataaaattgattgcctttcttccccaaactgtcccttcctatgttccccatcttaggccagcatctcagtagtttctcctgccagaaactaaggcattatctttgaattctccttttcctgccttcttgatacacctccccaatacaacaaagaatgccttcctcatcttcacatctttctttccacctaacccagtgcctgatatgtggtaatttttcaattaaagcttgttggattgtgactatcccaaggtcaagtttaaaatttttgccgcatgcagcggtacacacatgtagtcccagctactctgcaggctgaggcacgagaatcgcttcaacccaggaggcagaggttgtagtgagccaaggtcatgccactgcactccagcctgggcgacagagtaagactctgtctcaaaaaaaaaaaagaaaaaagtaacaaattacttggtattttggtgttactaagttttaacctacaaggttaagagctaacaatattagaacataggagcatgctatctgtcttagtctgttttctgttgctgtaactaaataccacagactaagtaacttacaaagaatagaggtttatttagctcatggttctggagactgggaagttcaagagcatggcactggcatctagtgagggccttcttgctcttcataacatggcagaaggcatcatatggagaagagggcaagagcatatgtgtcagctcaggtctctggtccttttcttataaagctaccagtcccaacatgggggacccaccatgatgaccttatctacctcccaaaggccccaccttcaatcaacataatgaatttggggattacttttctaatgtgtgaaatttgggggacacatttaagccatagcaatatccaaattaattatgatatccacttgttctcagcatggtttttatttaatacaatccataagccagggctgccttttttttttctttttctttttctttttctttttgccagcttcatgcattaagaaaccactgaaaagagaacctcatgctgagctcatttgcaaaccactaactatctgaaggcatttgctgagaacttccagttgatttcagagtattttttaaaaagaagaaacagctttacaacattttattcctccacctttgaccatctcttccttctctcaatttagcaaaggtttatgagacacctattctgtctccactattatgctaggctctctagccctctataatgggaaaacctagcccctaccctcaggtagctagctcatcagccaggaggggagatgagctccttaaaagacaaagtagcaggcacactggctccctgattttctactagactgtagaaatcagttccatttccagtaagattgttggtgagggatagggtttttaatggtaatggcttctttttttttttgagacagagtcttgctctgttgcccaggttggagtgcagtgacaccatctcggctcactgcaacctctgcctcccaggttcaagcaattgtcctgcctcagcctccctagtagctgggattacaggtgcatgctaccacgccggctaatttttgtatgtttagtagagatagggttttgtcatgctggcaaaactcctgacctcaactggtctctaactcctgacctcaagtgatcctcctgcctccgcctcccaaagtgctgggattacaggcgtgagccactgcgtctggccagtaatggcttctctagctgtgtgatggggaatgaacatttgagatcactgcctcccgtgagctcctcaacgagggagccatgtttatgaaggactgcctaggcccttagccagactgccagaagcctatgtggtgggctcctcctgccaaccccagctgccatctacaacaacactgcagttacttttattatattgtacttgtttgtgctggtgtaatccatactgcagaacaacagtttttaaaatccctgtaagtctcatcaaataaagatgttactgacattattttattacattgtgcaacagactctgtaggataagccatagggaagatttagtatttagtgtacaggaatagtctgacaagccaagttttttgtttgttttttaataaaatggacacccaattgcttgacttctggcatttgctgctggaaaagaaagctcactgccaaattgtagaatgccatgataggtgttttttattcatctcattcctgacttttttctctcttttcctttccatttctcatttgttttattgggggtttatttgtccctgtaagtcacttgaagttttctgagctaagccaggggtggttgtgagaagagggacctcccgggatcccaagtccctgttggactgggcctgaaaggagcctcatggggctgtcgctgtcttgttctctgcagatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactgtgagtccagggctggagacagatttggaagcagacatgtctaggtgttcctttccatgagaggcccttgaaaatgacctggcattctctcagctttcctttctgtaaccttttccctcttccctaggcaagaacagcaagtccatttcattcctcagcctacctagtcagttttgaaaaatctcatattaagttgtggttttatacttgtatagatcgctgttgatggatggccataaagataagcacaggcaacagcagggtggtgatcaatattccgaatccctcaaagaatgtggaaattatgtctactatattttgagaatgcatcagtctagtaacagttgttagaaaattagtcctaacatgtttgatacatatgttaatcctttaaccatactgtgtcatttgtgttagtcaaaataacaagccgacattcttataacaaaatagagttttcaaatcctcctaaccttttaaatccctattacaggcatttatggttggcaggaagttggcatccccctttttacagagagggaaactgaggctcacagagattgcagtttgcccagggtctcttagctgctccaccacagagctgaggctagaaccaagcctcttgcccctatattttaggactgttttcactatgatggttttatcttttcaaacacttttatttctgtctttagtgtcatactgtgctaagtgctataatctacaccagctctgtttctgtcctcttagataaaaccttgtaattcccattactaagaaaataacagtcattgatatttttcaacatcatgaagcattatctgggcttgatattaccctgtataaagatatttagatgtagatctcagccttctgggaggttacaaaataaataagaatgacaagagacagaatgcatgtttttcatgttattttaccatgtgatgagcaagattcattgataacttttaagaaatgacaggatagaggatgcactggcaaattttcaagctgtattgaatttatgctgtattacatataataatctggatggtctggagtaagtgagcaggcatcatctctttattgtggagttttcaaacttaaacaacatcgatgtagacatatagaccagtgttctcagattatatttcagtggaatcatgagtaaaaccaggaagctttgtcactaaaatcaatcttggtggtcttttgtttatttttagagataaaaatgcaatgagtagattattttttctcaatttgaagttttttcttataactttttcttaataactttcgtctactggtgaactctaccagacaagaaaaccagtgaactggtatagcaaatataatattaatggaaaaattcagacatgcaatatttttagatgcaaagagctgaatatttataaaatgttattttttttgccagcaaagttgttccttgtgtgtgtgagatggaagtaagtctgttagtgtttcgtgagattccccagagaacaccctcaccaatacctggttcacctcctgaaccagtttgagaacagccaaggtagacacctgaaaaagcaattagtgggcatttgaattaaggaggaaaagcacattaacttgttgaaacacaactgtgaattgtgtagtatggccaaaaagaaaaaaagaaaagcagtagaaattttgtgcttagtgcaacaagatctgaaagcattttgtaaacttctgccaacttgtatagttcttcaagtaaagggagtggctcttttcaaagatgatttcagatgtcacctgagagtttgatttctgagcttgttggtgatgctatgaaattaactaggaggtactatggaatttaggaatgttgggtgttttataactttaggtagctatacaaatccagtatttttgaggatatttttatattttcttgcttagaaacggagccacaactcccttttggttgtggaaaagtacataaggatagtgccagttgcccagaatcctgcctactgggtgattatcctctttgctttgtaaacaccacagtgttaactccattttgcagatgatgaaaatgaagcctaaattgcagtgtcattcttcaagaatccagctgagaaagagcccggagctcttctcagtccagcacctgagagttgctgtctgcttccttggagtcttaggaaagttaaacgtttatccctgaaagatagagattgagttggtacagattaccatcagtgtgatggctgaagccagacactaaattctttcagataataattccttaagaacttgatgcctttttgtgtcttaatagaaatcaatttttataatggaaaatccaagtagaaaacagatttgtgtgtttgtgctttgggccatcagaacctttggatttctaaagccattgatttagtgcatttctaaaccatggatctgatcaggatcattgctctaacttaattcaggaagggagccagcatcagctggaggctggactagatgaccataggcatgtcttccagaccctggccagctatgaaatcctgagttggaagggttaaaatggggacttattttttttatggttttagttgaataaggaggccctgtggatctatagaaagtcccctctctccactgccaccagttttttaagttactttttagtcccaagtttccttgcaattttgcaaatcatggtgactccagccaagcactgctgacctgcctgtcaagaattgattctttgttccttcacacctttccatctggaagaatacatttcttaaaaagctttatatcacaggagccaaggtgaaggagccaatttatagaatgtaatgtataatcaaagacttttctcattttttcagctgaaataatggatatcgcttcacaggcaaaggaaagctgactgtaatcatcttttgtctaaagccattttttcatcctcaagaccagtaacagagaaatggaacaagtccatacagatttcctggtaacaatatcagttcacccttgccatttgacaatccactcaaatttccaatgtagaaaaatttaaaaactccattggatctaatttaattaaggtctagtcaggaacaaagaatgcaggttatttaaaatttcctggccagtagctggcaaaagaagtaagatcattaatagagagtattaggtctgcacagtttgggggagtttttttaaagctgaaactattgatttctcccacattaaaatagatatctattgtataaaatctgaaaaataaagaaaaatacttacaatcagtaacatttattgaatacttgctctgtgctgggcatggtgctttacgtgtattgcgtcattaaattctcaccatcagcccagatatttgagcctcagagcctgcacttttaagtgctacaaattctggttctaccgtttagtagcagtgtgacaagtatactcatttgactttttttgcctcagtttcctaatctgcacagtggtaaagtagtgcctccctcatagcaatgctgattattaaatgagttaatgcatatttagttcttagaacactgcttggcccgtaataagtggtatatgagagttagttgttatttttattactatactataaaaaagaatcatcttggggcggttccaagatggccgaataggaacagctccagtctacagctcccagcgtgagcgacacagaagatgggtgatttctgcacttccaactgaggtactgggttcatctcactggggcttgttggacagtgtttgcaggacagtgggtgcagcacaccgagcgtgagcggaagcagggcgaggcatcgcctcacccaggaagcgcaaggggtcagggaattccttttgctagccaagcaaagctgtgacagatggcacctggaaaatcgggtcactcccaccctaatactgcgcttttccaatggtcttagcaaactgcacaccaggagattgtatcccgtgcctggctcgcatggtcccacgcccacggaggctcgctcattgctagcacagcagtctgagatcgaactgcaaggcagcagcgaggctgggggaggggtgcccgccattgctgaggcttgagtaggtaaacaaagcagctgggaagctcgaactgggtggagcccaccgcagctcaaggaggcctgcctgcctctgtagactccacctctggaggcagggcatagccaaacaaaaggcagcagaaacctctgcagacttaaatgtccctgtctgacagctttgaagagagtagtggttcttccagcatggagtttgagatctgagaacggatagactgcctcctcaagtgggtccctgacccctgagttgcctaactgggacacacccctgagtaggggcagactgacacctcacacggccaggtacccctctgaaatgaaacttccagaagaacgatcaggcagcaacatctgctcttcagcaatattcgttgttctgcagcctccgctgctgataccgagccaaacagggtctggagtggtcctccagcaaactccaacagacctgcagctgagagtcctgactgttagaaggaaaactaacaaacagaaaggacgtgcacaccaaaaccccatctgtacgtcaccatcatcaaagagcaaaggtagataaaaccacaaagatggggaaaaaacagagcagaaaaactgaaaattctaaaaatcagagtgcctctcctcctccaaaggaatgcagctcctcaccagcaatggaacaaagctggacggagaatgactttgacgagttgagagaagaaggcttcagatgatcagatttctctgagctaaaggaggaagtttgaacccatcgcaaagaagttaaaaaccttgaaaaaagattagacgaatggctaactagaataaccaatgcagagaagtccttaaaggacctgatggagcttaaaaccatggcacgagaactacgtgacgaatgcataagcttcagtagccgatttgatcaactggaagaaagggtatcagtgattgaagatcaaatgaatgaaatgaagcaagaagagaagtttagagaaaaaagaataaaaagaacaaagcctccaagaaatatgggactatgtgaaaagaccaaatctacatctgattggtgtacctgaaagtgacggggagaatggaaccaagttggaaaacactctgcaggatattatccaggagaacttccccaacctagcaaggcaggccaacattcaaattcagtaaatacagagaacgccacaaagatactccttgagaagagcaactccaagacacataattgtcagattcaccaaagttgaaatgaaggaaaaaatgttaaaggcagccagagagaaaggttgggttacccacaaagggaagcccatcagactaacagttgatctctcggcagaaactctacaagccagaagagagtgggggccaatattcaacattcttaagaaaagaattttcaacccagaatttcatatccagccaaactaagcttcataagtgaaggagaaataaaatcctttacagacaagcaaatgctgagagattttgtcaccaccaggcctgccctacaagggctcctgaaggaagcactaaacatggaaaggaacaaccagtatcagccactgcaaaaacatgccaaattgtaaagaccatcaatgctaggaagaaactgcatcaactaacgagcaaaataaccagctaacatcataatgacaggatcaaattcacacataacaatattaaccttaaatgtagatgggctaaatgctccaattgaaagacacagactggcaaattggatagagagtcaagacccatcagtgtgctatattcaggaaacccatctcatgtgcagagacacataggctcaaaataaagggatggaggaagatctaccaagcaaatagaaaacaaaaaaaggcaggggttgcaatcctagtctctaataaaacagactttaaaccaacaaagatcaaaagagacaaggccgttacataatggtaaagggatcaattcaacaagaagagctaactatcctaaatatatatgcacccaatacaggagcacccagagtcataaagcaagtccttagagacctacaaagagacttagactcccacacaataataatgggagactttaacaccccactgtcaacattagacagatcaacgagacagaaagttaacaaggatatcctggaattgagctcagctctgcaccaagcggacctaatagacatctacagaactctccaccccaaatcaacagaatatacattcttctcagcaccacaccgtacttattccaaaattgaccacatagttggaagtaaagcactcctcagcaaatgtagaagaacaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaaggtgttccttgaaaccaatgagaacaaagacagaacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacattcaaaagacagcagaaggcaagaaataactaagatcaaagaagaactgaaggagatagagacacaaaaaacccttcaaaaaatcaatgaatccaggagctggttttttgaaaagatcaacaaaattgatagaccactagcaagattaataaaggagaaaagagagaagaatcaaatagatgcaacaaaaaatgataaaggggtatcaccactgatcccacagaaatacaaactaccatcagagatattataaacacctctacgcaagtaaactagaaaatctagaagaaatggataaattccttgacacatacactctcccaagactaaaccaggaagaagttgaatctctgaatagaccaataacaggctctgaaattgaggcaataattaatagcttaccaaccaaaaaaaatccaggaccagacggattcacagcctaattctaccagaggtacaaggaggaactggtaccattccttctgaaactattccaatcaatagaaaaagagggaatcctccctaactcattttgtgaggccagcatcatactgataccaaagcctggcagagacacaacaaaaaaagaattttagaccaatatccctgatgaacatcaatgcaaaaatcctcaataaaatactggcaaaccgaatccagcaacacatcaaaaagcttatccaccataatcaagtgggcttcatccctgggatgcaaggctggttcaacatacgcaaatcaataaacataatccagcatataaacagaaccaaagacaaaaaccacatgattatctcaatagatgcagaaaaggcctttaacaaaatttaacagcccttcatgctaaaaactctcaataaattaggtattgataggacatatctcaaaataataagagctatttatgacaaacccacagccaatatcatactgaattggcaaaaactggaagcattccctttgaaaactggcacaagacagggatgccctctctcaccactcctattcagcatagtgttggaagttctggccagggcaatcaggcaggagaaagaaataaagggtattcaattaggaaaagaggaagtcaaattgtccctgtttgcagatgacatgattgtatatctagaaagccccatcgtctcagccccaaatctccttaagctgataagcaacttcagcaaagtctcaggatacaaaatcaatgtgcaaaaatcacaagcattcttatacaccaataacagacaaacagagagccaaatcttgagtgaactcccattcacaattgcttcaaagagaataaaatacctaggaatccaacttacaagggatgtgaaggacctcttcaaggagaactaaaaaccactggctcaacgaaataaaagaggatacagacaaatggaagaacattccatactcctgaataggaggaatcgatatcatgaaaatggccatactgcccagggtaatttatagattcaatgccgtccccatcaagctaccaatgactttcttcacagaattggaaaaaattactttaaagttcatatggaaccaaaaaagagcccacattgccaagtcaatcctaagccaaaagaacaaagctggagtcatcacactacctgacttcaaactatactacaaggctacagtaaccaaaacagcatggtactggtaccaaaacagagatctagaccaatggaacagaacagagccctcagaaacaataccacacatctacaactatctgatccttgacaaacctgacaaaaacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggaaacctacagaatgggagaaaagttttgcaatctactcatctgacaaagggctaatatccagaatctacaaagaactcaaacaaatttgcaagaaaaaaacgaacaaccccatcaacaagcgggcaaaggatatgaacagacacttctcaaaagaagacatttattcagccaacagacacatgaaaaaatgctcatcatcactggccatcagagaaatgcaaatcaaaaccacaatgagataccatctcacaccagttagaatggcgatcattaaaaagtcaggaaacaacaggtgctagagaggatgtggagaaataggagcacttttacactgttgatgggactgtaaactagttcaaccactgtggaagtcagtgtggcgattcctcagggatgtagaactagaaataccatttgacccagccatcccattactgggtatatacccaaaggattataaatcatgctgctgtaaagacacatgcatatgtatgtttattgcagcactattcacaatagcaaacacttggaaccaacccaaatgtccaacaatgatagactggattaagaaaatgtggcacatatacaccatggaatactatgcagctatgagaaatgatgagttcatgtcctttgtagggacatggatgaagctggaaaccaccattctcagcaaactatcgcaaggacaaaaaaccaaacactgcatgttctcactcataggtgggaattgaacaatgagaacacttggacacaggaaggggaacatcacacaccagggcctgttgtggggtggggggaggggggagggatagcattaggagatatacctaatgtaaatgatgagttaatgggtgcagcacaccaacatggcacatgtatacatatgtaacaaacctgcacgttgtgcacatgtaccctagaacttaaagtgtaataaaaaaatatatttaaaaaaagaatcatccttacatttgatatttgaatggacaaatgaactgtatgtaatatttttgggtcaactgggggaattttgaacatagtctcagtagtagatgagataaaatgtactgaaagagaaagttactaaaaaaacaaaaccagattaaggaatggtatgtacaataaaattttatattgatgtaaaactagaaagaggtgtgtgtgtgtgtgtgtgtgtgtgtgtgtgtgtgtatgtgtgtgtgtatgtgtataaagacctggaaaggtaaacattaaggtaatgagcattggtggacactgatggtaattaaattgatttaattaaattcaaaaatttcctatagtgcacatgtgctgcttctgtaactatactttttaaaagtacaaacaagataataaaaagttaaccaatttaaaaaaaaagaatcatcttttatacaaccataattttggcatatataatttgagtatttttctataattatgtgtgtatatgttgctttaagatatatttttatgtatctgcatataaatatatataaaatattatatatgcaataagcaatatgtgtattttaaaagcagaactgggatcatacaaacacgtcaagtgggaaggaaaacaggttactgtcttatgaagacttttccatgttgttaaatattctcttaaaacataatatttagccaggtgtgctggctcactcctgtaatcccaacattttgggaggccaaggcaggaggatcacttgagcccaggagattgataccagcctggacaacatggcaaaaccctgtctctacaaaaaatccaaaaaaattagctgggcgtggtagtgtgtacctgtagtcccagctacttgggtaggaggctgaggtgggaagatcacctgagtctgggagtttggggctgaggtgagctgtgattgtgccactgcattccagtgtgacagacagagaccttgtctcaaaaaaaaaaaaaacaaaccataatatttaaagactgcatagtgttttctcacacggctataattttgctaatcgttttgttgggcctttaagttactttcaattgctcactattctgagtaatactgtactgaaaaagtagcttacatagaaatttgtgcacatgcaattttataatgagaattagttttaaggagtaagttgctggatggtagggttttggcatatttaaagggggttggtacgttttgctgcatcatccccaaaagggctagcccagtgtaccatcccaccagtcaagtataataaaagtgtttgtttcttcatactctcatcaactctaggtgctaaatgttagagcaagattcctgaaagtgcttctcagcagttttccatctgtttgttttgccctctttctttcttattagggagtatggcatgagtgagtgtaggtgggaggggtaggctctctctgaaggacacgagtaaaactgaagatgggggccaactggggtgcagtctgatggaggcacacatgctgcgagtgaggtcatcacatgtaagcctgccctgcccctttggctactagaaactgcattgggttggagggcctagcctgctcctggggaccgttagacgtccatgaatggatttcatgaagtctgagctcactagccacaggtgaaaagttgtgtatgtttccagagcgtgatacaaaataggagggtaggtggctgccactgccaagacacatgtaggatatgaaagggatttacagtctaatcagtgaccccacagcttcctgggttcctcagcatctttcttttttcccgtaaagtcctggaggaaagataccattcaaagctaagaagctggccagatgcagtggctcatgcctgtaatcccagcactgtaggaggccaagatgggaggattacttgagcctaagagtttgagacggacctggacaacatagtgagatcctgtctctacaaaaaataaaaaaaaaaaaaaagctggtgtggtggtgcatacctttagtcccagttacttgggaggctgaggtgggaggattgcttgagcccaagacgctgaggctgcagtgagccatgatcgagtccagcctgggtgacagagcatgaccctgtctcaaaaacaaaaacaaccccaaagccaagaagctgttttaaccagacagctttttcctccatccatggttattagttttaggtacagtctggctgtggttgctttcctgagttatcaagatctcaagaatgacaggttcaaggctatagatgttattgctgttgaatcacgtctttgttccctggggaagctgtcctgtcagtcacagatcttacagaggccaggcacaagaaggggggtgcacctgtactatgcttgctggtgaaaggagatggccacctgtcttggtccttttgtgctgtaacaaaatactttagactgagccatctataaacagaaatgtattgctcatggttttaggggctgggaagttcaagatcaagtggccagcagattcagtgtctagtgagggcccagtttctgtttcaaagagggcggaaggaacaaagaggctctctgtccttatgatctaagcatctcccagatgccccacttcccaccaccactgcactggaaattaagtttcagattatgaattttggggggacactcttaccaatgatggtaagagtatgatctctgggaggccagagcgatagtaaatgttatctcacattattatgaaatgatttgagcatctcctgtgttagcattctttattaggagtcacttaaatgtaaaccataaagaaaacaccgtttcttcttctgggaagttaattaccttatgtgggaggtataccaagaacacctgaataatggttttaaaatgatactaaaatgggccaggtgcggtgactcatgcctgtaatcccagcactttgggaggctgaggtgggtggaacaccggaggtcagaagttcgagaccagcctggccaacatggtgaaaccctgtctctactaaaaatacaaaattagctggacgtggtggcacatgcctgtaagtcccagctactcggaggctgagacgggagaatcgcttgaacctgggaggcagaggctgcagtgagccgagatcgcgccactgcactccagcctgggcgagacagagcgagactttgtctcaaaaaaataaaaaataagataaaataaaatgatagtaaaatagactagtcagggtccattggaattgattcagtaaatcttggacagaggtaagctctgtaagtcaggtatagtcacagcttggcagaagaaaagagggaagcaaaaagcaagttggggaaatgtcacatgtaagttgtcaccaggctgtagtaaataggtatgcttagccaaggccacatttcagtggttcacatgggtctggtgtgtatggtgaagccctacctgaaatgcgtctccaaagagcttttgtgttccttgcctcttggattcttgcaatggttcttggacaatggcagagtagctctaatgccgtctctgaggacaaaacccgacccaggcagttcttctgacttggccaaagtgaaaggggaatcattgtcagcaccagggtctcctgactctggtgacgggtggttgagatttgtaaagcgcataggagcaataattagatccactcatcccagagttctcagactggggcacttaacattcttaacttatctttcaacagaaacagcagcagaaagatgccctcattctcttcttcaacagaacagctgaagctaaaatcccatctgtcatgtaagtggtcactaagtgtcgacctctctctctctcatcttcaaaaaaaaaaaaaacaacttattactttattctgcctgaatgattttactgcgtctaagaaatgaccagagattattaaatgtgccttttgttgaggaaggaaaaaataaaacagatgatcagagagtagaattatagctgccttgaaaataaagtttaggggccaggctcaatgcctgtaatcccagcactttgggaggccaaggtgggaggattgcttgagtccaggagtttgagaccagcctggacaacatagtgagaccccatttatacaaaaaatgaacagaattagctgggcatggtggcatgcacctgtggtcccaactactcaggaggctgaggagggaggattgcttgggagggaggacggtcgaggctgcagtgagctaaggtggtgccactgcactccagcctaagcaagagactaaaaccctgtctcaagggaaaaatgaaaaaagtaaaagtttagggcaccctgctgttaattacacacaaggcataagttggccggtaactggagcgactactaggatgtacctgggtctctaagagatcctgtcttgagccaagtaggctggagctgctgctcgttaaaaggagggtggggttgtccccagcaccaaaggggagagtttttctaggaggactgtgatcatttgcctttagggaaaaaaaaattagaaggaaaagctgccttatggggatacttgggtcttccccaaggtcaggaattgtcatccattacttacctaaataaaaagacaaatgtcaaagtttgttcaaaagatatgggcatatggccgttgtcacgcctagttctatttccaccttataaattaaagctaaagtaataatttctattcttacaattattcatgacaaaatctcaattgtatgcctttcttaaagaaaaacccactcctatttaaatatcactggggtagaaacctggcaattctaatgatgtgcagtttgcctgatttttttttttgtttaacattcatgtgatgctctggcaggataatggtccaactgatgaaattacaatgagaatggattccgtagggctgagtggtgccagactggctgtggggactgagatctggggataaattaagaaatatatctgccccatcctcgtacttggcccacctacctctccacaccctccactgtggcaagagagctccccacaccactcgatctgcaatgccccctggaaagactgcccagtgctggcctcctccccttcacctcctgggcactgcccttttcatttatgaccctgctaatgaactccagatgtggtttttatggcctggaaacttttctcccagaaacacatctgagttgcccccgctgacccatttctcatgtgctgtggaataacagatggcaagggtgtgcgtttctcccttgctccctcagctcaggacctgcaaaattcagagtccaccaggtgcctctctcttcagatactgtgcccagagccacccatttcccttagaaattttaagtctttctaccacctcataaataaactttggtcataccttatacatactttctcaaatttctattatacaataaattgtatagtgctttgtagtttccaaacattttttacacctgtgaactcatttcacatttacagcatctttgtgagatcatgtaagtcacactggctccatttttaaaaatgcaaacactgagtaaatctatgactctctggacctcagagtcacacagctagtaagtggaaattagattgtatgtcttcaaaaccccaatttcctcagctagttgtttttcttttctttttttgctgttgtttgttttttcattttaatgggcatcttttaatataaaagccaaggttattgtggtaggcagatatttccagcctaggaacttgtagaaggttatagaacaacaaagctgtgtatgagatatagaggggaaagacgcattaggaaaattggggcctgtggtttttatgagctcaccaagtggattttgtggccttgtgactttttgatgctgtagccgtaaacttttttgcttatatcatggcaaattttatgtctctcaaaataattaaagtaaattctattagtatcaacaattcacaaattgaactcaaatctggtgccctggtcagtcatagtgttgtttgaaatgactcttggatgtttacagggcagtccacgtacctttccctcacctgagacatatccttctttaaggaaggcagagtctgttccctgtccagacgcacccatggctggcaatggcctcagcaaaggagctcacttgcctgtactgggcttacctcttctttgggattgtgatccctcttcagggagctaccaggggagggggcacctagccagggtctgttaacctggtgacttcccaccccactgctccctgagggtagccaccttaaggccaagcgaaagataagaggtgggaagcttgccgggtgcggtggctcacgcctgtaatctcagcactttgggaggccaaggtgggcaaatcacttgaggtcaggagtttgagaccagcctggccaacatggtgaaaccccatccctactaaaaatacaaaaattagctgggcgttgtggtacacacctgtaatcccagctactcaggaggctgaggcaagagaattgcttgaacccaggaggtggaggttgcagtgagctgagatttcagcactgcactccagcctgggcgacagagcgaaactcagtctcaaaaaaaaaaaaaaaaaaaaaagggtgggaagctaagaaaaaacacagtggctggaagagagatgtaaattaagggaggccaaacaaatgagaaccttctctccatagtcctctgccttggaagagaattaactgacttaactactggccctgtcatttgaggtctaaagtgggaggagctggagatccttcttggaatgtctctttagtattatgtatgtctcaatatttagcttctagaaatttgtgtactgtcattaattccttagtcccctccctaaatgctttcagatctacagaggacactctaatttgtatttaaaacacattataatgatagtcggaggtaaagtgaaaactgttgatcatcttctatgatcccagataataagaatgtttcagtaacataccagagacacataaaacataaggagtatatgtttaatctgttttgttgtcattgtcaaatgcagtgaatatatcttggacctactggaaagtggaagagagaagtttttagtatttgcacaccataaggtggtcctggacgcaattacgcaagagcttgagagaaaggtgagctccctttgaaattcaccatgggctacttttgccatgtcccaagttgttctaagcaggcttaggtcagatccaagcaaagtgagaccgatggcttccggaagcattgctgaagactttctgaagaagagttcttgcttgtagaaccacagtggggtcaaaatgtttccccagccatgtcattttaacttcctccatgctccaaatagatatcccaggagtcttgctttaggaacatctcccaggggctgttccattattctgcataaataattacaaagttggcaagagaggagatagcaaaattgtccttttgtatggagacaagtatttatgtgaatgttttcctcttttccttcctttcattcctcctcagcactgtcaaagcacttttattaattccacatggcagtgtgcagacattagtagagagttttatggctctcctgaaattgaacgaaagggatctagaaggatttccaaggatgtttatgaaaactgaacacatttcatccccttttcatttttggttaaatttaaggctgtaaattgctctttgtcttccctcatcgtttatatttatataacatttgaatgtactttaagagtacagagaaatatacagcaaatacccatgtatctcccacccagatttaataaatgaatttatttcaaggtttttttattttgaggcagagtcttgctgtgttgcccatgctggagtgcagtggcaggatctcagctcactgtagcctccgcttctcaggttcaagtgattctcgtgcctcagccttccaagtagctgggactacaccacctcacctggctaatttttgtatttttagtagagacggggtttcaccatgttgcccaggctggtcttgaactcctggcctcaagtgatccacctacctcggcctcccagagtgcttggattacaggcatgagccaccacacccagcctgaaggtttatttttttaataataaaatacttaggtcccctcagtattctaactttattccccttccatctctccagcaataacatcactattacgaaggcaatgggtatccttgccctccatgttgtcatactatattctaggagtacgtatccataagcaatttatcgtctcctttttgcttatttttaaaaatttaaaataaatgacagcacggtgtaattatcctgcaacttacttttttctcagcattgttttagagatttcttttttttttttttttttttttgaaacagtcttgctctgtcccccaggctggagtgcagtagcacgaccttggctcactgcaagctccacctcccgggttcaagctattctcctgtctcagcctcccgagaagctgggactacaggtgcccgccaccatgcctggctaatttttttgtatttttagtagagacagggtttcaccgtgtgttagccaggatggtctcgatctcctgacctcatgatccgcccgcctcggcctcccaatggagatttctttatactgcattacacgtatagttcattcactgtaactgtggaattgtatctcattggatagctatactgcagtttatccattctcctgctgatggttgctatcgtgtgaatattatagtaggtgtatgtttgtatctatgcatttctttatggcttgtgtatgtgctttgtgtaggggaggcatattcaggcatgctcttgcatggttattaaataggttcatcttcatactaaatgttgtcaaattgctctccaaggtggtcattcacatttataatctcactaacaacatataagggttcctgctgttctgtgtgcccattaacactggtattatccaactttttaattttaccaatccagagaaatgaaatatcatctcattcttgctctaatttgcatttccctgactaccagtaaaatgtgtatcattttatttatttatttatttatggccattttagctgtctcctgtgaatattctgtttgtatcctttgcctgtttttctgttggattgtttttttcttactgatttaggaaaattctttataaattctggatattaatgttttatcagttatctttttatcttttaaatttattttgttggggaggggggtctcgctccgttgcccgggctggagtgcagtggcttcatcttagctcactatagcctccgcctcctgggttcaagagattctcatgcctcagcctcctgaatagctgggattactggtgcacaccaccacgcccagctaatttttttgcatttttttagtagagacggggttccaccatgttggccaggttagtctcaaactctaggcctcaagtgatccacctgcttcagcctctcaaaatgctgggattacagatgtgagccaccaggcccagctggtttaattgaattctaataaaaactccaactagatcttttttttttttttgaagcagagtctcactgtatctcccacactggagttcagtggcacgaatgctgctcactgaagcctaaacctcctaggctcaagtgatcctcctgcctgagccttcccagtagctgggacctcaggaatgtaccaccacgccttgcaaatttttaaatttttctgtagagacagggtcttgccatgttgcccaggcttgtctagaactgggctcaagcaattcttttgcctcagcctaccaaagtgctgggattacaggcattagccaccgcacccagcctccagttggattttttaaagggaactttatactgttactcccaagaacatctcaaaaaaaaaaaaaaaaaaaaaaaaaaaagcaggagcgatatctaaacaactatgaaaaagaagagcaatgttggaagacttgtcccttcagacattaaatattaaaatctgttataaaataccaataattaaaattcagccatgctggccccagagagatggccagatggtggaatagaatacatggccctttaccataaatggaaagcaaatacatgatcaaggaattgtcacaaatccgttttcaatttcttcaacaaagtttgggtaattgcctaaataattggggggtgggagggtagatgaaactttaactcactgtttactatattaaattgcaggtgaatcaaagatccttgaaaccataaagtattagaagaaaataccaatgaacaatagctgatcactgggtggagaatgactttctaagcataaaaaccaagaaattacaaaggaaaaattgatttgaattacctaaacacatgtattttttctgtgacacatacacagtgattaaatttttttttttttttttgaggtggagtttttgctctgtcgctcaggctggagtgcaatggtgcaatctcagctgactgcaaccttcgcctcctggcttcaagcatttctgcctcagcctcccaagtagctgggaatacaggtgcctgctaccatgcccagctaatgtttgtatttttattagagacaagctttcactgtgttggccaggctggtctcaaactcttggcctctggtgatccacccaccttggcctcccaaagtgctaagattacaggcgtgagccaccatgcccagcccacagtggctatgattctcttgtacatttgtacatttttggagggcagtttgacagtaaattaaggcgtgcactcaatttttcaaattttacttctaggaatttatcctaaggaaatcatcagactagtcagatttataaatgagaatattagtcatgctgtttataatattcaataattaaaaatctaagtttttatcaacagatatactattaaataaattatagtccattcagccataaaatataatgttgatcagtggttcctaactttggagatcattgaaccctataagaacctgaagaaactccaaaattgaaggtcttggtatctggttagtatatattgctatcggaagatgtccatactatggacaaaaagctgttgtatgtataataatttttaaaaattgtcatgttgtccaggcgcagtggctcacgcctgtaatcccagcactttgggagactgaggcaggcagatcacccgaggttaggaattctagatcagcctggacaacatggcggaaccccatctctactaagaatacaaaaattagctgggcatagtggtgcatgcctgtaatcccagctagtcaggaggctgagacacgagaattgcttgaacctgggaagcagcggctgcagtgagccgagatcctgccactgtactgcagcctgggtgagagacaagactctatctcaaaaataagataaataaaataaaataaataaaatagtcatccatagaaaaaagcctgattaatatataccagtacattaatgatgattatctctaagtagtcatcattatctttttagtttttctgtatttttgcaatgagtgtgtattatttttataataagaaaaattacatttttaaaaataaaggagaatttagaaaacaacagaaaagtaatagaaggaaataagctagggaaactattagccacctctgtgacatacaaataatggtttttacatgtaaaggtatttcctaactcccagtaggaaaaaaaaaaagggggcaacctgtataaatagatagttcatcaaagaaatgacaccagtagccaattaaaagataacgaaaacacccaatttcactagtaatcaagttagtgaaaaataaaatttttttttttaccccatcaagtcagtagaggttttaaaaatgtgcggtgctcactgttgatgaaagtgtacgaagatggacatgctaatacattagttattggaaagcaatttggcaataatatcaggagccttaaattaagttttttctttttgctatcgtactttggtttgtagtccaatctaagaaaatcaccaaaaattggcatcctcttaaaaactttccattttaatagcattcttgaggtataattgacatgcagtaaactgcacataatgtgtacaattaatgagaatcaagataggaaacatatctgccacccgctgcccccacccccagagttttcctttgtaatcacgccctcctgccccttccctcaccctcccatcctcaagcaacctctggtctacggtctgtcactaaggattagtttgcggatttttagaattttatataaatatggaatataatggaatataaatgtggagaaaaggacattcaggatgtactttttttttttgagatttatccatgttgttgtgtgtctcgttcctttttagtgttcactccttggttttccttttttttttttttcttttttggttatctagacctgcagatgttcactcccttttagtgctaaataacatcccattgtacatcatctgttcacttgttgatggacatttaccaacatatccttttaggaaaaatttgagacccctaaatctgcagaaatagaagggttaaattatgctgttgctgcataatgacaaagggccattaaaaatgatattttagaacacttaacaatacagttttacttataatgtgttttattgggggaaaacaggatataaaactttttatttaaaagatatatataccatacacatcaaaaaaagagacaggaaaaagtagattggttagattactaaatgtttttattttccttatcatgtttatcactagcaagaataaataaatgccatttaaaagaaaataactaaactaaacatgcagttaccatacaacacaacaattgacttttgagcatttttctttgggaaatgaaaacttaggttaacagaaaaacttgtacacacatgttcatagcagctttatttgtagtagccccaaactggaatcaactcagatgtccttcaacagatggatggtgaaactatggtatatccatactgtgggctatttctcaacaataaaaagaagaaaattattgatacaggtaacaacttggatgaatctccagagagtgctgaatgcaaaggcccattccaaaaggttatatgctgtgcaatttatataacatttgtatagcattctttttttttttttttttttttttttttttgagacagagtctcgctctgtcacccaggcaggagtgcagtggtgccatcttggctcactgcaacctctgcctcccggattcaagtgattctcctgccttggcctcctgagtagctgggattacaggcgcacaccagcacatctggctaatttttgtatttttagtagaggcggggttccgccatgttggccaggctggtctcaaactcctgacctcaggtgatctacctgccttggcctcccagagtgttgggattacaggcatgagccactgtgcctggcctatagtgcattcttgaaaaaaaaaaaaaaaattggccaggtgcagtggctcacgcctgtaatcccagcactttgggaggccgaggcaggcggatcacctgagatcaggagtttgagaccagcctggccaacatagtggaaccacgcctctactaaaaatacagaaattagccagatgtggtggtgtgcgcctgtaatcccacctagttgggaggctgaggcaggagaatcacttgaaccccagggggcggaggttgccgtgagccaagatcgtgccactgcactccagcctgagtgacaagagtgaaacttcatcttaaaaaagaaaaagaaaaaaaatgtttttagaaattcaggtcagattagtggctatcaggagctaaggaccgtggaaagaggagggaggtaaaaggatccttgcaatgttggagttgttgagtatcttaacattggaggtgaatatatgaaaacctacacaggtgataaaattgtgtagaacacacacatacagtaaaacaagaaatctgaagatcagtggattgtatagaagtcagcatcctggctgtggtattatactatagtttttatagaatgttaccactgcaggaaactgggcaaaggcctaagagggatctctattatttcttacaatggcacctgagtataagcagtcatctcaataccaatgtcaatttgaaaagaaaagctctgaaggcaggggcctctgctgagctggaacctggttctgtgctggagctgtggctgggtgtggtttgctgagaagcccccggggctgttgcccaccttgcttctgccccttgttcctgcagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtaagagacgcagaagactcagatactccccaggcatgctcatggctgtgggcaggaagcagtgagtgtcggtcggggaaagtgtggtttcccttttatccattcattatacttcccacaagtcagttttcacttcctttaagcacttctatgttgattgactagtctctttttttctttttttgagacagagtctcttatcacccaggctggagtgcagtggcatgatcttggctcactgcaacctccgcctcctgggttcaagcgattcccctgcctcagcctcccgagtagctaggattacaggtgtgagccaccacgccaggcgattggctgttttctagattttcacagcaacctgtaggattatcgactccattttatcaacgggaaggttgaagtcttccagggctagaaggaatcttgacttcatgtctcataggaggaagttagggcaccgagagctcaaggggtgaggcaggactgcactgccataactgaagagggcacttggtggcaccaggttgcagcccaggcctcacgttccagcctgtgccccctttagtagccatcattgtgagctgctttaacaatggacctcacacagagtgacagcagtgagggtttcctggacaccaccactggcctcacctgaccaactgaggacagagataagacatttgtttgaactcttaaatttttctggtaatctccagaaaagttatatcccctttaatatttatataatatttaataatattgtggtttttattggctacacataagagactacattaataatgggtagaccttgagggtgtagccattttatacaagaaataatgctcatgatgttaggtggttttttttttcttttgcttttttgagacagggtcttgctctgtcacccaggctggactgcagggacttactggctcactgcagccttgatttcccgagctcaggtgatcctcccacctcagcctcctgagtagcaggggactacaggtgcacgcctccatgcctaatttttgtattttttgtagagatggggtttcaccatgttgctcaagctgttctggaactcctgggctcaagcaatctgcctgcctcagcctcccaaagtgctgggattacaggcgtgagccaccacatccagcccttaagtatttattataaggcttaccactatattaaaccaccaccctatgcccaaatcatggatagcctctcccttgtgtgtgatgtttttatttatttagaagataactttttatttcatacagtgaagaaatggaagtgtgcaggcctccatcaccagcccctccccatgcagcctgatggcagagcctgtgcctcttcatttgcagcacctagctcagtgcccagcactgaacagccacctgcagatcttctgcttcagattccagttccccagccagggctgttttgggttctctcttttgttaaagtggcaggtcatttgtaggtctgagatggtaaagtgcaggttatttctaggtctgagacagtgaagtgctttgaggagggagggttgtggtgggactggaaatggggtggagaggaaccatacctgctatggtggatggaactgcttcaggcctttacctgcctgtctcaattcctggacacacaggtgctgatccaggctgaggaccgcgtgcaccgcattggacagaccagctccgtgggcattcactacctcgtggcaaagggcacagctgatgactacctttggtatggcttggttgggtggcctggcagttggagtcgagcaagggtggaaactgatgatatgtttactttgctcccaaagtgcttctgcttttgctaagtaaggtctttaaggatctatagaaaattgactagtgatgccctcctgctttcatcatgaccatatttggcctccctcactagcgttcactggtggcttgcagggtgcatgctgaatcttatagcaataaggggttgtggctccttttgctgctggtctgaggcagggagaagtgctgattatgacaaaatatagatggaatttagtttgtaaaacaccctgttcccagctgtgaaggcatttgttaggacagggtgacagtcttttaccttttatgatgtgcatttatctggtgggcacatcttacattgctgctgctggaccacagggagaaagtggcttaccctggactgtgtagtgtacttcgttagcagagctggagtaagattttcaaccctagggttttctgtctgttacctaagtgaaaaatctcaaaaagcttcttccccttatctcccccttcctgatacaaaatttcttgattatctcatttgtttccactgcttgtctctgtttccagccttatgactaaggagtcttccctttgcaatgtgtgtgggtcactcctacttccccctttttagtggatttgttaattgggcagctcataataccaccagattcaaaattgtgttgaaatgaggcagcatttatttcctacacatcttccattagaaagaatattgaacctgatgatattcttagccctaaattggagtttttacaaatgagagggggcaaatttttcaagatgggtgtttgcaccttgagagatgcagagatgtgaaaccgtaaacaagccgttgtcccataagaacaaggagggtggcctcattttcattagtctggtggttctgtgcaggttgtattcactgcagctcatttctccccaacaggcccctgattcaagagaagattaaagttctggcagaagccgggctttctgagaccaatttttcagaaatgacagaatccactgattacctctacaaggtaatgccagcacatggctcttcacccctggagcagagggaggcattaagctgtctgccaagtctttgggtcctgagtaggaggatgtgaatcactcctagggacctcccccagcctagagctgaaaacaatggcctgcagtcattctcagttgaaccatgcatgcatcgctttatggggaaatgatggcattagctcctacagctgctgacattcccgcacaggctctgaatgctgcctcttccagcaggccattagaaactgacaaaactccccatggcaaatgttgaattgtttcaaaaagtacacagcaacaccacacatagggctgccacaggaatgcatccccagcacagaatggggagtgtttaaaatagggtactggcttcatagaatatattttcccttctgtcattttatttattctcagtgtctccccacttgatagaggggtaaactgagacatggcagtatagtaggtttgcacaaagtcacagggcatgtgaagccagcccaaggaagaaggcttcctgacttggcccagcattcctcctttgagctcagcccttgttgtaaaggagtataagaggcatccctccatgaccaggcaggccttgtcaaaggtgctgagggggaaggctgttgcctctgaacaggacagccctgggcccatcatgcctgcctggtttcagtgctgcagcccagtggctgccacagactcttcctcccccatttcagtgaaacacagtggagtgagcaagagacccagagccttccaaaagcttgttttccttccccagcttggattgttggccagaaggtgaaaaccaggagtatgccctcctcgagcacagctcatggttgaattgtttctgccaggagagtttgaaccaggtctgagcctcatgcagaaaggggccttacggtagcttatcaggaaagtgaagcacctcctccttcctgtgaaatcaccatcagaatattgagttaggccacacatggtggtgcacacctgtagtcccagctactccagaggaaaaggtgaggatcacttgagcctaggaggtcaaggctgtagttagccatgatggtcactgtactctaaactgggcaacagagcaagagcctgcctcaaaaaaaaaaaaagagaaagaaaaaagtttaaataaataagaagttgagttaaatcttatcgttgacaccaagacttaagactctgtggatctgctcattcacttacatttatttagcaaataaattctttctttgcaaggatttatttgctaaatattgggataaataagactcagatcatatttttaaatgcagactgcaaattatcctttcagacatatatagttaataagccaattttaaaacaaccttatttttaagctttttaaagaactctccagttcagctgaatggtaaatggtaacagagcctaggttattacaagccttttgaaaagaaatagtctgagcaggcatagtggctcaagcctctaatcccacactgaggcggacagatgacttgagcccaggagtttgagaccagcctgggcaacatggtgaaacccccatctctacaaaaaatacaaaaattagccaggcatgatggcacatgcctgtattcccagctactcaggagactgaggcaggaggattccctgaacctgggaggcagaggttgcagtgggccaagatcacaccactgcatttcagcctaggcaacagagacagaccttgtctcaaaaaagaaaaaaaagaaagcctatttttaaaggattctcacttgaactcatttattcctccttgcctttctcttactctaaattggttaagcatttctacctaaaatataagtacaaggtaatataaatgagttttatcaatattttgatcaataactatatcaatttattttttaattaagatggggctgaaaattttatcaactactagaaaaagaaaatgttgcttccaatataggagacaaaagcagaagaggttatatctcactgagatagccttccttctgagaggggaaatgaaatattaatctgatcttggaactcgcttccaattaattatgcatgccccgagtcagcatacagtgttgccatcatcataatcaaatgcacattagcagctttttctacttggaataggctgccttgcagggtggcgtttccttgacattgcagtcattcagaaagaggctgatgagggcatcctggaggaggacatgtgggttatttgggggtcagccttgatgatctttcatatcatttccctctctgcaaggctgggatcctgaaaggctaggagatttcgggtgcaggttaattgaataatctggagttcttacatgacaggctgtcatgatcaattttcaaggaactctacttcaccaatgtggagggatttggttaaggaatagtgaggaacagtggccaggtacgttgagacctaattctataaaggcctgaaaagccaggggagcaactgtagacttgatgaggtagggacagcggagcccaaagacatgaccaaaaaaatctttaaaggagagcctgggggtaaaaatcagctggcaaagatctgtaggctgtttgaaatgggaagaagcctgaggcaggaagcgcagttgagctgttgcaaatccatgcagtaccaagtgatgtggcccaagtaaagatggtgcctgaaggagagaggagggaactaatggggggaacaaacttgcataagccgaggactctgtttgcctggatgatttccacctgggagactacgagaatgcaggtagactataaaaactagacttatgggaagagaagctgctttgagaatataggagatgagagatcatttgattttttatatttatttatttatttatttatttagagacagggtctcactctgtcacccaggctggagtacagtggcactatgctggctcactgcaacctccgcctcccaggctcaagtgattccccccatctcagcctcccgagtagctggaactacaggcgcatgctgccaacacccggccaattttctgtatttttgatagagatggggttttgccatgttgcccaggctggtctctaattcctgagcttagatgatccccccgcctcggcctcccaaagtgctgggattacaggcgtgagcccttgcagcagccttatttttatgtatttattttttttttgagacagagtctcactctgtcacccaggctggagtgcagtggcgtgatgatggctcactgcaacctctgccttgtgggttcaagcgattcttgtgcctcagcctcccaaatagctgggactacaggcacgcaccaccatgtctggctaattttttgtatttttagtagagatggggtttcaccacgttggccaggctggtctcgaactcctgacctcaggcgatccatccgcctcggcctcctaaagtgctgggattacaggtgagagccactgagcccagccaaaagatcatttgattttaaaccagtttagttttatgaaactgtgggatgtcagtggagatatggaaaatatacctctaaattgaaaaatggtcaaagttggaaatttagatgtaggaaaaatcggcagaggggtgatagtgatcgtgtgttgtggttgtatccactgggcatggttttaacactacaccattgtcatcaatgtatagatgcagttggtgggtattttgattatttgtaatttaaggtaatcagaataggtacacatatctacttatgaatatgttaaatgtgtgtatgttttttcaactactttgaaaattaggtataagccatggctgaacacagagatttggaagttggggggctgggcacatggtggctcacacctgtaatcccaacattttgggtagctgaggtgggcagatcatttgagctcaggagttcgagaccagcctgggcaacatttagtgagatcccatctcttaaaaaattataaaaataaaaataaatttaaaaatagagatttagaagttgaattataccttaactgacccttagtagagaaaggctttggaggaagtgagatcttgggtgctatttcagtattgaaataatgatttggaaagttcaaagggagaaaacatttccaatgtaaattatagcgtgagagcagcttctttgttgcactcacaaccatttctttttcctaactcaatgagcacagagagggtaagatgtcagacactaaaacagtgaggctgctttagtgatggtttgctgagatgatgcacacttgccatcgtgtagctccctgacaccatgaaatgtgtggtctctcatctttatattctctcatcagccctagtggaggagagtcagtgttggagcctgggctcttccttttatcttttgttttctttctctgatgaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaa

SEQ ID NO: 2770 - DNA, 70638 bp, Homo sapiens
  source 1..70638: mol_type = genomic DNA
atcattcttacttttggaagcgaaactgcggccgcgttgcctgctgggaaatgtagttcagcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggtgagaaagtggtagactggcaggaaggcggcggaggcggacgagaccaatgccagcctggaggaggaagtgggccaatgggaagggtgaatccaagtggagatcgtaggggtgggagtggggcgtggcgcccgcttaccttgaggctgggtgaggctcgccccgaaatgcggggcgtggggggcggggggcagaggtccctgcctagaggggaagaggggcgtccatgtggcggaatggatttatggtttggggctgatcagtgggtcttatggccgagtctctctggttagtggagacagcttaccaggcctgggatctggggagtttggaggtgcaggagatccctggttggaaacttaggcaggagtgtgttacccagagagactgagggcttctgctgtgcacctccaaaaccttttcctaacctcttcaccccttcctaactgctaatggttggagaaggtggaagttctctggggatagatacttcgtggtgggggaggggggaggggggttgggttctggccaaagggagccccagcagggaaggaaggctttgaaccctatagctgcccagaggcctaagcaatgctactggagtacccctacatcatcattgtaaccgttacacagcattacattagatgcagcctatttagtctgaaccaagccagacaaattggtgtgtcctgcccgctgcttctaaaatattgtaaacatgtctcagctcataggaaaataaatgttccgggtaaattcatggaaaaaaataatcagggtgcaatatggaatgtttacaatgatcctactttataataaattcttatatctcctaaatatgtgccattttgttatggatgaaaaaaaatccgaactatatactctaaattattaatttcaactgtggttattgatggctggtaagattacagagtaattttattcttttttgtttacatctttatgtagcatcttaatttgcacagtgaacacataatttttttttttctgctccttattttcccaggagagtcagtcagttgctccgtgtgttgtgttggaagtcaggtcctaaggccagctgctctggcttgcactgagccacaggcagactgatttgccaggaatgataaaaaggggtgaatgtgaggggagaattcagtgtgcaggctatgggaggctaatgcttttttccttcttctaggttggaaaaagactatgttagcaagtgtcacgccatggtatgtggttggttggtctatttcagtctaatctattatgctttctggttaaaaatgtcacctttctcattatctgatggatttacgttgcaatgcataactttcttaggttctgataactcaccttggctgggccatgtgagttatcagaagagttactcaccattttggcagtgcttcgaaccattgagttaccatgtgagttaccatgtgagaaggagagaaatattgcctctgaaatgcctttttagctttggatttgctttttgcttttttttttttctttgagagttttgttcttgttgcccaggctggagtgcggtggcacgatcttggcttactgcaacctctgcctcccaggttcaagcaattctcctgcctcagcctcccaagtagctgggattacaggcgtgcaccaccacgcctggctaattttgtatttttagtagagatggggtttcaccatgttggccaggctggtctcaaactcctgacctcaagtgatccacctgcctcagcttcccaaagtgctgggattacacccgacctgctttttgctttttgatcagggtctttatttcagcatatgctgcctactatttcagtgtgtgtgcaattataaaagaaactttaatacatcctttagttgtgctcattatgcattttctgggacaaaagcttgttaaaatcatggttggagtatgacaattaatacatgtaatgttcatttcattcttcttactttcttccacagcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatggtaatgtcttcatttttcagctgtttttttttttttttcttatttttggagtctcttttaatctaacagtttctcataaatattaagagagtgcattggcacatgctgtccatccagttgttaaaaatttttcaattttagcttgtttcccttcataatagtcattcccttaaacagctgccaaacttgatggttgtcacgtggccatctggagaacagttgaatgttactgagaagacgcttcctctgccaggtgctttatatgcattgtagcacttaagctgaacagcagtttttttgaaataagtagatgttattttagtttttaaggtgatggaactggcccagcaagattaagtgacaggcccagtttcattggtctggaaaggcagcgtcaggatgtgactagctcaattacaggccagagccattactcctcatactgctttgcctgaccacactacgacctggagaacttggattctagtcctaactctgccctcagtcctcttaggtgaagttcataacttcccagggcctgagttggattccactacatggaataaaagaattatctatatttactatttgtcctctacagagatttttatagatcagtgggggcttgctggtcagctgttttgaacttggcgtccttcattcattcatttagaagacaagcttgtgttgagtgcctaagtacaaattgtcaacagtcatcagtcctctgttttgtttcagatcctgacaccaagacgtggaacttcagcatgaatgactatagtgccctgagtaagtagacacatggttgtctcatggagggtggcactggtgctgaaaatctttagagtatcacatgtagtccagcttatggagtgcatggctttacaggtggtgaaagctttcagggcaccccccccaacactccttcccactctgtctagcctaatgaggcagctctgtgggtgaaggccgttagtagtattaacaaaagctagcattaaatgatgcttgctttgcattaggctattctaagccccttatgctaacttttattccttataatgacttttttacagatggggaaactgaggcccagggacgatgagtcagtaacacagggtcacatagccaataagttgtacaactgggattcaaaccctgacagtctgacttcagactacacgttcccaccagactatgctggccccagcagtgacaggcagctcaggcagcctgccagcccctgctcccaggaaggtaacagttcagcaaacagcacagatcctcagagtactctctgtgcagctaactactcaaaaatgcaaggagggggcattggccaggcaagttccagctaatgcagtgtctggtcatagtcagcacctggttacgtccctctgtcttctgagaaaactgtcatacactaaagtttttgtcacttgatcctggtacatggagcttgcacacctgtgtcaaagcgtcagccctgtgtgttttcatcttccatttattttactcttctcccccagctgccatttctacaccgtctcttcctccccctagcttaagaaaggaaaagataaggatgtatgcttaggtcactttgcagatttggggtatgaggtaggattatctggaggcaccagtacagtttctgggaaaggtggtttgggccagtgatgggacagctccctgcagaatttcctggttttctccttggcctccaattcttgaaatgtgtacattaggcgatatctttctttggtagctgctagtgttgttagtttgcgagggctgccgtgacaaagtaccactgactgggtggcttaaacaatacaaatttattttttacagtcctggaggctggaagcctgagattggtagggttggtttcttcagaggcctctctccatgccctgcaggtggctgtcttctctctgtgtccttgtttggattttcctttgtgtgtgcaaatccctagggtctctcccttttcttagaagaacaccagtcattggattatcgcccaccttggtgacctcatttaacttattaacctctttaaaggccctatctccatatacaatcacattctgaggtcctgggctgtgtgtttaacatgaattttggagggacacaattcaacccataacgctgctgctgctagctccgtctagtgagggctcattttttaatcgatttatttggtgttggaacggggagacccaaggctctggataaagattgcagattttgacacctggtattctcattgctggtgatcttaaaccagtggtttcccctgttgcggttgttttgtctttttactcttgttctgaccacggtgcatggtgacttagatgacttctgcttttgcagattcatttaggttttttgtgtgatatcgttactttttttttgagacagagtctcactctgtcgcccaggctggagtgcagtggtgcgatcttggctccctgcaacctctggcttccgggttcaagtgattctcctgcctcagcctcctgagtagctgggatttcaggcgtgtaccatgcctggctaatttttatatttttagtagagatggggcttcctccatgttggccaggctggtcttgaacccctgacctcaggtgatctacctgcctcagcctctaaaactgttgggattatagatgtgagacactgtgcccgactatcattgctttgtgtaatgctccacatgttttgaaaaccatgtttattggatacaaaattctccatatatacttctcaatgaagctcatagaagagaaaaaaaattctccatatagctttcagatgaatttttctaattgtttggctcctctgcatctttaccaatgtgttacacacttgagcttttgcctgctgagataaaccttgaaattccttgccataattatggatttgtgaatttctccttgtatttctaagtttcagataggttcatgattgtgtctcatgattggctttttattggtataacatataaaattgtctctgtgtcagtctttctgtcattttgctttaggtatatctctggatttggcttcattaaccctaccacatactcactgtagaacatattttgacgtgtgaagaagaaaaaccatcccccgtaatctccccactcaactaaccattattaacattttggtttcattccctccagccttttttctatgcgttaaaatataaagttttatatatgcatataatttgtattttgcccttttaatttaatactccagcataaagcatatttactttactgaatgttaacagttaattctaagtgatgaaaatgtgtccattatcataatgggccattttgaccttcaagaaatggtttcgtgttgttgaactacttttgtcttttccagaatttttaatacaaaataaattttgatagctgtataacattctgtcttatgaatgtgtcatacattgcttaaattgttgttgtttattttttcctgcttgattttaattggctgccagtttttccagttttaaagctgtagaggaacaccttcgtacctaagtttttgtctgtattttcaactggtagttgggatagattcccagaagttgaatcattattcttagagctcttgctataattgccaaattgttttccagcaggttttattcccaactagcaatatggatatctaattgtttctcatcctgcaagtttgagaagtaaaaaagtatcttatttttctgattatttgtgaaggtgaacatttcttcaaatgtttcttagtctttttcctcctgttttgaattggctacactaccctcttcttttgtggtcttagtacttttttaaagcatgggttctttttatatttctttactcagggtttttttcctttcactccagtgtgtgtctgttgacagcttagtgttacacagctgaatttgttcattataaaatgcatctgtagtagatgaaataatgttcagaactgtgtgtttgtgacctggtgatcctggtcctcactcctttgttctctgagcagtagacagagtagcgacctaggagtgggcttaactgggtgatttgtggtgtgctgacttcagtggcttctccgacaccgtgccagaaattatctaataagtttattcatcctggcgagcttcctcttccccttgttaatttctgaattttaaatgttttgatgtgaaaaatgtagggaggccaggtatggtgcctgatgcctgtaataccagcacttcgggaggctaaggtgcgtagatggtttgagcttagggatttgataccagcctgggcaacatagcgaaaccctgactctacaaaaaatacgaaaactaaccgcatgtggtggtgcacgcctgtagtcccagctactggggagtctgaggtggaggataacttgagccagggaggttgaggctgcagtgagccatgatcacggcactgcactccagcctaggtgacagagcaagaccccgtctcaaaaaaaaaaaaaaaaaaagaaaaaaaaaaaagaaaaacttacggagatggaaagttacattcagcaaatattgaaattcccaaagccccaactaaaaaacactttcaagtcttcctaatctaacagtgccttttcttgccttcctgccaaacctagtgcctcttgaccatgtcccttccccactttctccctcttcccttgcctgtatttcaaagccacatcatagtcccctgctttatcacttctgttcgattcttcttctttggcagtgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatggcaagtaattggtctttgtctgattcccagaatgtgtagtggtctgtgatctcaacatagggtgtttttctctacctcgaatattcaaaaattactttcttgggaaagacttcctgttctgctcctcttcctatagaaagatgacacgttaattgttccagatagtaaacatacagtggtggctgttttgtcataaggcctcccaaagagaagacctcataatatccccctggtcaatatcttcttggtagaagcaggtaaattcctgcttcagccatttaaaacccatctgtttttattttggcctttgcagagcagaaaaacaggtggttgccataaaaataaatgcttttccatatgcaaacttagtagttttcaaacttgagcctgcagggaactgcctgcaggggttgttaaaacgcagctagctgggccccactactggagtttctgattctggaacttgagcatggagccaaacttttgcgtttctcacaagttccctgagctggtgctgctgctggtgatggtgccacagtttgaaaatgctggtggttctgctctcggcctgcccatcagcatcacagggccacttcaaaagcaccgatgcctggttcttacccagagatgtttattttgtcggaggtggggcttggacattgtcggggtgttttttgtttgttttggtttttttaatcttccgataagcctaattataagccagtcttgaaatctactggccacaacagaatagttttgctgtattttattttatttatttttgagatgaagtttcactctgttgcccaggctggagtgcagtggcgcaatcttggctcaccgcaacctctgcctcccgggttcaagtgattttcctgcctcagcctcccgagtagcagggactacaggcacctgccaccacactgggctaatttttgtatttttagtagaagtaaggtttcatcatgttggccaggcttgtctcgaacttcttcgcccaccttggcctcccaaaatgctgggattaattacaggcatgagccaccgtgcctggccgttttgctttagtttttcatgaggttcttcataagctcccccttcagaataggggagaagcagctatagattctggactcctgggtgtcattctcagcttgggccacattgttttttaaaaacgatgtagtttttatggatcagtgtttccccattcttgaattggtttaatcttgttcttaatcaagtagaactcaaatacttaaaacctcatgcctttgagacctcacattcaagcattgtcctggaagaagcctctagaattgcttgcttaacaagagctttcatcagggtttgggttccggaggaggctgatgctggttgctacgtcatcatccttagatggatgcagtttggactgatgagggcagacgggtgagcagggcacaggggagttgtgcgaggcccaggcaggtcgtgagatgagctgctccacgacagtctagatcctttgcctttcctgccccctcaggtgtttggcttcagcttggggtggcccttaaaaggcaactacgggccgggtgttgtggcctgtaatcccagcagtttgggaggccaaggtgggtggatcacctgaggtcacaggagttcgagaccagcctggccaacatggtgaaaccctgtctactaaaaatacaaaaactagccaggcgtggtggtgccatcctgtaatcccaactactcaggaggctgaggcaggagaatcccttgagcctgggatgcagaggttgcagtgagcctagatcgcaccactgcactccagcctgggtgacaatctcaaaaataaaaaaggcaaatacagtgatatgtgtctatcaccagcctgtgagatcacactcctgacatggtctgcattctgggagtgggtaccatgaaggtatggatactgatcctgctcacacccaggtgtccaaaaaccgtgattggttcctttgccttagctgttgttcacatcttttcctgtttgctgctgtgccactgtgagaatcaagttgtcagaaagggccttccccttctagttctgcatttacgattagtctgtctgctttgttccttccatcaggttgtacctggacgacctcgctttttcctgaaactgactctgtgtccatgatgcctttttctgaccaccttgcttttgaaggaatcatacagtgaagaatgaacttttgctgcccagatagcatttactgagaccaagctttcttgatttttcaaaagatagattagtagagaaattcctctatttaaagaatcagccaccattgggtagaaagatgctcacctttcttagttgatattgtgtgtaatttatactacacgatgctgattagcagatgatgtaataatcccactaacaataattcataataactggctttggggtgctcattgttttccagtcatacttttataagcattttcctttaatttcatgtaaacagtaacctgtgaggtaggggttgtaatatctttatttttcagatgtggaaactgagggagaggtgttacagtgacttgcccaaggtgacatagctagcaagaggcagagccaaaattgaaactttggcagtttgaccactgaccacatgcaacttgtttcccatgtgtaaaatggagttaacaacagcccaccttacagacttgggaggggcagatgagagggtgccactgagtgttggcacagtgccgggctgaatgcgaatgctgcataggtgtgagctacagttaccatccctgtcactcagggcatttctgacctgctagaccctccccagccatgtatcctgtggcaccttttatcacaacccttacaacccagtgttgtcagcatctctgcctctttttcctcccagtatactggggaagcctccagggaaagtactctcctaatttctgtatccgcagtgctaggtacaggaccagctgccacattgtctaagctgaatggaagtttatgaaaccaaggaataaatgagtaagtgtgatcacgtagcagaagggcagggtgtcctatttgcttatttatttcttgtcattgcagatgtcaagaccaggaagtggagctttctcttggaagagcacagtaaactaagtgagaagccttccttacttgttttatatcatgctattgttaagctttaataattcaccttaaatttgatgtatttttgaagaatcttctcctccctttgctgtggtgggatgcttgagtacagggtaagtaaaggtgaggatgcagccttgtccacatccactgagatggtggctttatgacagcccagacaaatgccgggcctcttctatcataagggtgaggtggcagtagtgaaatttcccaggcctgtgaaatcttcctgctgtcatagaagtgctagaagcatgggtacatagactttaggaatcagaagtgagctaggattgcttagcttaggtggaagtgaccatagattacttctaagaataggctctcagtgtacttctagaactggatgggatgatcaagaaagataggagagtatcactgggaatggacttcataatagagttctgtttggggcagaagtcaaggccagggacttaggcattttaacaagcactttacagactgaccaaggaaaagggatatgtgtacagatagcataagtgcaagaagaggaagccattttgggtttatcatttttcttctctgtgttttgcttagatggggcaataaattctaatatgcctggaaaaaggaaatatggtcatatctcagactgtaccagaataccagtcccttatctatctggctgtaacaattctgcattgggtttgcagctagcatggcttatgttcctctgcttttctcctaatcctgatggcctgttgggcctcccaaaccaaggaaggagtcatttgtgggtaccaatcaggccaggacagacacgagccaaccctgggagctctgagtcattggccatcttccctggcaggctagggcttcaatgtgagggaaaaactgggttccttccttttgtctccttcttatgtgacttactatgtgacattgggtaaataattaaacattctgggtcccattgtccctttagtaaaaaaagcggtggtctttaatctctatctgctctcctgacataggaattaaatataaaggaagagcctttggttccttgagcaaaacttgctgtgaactacatgattacgtttgaatatgagatggtaacttaataaatgctggctgaagcagaaagaatggctcacggtgatcttgagactctctggctgctactatttggaacttgtgatttagagggaattatttggcaaaatctgaatttttttttctttttgaggcagggtctcgctgtcacccaggctggagtgcagtggcatgatctcagctcactgcaacctctgcctcccaggctcaagcgattgtcctgtttcagcctcccaagtagctgtacacagaatccttttggtgccactttgccagctgggcttgccactgggcttgctttgcccactcgacctggcaggctgcgctcggctcacgctaccagtccagattccacacccactgagggcgagctaggcatggagcagcagagggtttgtgagcaagtgagtgtagagtctggccacagcacatagccaggtgcgccagctgctgcagcagagcgggcagctccagactgtggcacaggcaccagctctgtatgaggctgcagctggactaggcataccacaagcagcttctgccttgggcaccagcggctggatgatgggaatgtgctggtgcctgaaaacttgaagacaccagcaaccatggagccctaagggggtgttacagcatgttacagctctggccgagggagtcccaaggtctgggctcccagaaaggttgccactcttcactcctgtggttcggcagacaggagcatgtcactgcctgcagcttggcgagcagaccaagaatgtgttatagcccttttctcacctgccattcagcgggtcccagattcttgtcctgcgtccaagaagaatgaggttacatgaacaactggagagtgagcaaggcagagaagggttttattgagcaacagaacagctcttagtggagaggggacccaaagtgggtagtcccaacatgtggctgagtccagggtttttatgggctcagaatgggggtgtgtgtgctgattggtccataggcaggcctggaaaaagcaccattcgattggctaaaaggcattgaggaagttcttattctgggttgtggactccacctggaactgacagcctggttttcaggtttcagtctgtctttggcttaaaggttgggtttcactgtggacccacccctgtctgcctaggaagttgtctgcctcctgctgttatcagctggaattataggcgcatatccccatggccggctaatttttgtatttttagtagagatggggttttgccatgttggccaggctggtcttgaactcctggcctcaagtgatcctcccaccttggcctcccaaagtgctgggattacaggcgtgagccaccgtgcccagccacaaaagctgaattttttaagaaaaatagaagtgagttctttccttctcgcttttgtctttcaaccaggaaacacacacatgttagctataaagtctttgacttttatggaatgacaaaaagcaggacatttacagcattagtagataaatgtagtgttgaaaaaccatgacttgtgactcacatagcattgtagagtggttcctgatcttttgcagacaacagactccttgaaatatctgatgaaaagaatggattcttcacccagaaaaaaatgcacataatggccacaaataagattttgcacttgataaagatgattccatagatcctgagtgaagattctagatttagagtttttacctgctatctcatcatgacagtgtctcacggaagataagactgagaaaaggttgggcccagagaagggaaacagtggctttccttactgggagcattgcaaggttacagtaaagtcagtgacagaaataagagtaaaattgccatctgcctttgtaaaatgacccattatggaatttagaagccagctaaactaagaagctgggagtggaagcagtgagaatagagcccagttccaatttagttctgatttctccgccagtactgtgaacctggggaatgcgcacctccttcctcaccccatgctgtccttcctcatgagtgaaattagatcgatgaccctgagttagtgaacgtgtgcataggaaactgatgaagaaatgacaataagacctgagtacgtgaatgctcattggtgaagcagtgggagttattttctttagtaaggagaatctaagctttcctcctctctcttttctaagtgactcaggccttttgcccccagtgaaattggcataagtccttttgttttccccttgctgtcagtccagaagggttctcaacaatcttgtcttgttagctgctatttgaaaacattagcatctctgctatgtggctagtagcattctggcaaagagctattttacagaaatgacttctagatgactcacgaagccgacaacacgtctgtcatctcctagtaccagggaaaggacagtagagacagtcgttgtcagggaatggtgtctttctcaggaacactgagatggctgaactagcagcataggattttggagacagtagttggtaggagacagagtagatgttggttttattcctcttaaatggccgaaggaacataacgcttacaaagccctgccttttctaccagccagttcatcagccctttcttagctttcatcaggtatttgagttctgaagatcactagaattaaaatgaaaatggtttctgaaagcacaaggagtgctcagcctcctgaagtgtgtagaaatcaacatactcagatttaatttggaggtataaaatgtatttctgcatcaatatggacagtctgttttgtattaatgccatcaaccttccctaatttcttctcatggtgattatttttgtggaaactatttccagaaataactggtacttatatttagtggaggagagaaatggacttaaatatattgaaaatacaaagcaattggaggtagcagtagatggctcagccctgcacgttcacatcagtatttacagtggtaaccaattgatggttgtggcaaaagacttttggaatcacttgtgagggtattcagaaaacatatgatcacacatgttttatgtacgtgtatgaaatagagaaccagccttaggatttcaaataatattggatagaagtaaaataatacccagtttctctttgtagtttcctttactggataccggaggacgattagccttttggtgggttactctgactcccagagtgcccttgaaaaggtaaaggataaagagcaattgatgatctgtaaataatggctactcttctaattagatttttcaaaggaaaattataaaagggaagaacatcctgaaagtgatagcctgcaggacagcaggctatggttagtgatttaactgtagttccactgccagaggtctctaggtctgtcattttttctctgcatttttaatttgtaattcagcctccttctcccaagaattatgtgttttatttatctctccggtttattctttttctgtttctctattgaataaaggggttttttcccctcttttttgaagtttaaaatcaggtgagactacattctttcaaaaagcaaggtcagtgcaattcatttgctttcatttccatgtagatcccaagtaatttatttttcccatttgggttaatggtcctgactagaagagatttctccacccattatatagggacctaggaccagcatcactggaaggaaatatatatatcccaaagctcctctttctccaaatcttttgggcatgaacactccagctcatatgcttctgttcttcttttcagttgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaagtaggttcttgatcttcctctctcttcctctgttgctcaaatttcattactcaccacagactgcattcagatgcttcctgttttatgaacttttatttaccatggatagatgaaaatttagaagagtctaggcattaaacagccaggtgtgctgttaccaaagctttattgtaaccattgatttcaaattccatgggttaatcaagactctgaattgcagctatgcagaaacccaattcaaattagcttaaggaaagagatttctcagtgcctgtaagagaaaatccagcatctctaaagatctcatcaggctgctctcctctctcagatctgctttctgtttgtttgctctgttcccaagcaggtgttactcaagtgtggcagctcgggccgccaggggcttccagcttgcattctcagcttagcaacacacagaagcaccatttttctaatggggctaacactgcaatggcttaagtctggtaccaatgttggagccagtctttgtggccttggaggcttgaggtcttgttgattagacttggtgataggcctgtccctagaaccagagggtaaggcctgcccacctaaattactgggattgaaagtgggaggtggcagttctccaaaagaaagtcaaggtgctcttattagaggaagaaaaaagataaacctacatcctgatctttcctttttttccagagtttcttgggagaagcaaaatgccgtatttgaactagccttctcttaaaaatatgggagttcaaggagaagaaagaggaagtcttgatagtctgtctagaaataagaagctgttattagacagtgtagttgaacatagagccctgtgcaagggaaggaacctaaattaacaatggcactgacaaaccacaacagcctgcctgctcgaagcctgattgtggtattttggtgaaagcttggctaccgtctctggcaggatttgggtctcggtgtgccgtttgggcacagtgcactttattatgttacctggccccagcccttccccctaattcttttcttcatttccttccatctctcttacatagcacactctgcaaaacctcctctggcattgccattccaatgctccagctggtgagatgtcctttgggccttgttttaaccaggctcagggtggttttttcctttcatctttctttctctgggcctctttattaaagctgcagtagaggttgcccagccccaccccctgggcagcccctgccttcagcatccaagttcttcgtggcactgttagccatccttgggcccacgtgttgggtgctggttttaccagttaccccattacccctgagagaggctctgtgtgtgaggcgccccagggcagatctgtttctctctctgtggctctaaagtacttgtaatctttcttcagaattttctaaataaactcagattttaactttcatagtctgaagaggtgggggtttggcattgggggaggagggctgtcaattctatgttttgttttgttttctttaatgcaagaactacaattgaacacacccattaatttataaagcaaaatctcttagaaatatcagcatcttctaatatccaagtcaccctcttcagcaggtgaatgaattgaggcttagaaaggcagtcagttgcctaaagttattcagcagtcagaagtggagttggggcttaaatctgtgttttctgattgattaatttctgagtatgacatttttttctattgtattcaactgccctgtggaggatgacatttacttatgttattgttcctctgttatccaggctttttctgtctttgttgtcattttttggccactttgttccttagttgggctccctctaggcaggggaaaaaggagagaatgtgaaattcagggggtccattctgctctaaggatgcggatagaccaaacttctggaaattatagatggtaaagctgagaaggctgaaacaaaagacgctcaaagggcgtggggctctccatggattccgttgcttaggtactgcctgtcctcgctggccaccaattttgtaaatcagaaagtgaggtaaaaaatacatcttttcacacctgccctccccccatctgtctgtgttgtgggttgatcccagaaatggtccagaagatttcatagaggtgggtgtacagggaggaggctgcgcctgttctggagaggtgaggcagcccactgctcggctccgttcctccccagtggagggtgaggccgccaaagctgggctttgggaagggctgccccctctcctaggcaggcccccgcccaggctgcagggagaacagaagggtgccacgccatgatgcctgttgtccccacactctactggcttcgggctgcctggggatttgctgcccagttttccatctttggaaacggtgtttccaggcaattcagaaagggcaagtgcagcctagacttcttgtccgccctgctagctgctgattagaagaggtgacattctctgttttcactgtgtgagaaggaaagagaaagaactatcccagcggcttattatcaggattctgagcaaatgatctatttttcagagattagatgaaagaagactagtatttggcacagaggaccagacatctggcacttgggatccttttagcttttcactgtttcatcatgcgacacgagcaagtcatttttactgtttgtgttttgattctttttctttttgtggaatagtagttatgatagaagcacttccttagcacttatgatgttgccaaccactgttttcagtattagctttattaaccctcccacagctccatgagataggtactgttattactcccttcttactgctgagggggctgaggcatagggaggttaaatcatgtgcatgaaggtgtacagctgctgagtgatggaattgggactccaaccccagccaatctggctctgaaatagtggaatacacctttattcatgaactattagcaagggatgctgcacttaagggctttagggtcctggaggctgccatagtgaaaaactcagtgctgaggttggtgcttcctgttggacaagcacccttcctcccatccttttctcgcctctgtcctcattagcagcatcttctgtctttgccagcccctttctctgcctttatgcatactgagtactctctgatcttcagaaagccttcttttcaccctaccagctcttctttccttccttcctttctttttttcttttttttcagatggagtttcgcttttgttgcccaggctggagtgcaatggtgtgatctcggttcattgcaacctctgcctcccgggttcaagcgattctcctgcctcagcctcccaagtagctgggactacgggcatgtgcctgtagagatggggtttcaccatgttggtcaggctggtgtcaaactcctgacctcaggtgatccgccccactcagcctctcaaagtgctgggattacaggcatgagccaccgcgcccgaccctttccttcctttcaaggcagactctggagtgagtaagcatgccctcctcagtgctagtcctggactcccaccaccctcctccatgtacgtcccctgtgccctgcctacagtgggccgaggcaactcctctcactggaaacttccttctttggcctccacgacctaatcatcttccagatcttctcccttttgaccacattccacatttttcctttttgggctttctctctctctctctctcttttttattctgctccctatttggcctatgtacctttccttctggggagcaagtctggtggtgggctgggcccgggctggccagtgaagtggccttcacccagcagtgctgacccaccggacatgagggcagatgaactcatgccccgggaaatgtgccatcctcaccttgtctgccttcagttttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggttaatggtcttcaaattgcagttttcacagagaaggttttcttcagtgttagagtcataaaataatggtttgcagacagggcctagggatctttaaggatcctgtctcaagtaaaggcaaaggcaggaagagagatgagatgccacctgagggcaggctgggggttttctggattagaatcaggttacaccttgagggaagaaagccaaggagaaaccggcttagagacttgtgttcatctgtcagcaggcacttctgggacctctgtgccctgctaataatacttttcatctgtaccacacttaatttttttttatttttcttttttattgttttttaaaatttttatttattttgaaactggattatgagactggctagtttttgtactttttgtaaagatgaggttttgccatgttgcccaggctggtcccaaactcctgggttcaagtgatccacctgtcttggcctcccaaagtgctgggattacaggagccactgtgcccggcccacacttaatttttaaaatatttttacctcctgtattttcctcaatcccatgacagtcctgtgcagtaggtacaatagatagtaaccccatttatagatgagaaaatggaatctcagaggttaagctccatgcttcctcttaatgaggagccctggcggatcttgatgtggcatcttctgacttcccaactcaggggttttgcactctgtagaggggggagtgagtgggatgttcactgtctgccaggtagctttatggatccagagcctgacaagaaaactgtatcactcacccttgagctttttttgctgtaaatccaggaatcagagtgcttttgtgaaatgaataaaaagcccatgaacaaactcagtgaagaaggaagacctggtccatcgtccacagctttttctagctttatgccactgacgtcagcctgggacttcttcctgaggcctccatgagccattcatgcagaagaggcagctcctcctactgccggtcagtccaaggcccagatgtgctattctgaccgaagagatggcaaaaaaaaaaaacactaaaaaatgtgcaccttgttttttttctgtcctggtgatctgagttctttttttttttaattttaattttttattttattttttaatgagacagggtctcattatgttgcccaggctggtcttgaactcctgaggtcaagtgatccttctgccttggcctcccaagtcttgtgaattctgccagtgcctgtagaaagtaatcttcagaacatattttgtgtgcgttaggttcccacagcaccctcagaaattctaggaagagtcagccagacggtgaccagcctgaggttagagaaaaggccagccctccctgtattgaacagtgtcaccccatgtgaggcaggtgagcacccagatgcctgggtgggtttggctagagatgctcagattgccagagagagaaggtagatttgtagaaatatcgacataagtagtctcgtcatcatcaataaatgtttatgatttgccttcagtgtaccaggctctgctacatcgttcataaaattcctcttaaaaagagtcgcattctttccctgcagaaacttaccatctagttagagatcacagaaatgaaacccagacactgtgaagtgactgttgacaaaggcagggagatagcgaggcatggtggttcaggcctgtagtctcagcaacttgggaagctgtggcaggaggattgcttgaggccagtacttcaagaccagtctgaacaacatactgagacccatctctttgaaaaaaaaaaagaaagaaagaaattagccaagtatggtggtgtgcacctgtagtcccagcaacttgggaggctgaggcgggaggatcacttgagcctaggagtttgaggctgcagtaagctgtgatggtgccactgtactccagcctgggcaacaaagtgagaccaacacaactctctattttttttttttttttttttctgagacccgaggtttctctcttgttgcccaggccggagtgcaatggcgcgatctcgtctcaccacaacctccacttcccgggttcaagcgattctcctgcctcagccttccgagtagctgggattacaggcatgcaccaccatgcccagctaattttgtatttttagtagagatgggatttctccgtgttggtcagcctggtctcaaactcccgatctcaggtgatccgccctcctcagcctcccaaagtgctgggattacaggtgtgagcgaccgcacccgtctcccccaactcttaaaaaaacaaaaaagggagtgtcctgttagtggcaagtgaaggggcacaggtaggtgagaggaaggtagaggtgatggctgttgatgggcatgagactgctgctgtcacaaccaacagctgctgtgctgggtggtcattgtagctttgttccctcctgtcatccacaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgtaagaaacttggcaaagtctttaagtactttatctctctggaaactttctttgtaaaagctctgagaactttcatgtctgtaatctccttgagccccatttagtttctagaagaatagaaatcactgtctttattttgtggggaactggaaattcattcccctcaaatagccattctcaactctggctacgtactagaatctcttagggagctttttttgaaattgtgatttaattagtctttgctggggatttctagctcatctctttcccagcgtgactcatggatggaggccagcatgtggaccccaggccacctgggggctctgggtactacaacctggacggcaagggggtgtgcctacatctggtgccatcttactcaaacaattgagttttcttccagccaatgtgaagatacacccccaccccacaaaagcactttttactctaactgttttttggaggtttttctgtgttgttttttttgagacagagtttcactcttgtcacccaggctggagtgcagtggcgtgatctcggctcactgcaacctctgcctcccgggttcaagcaattctcttgcctcagctccccaagtagctgggattacaggcacttgccaccacgcccagctaagttttgtatttttagtagagacggggtttcaccatgttggccaagctagtctcgaactcctgacctcaggtgatccacccaccttggcctcccaaagtgctgggattacaggcatgagccaccttgcccggcctctaattgttttttaaagaaggtctgactggacctgcttccagatttgacaacatatctttcaattgcaggctttcctacttttaactcctcacatacttcctaaggaaagtctagacagacttggtacccagccatctctgtcagtactgagtatatttacataactcacacaaatattgtgggagcttagagaaaggaaggagaagataccgttactgacctcaggggatctattattctgttttggacatgagaaccacactgtgttcttagcataagcaaacttgagtgttgatagttttgcaaagtgatataggtaatgagtctttgggggagtcatttttggttcggcacaaattcaagtgtggctttgaaaagatgtcagcatacatgtgaaatgaaaacattccaagaagtttcccaggatgatggggatggctctacagtgtgtgggaagaataatgctttcaattcttgagtgttgccttgtgttaggtactgacatataatcatctattttcccagtggcccctgagtaggctttatcttttatccttgtgaattatccatttcacagctgatgaaactggcagtgagagtgggtacataaatttgcccataggcacaaagctagcaagttggaggttattgaataaagctgggttgcgtctgccttcagaattcatgttcttctctttctggcccatcacttaacctgctgtatgatttttggcaagccacttaccaccattgttggtttgttcttcagttaagtaagagctctgtcctctttctttcagagaaatgttgtaagaaagaatagagtgatggctctgaagtgtcacacttttcagaagaggcttcagtttaaaccattctttgagatttgttccagtattggcacatttttacccattggttgaaagggcccattctcttccatatcctctgtactttctgtgttttttctccataaatacattttacttgactgtaatgaggtctcatgatcagaaaggcatatgaccgtaacactccagctttctggacaggatactttcttgatattttgagggttatttcacactcccctctgctgtgcttttgtggccctttttgctcatgatagctgaaatggaataggggatttcttatagatcatctttaaggacagcgttgggatctcactggtatcccagctataggaaggctgataccattgagtgcttactgagtaacagggctgtgctaaggacttcacatgtgttagctcatttcagactcacagcaacctaatacataaggaattatgatacccattttacagacagcaaaactggcattacagagaggtggttgctcagagtcacacagcaaggaatttgactctgtaccaaactagaaaatttccacttaaatactcatgtattagttactcatttggctttagaaaatatgatcaactctatatttgcttatgcaacaaaaagaaaaaaagaataaagaaaaacaaactatatatatatatatgtatgtatttgcttatgcacagatacagagtggttaatcagacttcatgttctaaacatagcagttccttgagaataggaatcatatcgtcttctttccgtctctcagtttccccagcactttgtttacactcgcctcagtgacagtactgataatacagcctgatcggttgtcagtgtgtctggcatccttcctgcaccctgagcccctgagggcaggggctggacaccccagagctttgcaccagtgcagggcccattatggggcacttggtctagtgctccacaggtgggaggtgcctcttacaaagcagcaaaccaccttctagtggtttctttgagcagcctctgaggtgggcggagcagggattcatgaatcccactttatagatggaaaattgtccccagagagctgaagcaacttgctcagaatgcagtagagaagctgccaccagacccctgggtcctgacctaggcccagtgagccatctccttgaatgagaaagtgctaagggagcatccaccttgcacttgccatgccagggtcaagcctaaagtgacccatatttctgtccactcaggattggatcttgtacacttatgtggctacttcttttcaggatgaatctcacttcctcaaaaacagtaggactgcccgctgtcgagcagctatgccggtcctaaaggtgagtacttctgagaactgagcccactgagcattggcatcccataatattttgctcaggcttgcatgtcgtcctagtccagcaggggttgcaagtatagacctgtgggccatggtcatgacttggcattgacttagggcatctgtctctctccttagggctgtggtaccaatttcatctttcttcctaacatcctgctaaggaactagtaggcagtactagtagtcagtagtgctgcctttgtctctcgaaggtcaagactgttgaggctgggtgggcattggactccagaatcctcctctggcttcctacttagataagagagagcctctagcagcttgtccactaattagcttagaaaaaactgcctgtcttctaagtcacttgtagtggcaaagctgcctagatgctggaaatcagggaagacgagttgtattaatgaaagtaatggcaaaaaaacgcaattacttttgcatcaacctaatacaaacagaactgagcaagggctggcggggtcagcgagatacactggcaaagctaagatgggccttaaaagctgatactgttttctgtggctaccctgagcctctttggttgacagaaggggcagccatcccccttcctccctgtggtggcctaaactcatttctgagtgctttggcgggtgtgagttctggcttcacagcaagcaggcgtgggtatgtgatgcagattctagtctttaagcatgttctgatgtgcaatataggctctgtatttcatctgtctctctcttctgtgtttggtttcttagtcccccatcccaacagagggtagtcctccaaatttccttccattatgggggggggggatgatttttttcctattattgtaagagggaaggagaagtacaattagaaaagtagccttttctcttgtaacaagttagaagtttctcacagattactttggaggtatccactttggtttgtgtagactgagcaaaccaaagtgtgtgtttttcttgtgctcaaagcaacctttgtgttgtaccagcattttaaaactatggcttttattgattaaaagaagctttaacttttacctaaactagggaaaacaaatacgctgaatgttaatgaagcttagcatttgaacattaatcttaacatttcctcacaaaacacacgtaagtgtccactcatttcaagttttcatgtgtttaggaataacggaatatgatacatcttccaaggcagggtcatgtcatgtgccaaaccaaagaataaaagtcttttactgcaaaagcttggttttgctggggtggtggctcacgcctgtaatcccagcactttgggaggccgaggcatgtgggtcacttgagaccaggagtttgagaccagtctgagcaacatgacgaaatcccgtctgtactaaaaatacaaaaatgagccaggcatggtggtgcacaccaagctgaggcaggagaatcgcttgaacctgggaggcagagattgcagtgagccgagattgtgccactgcactccagcctgggtgacagagtgagactctgtctcaaaaaaagaaaaaaaaaaaaaaagcttgattctctgccagtattacctataaatatttatatgtcaatagccattgatggacacatttaaataaaatgtttttcctaggttgatgacccttcttttgggaggccttaatatgctttccataggaaaacaatagggttaggtattttggtttcagtatttcagccataactaaattaaatctttactcctgattgtttagacaaaagaaaatgcacaatagatagattctatcattaaagatacaatgtgaaagcttctagcaaccacttgttaatgtagtcattgcctggctgggcaagctgagccagatagtggtttctgaaatgtgtgcctctcagccagacctttggaagcagcatatacctctttaatatcttgagtgtgtttcaaagtgacatgtttaaaagaaatctctaaactgctaactaatatgtactactctgcatttgctgtagaacttggatgaattaatattttaaaataagcctcatgaacatggcctgtgtttatgaaggtgtcttggggccacgctcttccgcaacgttgacttcatataatgctggactgtggcaggattgggctgaaggagtgggatggagcattctgtgctattctgttaaccgaacctttcatctctgtcttattgtattttcgtctagattggagtctctcaaccatggtactgttgacattttgggctggatgactctgttgttggggggctgttgtgtgcattttaggatgtttagcagcatccgtggcctctacccactagatgccagcagttcctccccagtcatgacaaccaaaattgtctccagatgccaccgaatgtcctctgagggaggacaaatcactctctactcaccttgcccttctccaaccccatggagaaccaccaatctaaataaggaaatgaatctaaatgtttttggaataataagatagttgggaaaaagtaaagtatgtctttgaaaagccatataaggacctaatttaataccacttgattgttcctctaatatgaacatctcttagaactatattctgataattaatattacaagcatattttcagcaaataggcataatgaggtatttagattaaatcatacagttcgttggatagcagggccagatcgtgtccagaaaaatgtggattttgtaaatagcaatagcagtcagcagagagaaggtgtgttagattgtaagaaattggtgtcactgtcccctgggaaacgtgacatttttcttcccccacagcactattggctggggctactaatcctaaatgaggtaaatctatttttatatataaatatatgaaagtagaccagatagaagctaaaaagaacaaagttaaaattacctttaatccctccaacagaaaaagccactgttaacagcttatttttccagcatgtcaattattgagcaagatcatcatttttcaataactatggagcatttacatagtggagacacatcccataatttaatcctcagtatcagacatgcggttgttttccatttttgctattataaataattctgcaagtgaacatcatctatatgtaccttgcatatttatcctattaggacaaattcctacaatcagaattgccaggtcagttttcatttgacctttttaggggaggcctctgaagtccagtctggccaggcataacaatcttcactcccattcagtcttcaatcagaggcttttttttcccacatgactccgccctcaggattactggcactcttttaaacagtgaggtgtgtgtttggggttttttggtttagtttagttgtcttttgtctacactggcttttattgttaaactagtgtaataacaaaattaaaaatttttcaaagggaaaggcccctagagtcctaccattctttcctaagaagcagctgtttctctttttctgtaagtagagagtactttttatatctctgttgattggctggatgagatagtggctaaaaggtataaggtttttttctttttcctttgttattaaagtagtttaaatagatgataaattcaaatggggccgggcgcagtggctcatgcctgtaatcctaacactttgggaggcctgaagcaggaggatcacccgaggtcaggagtttgagaccagcctggccaaaatggcgaaaccccatctctactaaaaatacaaaaattagccaggcatggtggcacacacctgtaatcccagctacttgggaggctgaggtgggagaatcacttgaacctgagaggcggaggttgccctgagcggagatcgcaccactgcactccagcctgagcaacacagctagactctgtctcaaaaaaaaaaaaaaaaaaaaattcaaacaatacaaaaggatggacagtgaaaaataagtctttcaacccctctaggttccctagtccccagtctctttcctcaaaggcagctatagttaccagttttcaggtttacttccataaaataacctgcacctatggaagtacgagtgtgtgtgtttcctttctgcctccttagagtgttttacaaccattgttttacacttgcctttatccccttaataatgtatcttgaaaatcattccatgttgttccaaatgacttctaccgcattcttgcaaatagcattctattggataaatttatcataatatgtattatctgttctcttttgatggatttgtaaccaaattgcagctattacatgcaacactgcaatgaccattttttcatatgttagagaagtggggagtagaaaatgcaatccctgtgtgtctgagatggctttttgcctatcaggccagaggggagagcagtgtcagctggcagattctgttttcttccctagtgtgatgaggctatagaagtcccctgaggtccggccattctcatttatttcctcactttcattacataatcagacttaaaaaggaaattattagagtttgaaacctatagtaaaatggattgtcttttccagagtaaaaaaatctaccttaggccgggcgcagtggctcatgtctgtaatcctaccactttgggaagctgaggtgggcagatcacttgaggtcaagagttgcagactggctggccaacatggtgaaacccacctctacaaaattaactgggattggtggtctgcgcctataatcccagctatatgggagactgagggaggagggtcacttaaacctgggaggtggaggttgcagtgagccgagatcatgtcactgcactccaacctgggtgacagagtgacactctgtctcaaaaaaaaaaaaaaaaaaaagcttggaatggcatagctttaatcagctataattataccatttgatatattctcattataatattttggtatttttggtccaatatacatgcagtcactgtcttcattctgtctgttcttacccaagaactgccttatatgtggcatgataatttcatttatgttacagcagcaatgctcacttagcttgaaggcattatggttatcatagcaaatcagtttagttaaggttagtactattcagatttgtgactggaactttgttttttttggaacataggctagaacctagagggaaccatttatgtgaaataagctgacctaaccagagattcagaggccatgtataaagtatcactgagtggtaggtggccttctgccaatacttagggcagcctctggtcagcagtggccataattatgctgctttcttggtttgtcctggtttgttttggggggcaccactcaggagcagagtaaagaatacacccgtggtctccctccccgactccaagcactggctttcttctgaatgtcaagcttttctttttgcccttaggctttcgatttaactacaggtgtctcttttgtagctccttgtatagtgactgtgatcccacatttattcttgatctgtgtacttttggtcacttgtcctcaagctatgcttgccactatccttatttctgaagattgtatcatgacctctgaactaattaaaacacagcttcaatgtccctgccacatcagggttactgagtatggagactttccagcggtgtggacttgaccttctctttgatattacctgccttcttcatgtcttatttctaaattgaatatatggtattgtataaatttatttagagtaccattaggaataattctgggtataagactggactgagctttggagaacatgatttttttcctagtctagggttttggcaaaatatgttacagcccatcagaataattcagtaaagcaagttactggctcaattggaaaaaaaaaagagatcacataaagtgatgaagaatttctggactgcttcttatataaacttaagacttcagctcttttttctacagtagaacattctcttggctcttaattttattttttatttaattttatttttttgagacagagtttcactcttgtcacccaggctggagtgcaatggtatgatcatgatctcagctcactgcaacctctgcctcccctgttcaagtgattccctgcgtcagcctcctgagtagtgggattacaggtgtgcagcactgcacctggctaattttgtatttttagtagaggcagggtttcaccatgttggccaggttggtctcgaactcctgacctcaggtgatccgcctgcctcagcctcccaaaatgctgagattgcaggcgtgagccatcatgcccggtcaactcttaattttaaaactatgtatagattatccactttcaattacgacattgaattctctgtggcgaattatgtatacacgaactcagcctattctgcagggttttcccacccccaacccacgaagaaactaagcctatctttgagggtcatctgatcccaacagtgtctgcacatgtgaatcatgttatctttctaacaccacacagaaagtatttttttacattgttctatcttcgatttcttgggtgttgcttttctcccttaggtgggggagttcactgtaaactgttcaatttggtgttgatttatgtagttttatagatttctgttttcctagatttggaagttttcagaagtggagggtgacatatgacacctttgcagctgggcatgtgttaaaagcccttgtgggtgatcgtgatgacatacacacatgttggggctgagctgggagcaggccaaatcaccccattacagacgagatgccattctggtttctttttcaaagctggactttttctttttttgtaatgctgcctctgcctttttgatgcccacaaacacccattggcaacgctcccatcactctctagtctagggagtgtatgggagaagcgatttaatactaactacatcctataagtatctgacagaagaccctggagttaatttccatcatctgattcatgaactgtttttgccctggctccatccccaggccagcacagtgacatgaagaataggtttggggtgatggggagattttctctttttgataaaacttttcattttcccctttttcattgaaatgatcttaaagccaaggcaagcgatgctaccaacgtcagctcattgttattttaatgagtctgcattaaaccgtgcaggaagttagaaggcctaggtaattgaactgtggaaaattatagctggagacattcatagctctcccatcataatggaattagatattggcgattgctgtgagggcacaaatgcgtttagataattgtgtatattgtatatttataaagaatgatttttcttttcactgttgcacctttatttatttatttttatgaggcagtgtatccatctgtaaacctaatttattctcctaggtgatttattacatgcaattgccttgtattactgtcattaactcaaggttacagtggttaacaagctgtttctagacaactgagctccatggtagggtccgttcccagagctgaagtgaattttacgtccagtaatttgtagtgattctgtgttctaatacagtaggaagagtctctttttttttttctcaccctctttcccatcttaataataggaggtgggatctttgggtctgatgcccatgggtcaggttggtgtctgggtagtgaggaacttggaatctgtcattgctgttgaccaactattttttcccatcttgcccatgctaagcaggctgctgcacatctgggctgagtttagggaaaatggaaccaggtatcacctattaaggttcttattgttaataactgcaaaatgagcctgagtcaggatctgtaggcttgaagcattgtgaagctgagttagtaaaggccttattttcctttaaagaaagtcacatggagacatatacattggcaacccctgacacttcctcttgggaatgggagagggctgattgtaattgtcattatctgagttcaacttgcatgtcacagatccactctggaggaagttcagacctgccactgtcttctcccacttcctgtccaatgctggattctttgagtttactctgtgttctccaggatactaattagcttccttgtgaattttttgcagcatacggtgaacatttattggttacttggcgtcaggcatatgctacagaaaataaaggtgaatacagcccagtccttgatctcaagaggcttgcagtctaacaagggagacagaaaagttataattcaatgtaatatgttaagtactaggatagagctcagcagagggcaggcagggaggatttaaagaaaaggagatgccatctaactgcttgcattggcaatgccattaggttctcgcgacacgcacgcggtctttttctgggggcatccagctcctccctcactggggcattttgaacatttcctgtgtgctcctccctgtgttcagagcacctttggctgtttgtcttttaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacgggtatgtattatctcttccctcccagcccacccatttctcaccctgattttgacacttatctttctcttccttctctctggccatgatatggtcagaagagcactggccaggggaatggattttagtctttctgtttcttactatggccttggaatgacctcaggggtaagatgaaaatggtcatcttaccctttaaatctagttttaatggttatggttatccgaagtcatcgttttccagtaaggggactagtggctgatgtgtaggtatgtggagctctgagagccggcttccctcttgcccagggtcacagctctgcatgaggcacagtgctggagctataaaaggaaagtccttgtcaagtgctggccctagagaagatgctggcactgaggtgagctaggagtgaggctgaggccccaggcagagggaagaagtaggtgagggggtaagggcttcctcctggcatgggaggaatatgaagtaaaggtgggaaattcctccctgtgcaaaaaaaaaagaaaaaaaaagataaaggtagattgaggagcctgatcccaaactgccttgggtgggctctgtgagtgcagtgccaatggcgcaggcacctcaggacctacagtcggcactccagaaatgctctcccaaaatggcagggaagccctgtaaacaccaatgcattgccatggaacccttgtttttaaaaccacattaattcagaccttagggattcttgttttgtgatcaagtcacaaaggtactggcactttggagaaatagctgcaacttaccctacaagccatctatgagggaaaagccttgctgtgcaagtacatgatataaataagagtgtctgccttattttttaaatttttaaaagaagaaaaaaagttttcaagtactttaaaaatatccacttacattcaaacgaagtacttataatggaaattgtagtccttagcatagttaattgcaaaccatttttagctggttattgaggcaggaaatttcccaattattaaatgtatttaaaagccgtacacttctttaatcatatatttagttcattttccctgtagatcaatccagattagactgatgctatatagttttcatggtccctcaaaactcttcatgtatgatttggatttctgtcctattcgcaaacagtccactttctaaaaaggatcttctctttcttgactatatgggcccatggcataataatgttcagctagtgatgaaaggggctaaagataaaattgattgcctttcttccccaaactgtcccttcctatgttccccatcttaggccagcatctcagtagtttctcctgccagaaactaaggcattatctttgaattctccttttcctgccttcttgatacacctccccaatacaacaaagaatgccttcctcatcttcacatctttctttccacctaacccagtgcctgatatgtggtaatttttcaattaaagcttgttggattgtgactatcccaaggtcaagtttaaaatttttgccgcatgcagcggtacacacatgtagtcccagctactctgcaggctgaggcacgagaatcgcttcaacccaggaggcagaggttgtagtgagccaaggtcatgccactgcactccagcctgggcgacagagtaagactctgtctcaaaaaaaaaaaagaaaaaagtaacaaattacttggtattttggtgttactaagttttaacctacaaggttaagagctaacaatattagaacataggagcatgctatctgtcttagtctgttttctgttgctgtaactaaataccacagactaagtaacttacaaagaatagaggtttatttagctcatggttctggagactgggaagttcaagagcatggcactggcatctagtgagggccttcttgctcttcataacatggcagaaggcatcatatggagaagagggcaagagcatatgtgtcagctcaggtctctggtccttttcttataaagctaccagtcccaacatgggggacccaccatgatgaccttatctacctcccaaaggccccaccttcaatcaacataatgaatttggggattacttttctaatgtgtgaaatttgggggacacatttaagccatagcaatatccaaattaattatgatatccacttgttctcagcatggtttttatttaatacaatccataagccagggctgccttttttttttctttttctttttctttttctttttgccagcttcatgcattaagaaaccactgaaaagagaacctcatgctgagctcatttgcaaaccactaactatctgaaggcatttgctgagaacttccagttgatttcagagtattttttaaaaagaagaaacagctttacaacattttattcctccacctttgaccatctcttccttctctcaatttagcaaaggtttatgagacacctattctgtctccactattatgctaggctctctagccctctataatgggaaaacctagcccctaccctcaggtagctagctcatcagccaggaggggagatgagctccttaaaagacaaagtagcaggcacactggctccctgattttctactagactgtagaaatcagttccatttccagtaagattgttggtgagggatagggtttttaatggtaatggcttctttttttttttgagacagagtcttgctctgttgcccaggttggagtgcagtgacaccatctcggctcactgcaacctctgcctcccaggttcaagcaattgtcctgcctcagcctccctagtagctgggattacaggtgcatgctaccacgccggctaatttttgtatgtttagtagagatagggttttgtcatgctggcaaaactcctgacctcaactggtctctaactcctgacctcaagtgatcctcctgcctccgcctcccaaagtgctgggattacaggcgtgagccactgcgtctggccagtaatggcttctctagctgtgtgatggggaatgaacatttgagatcactgcctcccgtgagctcctcaacgagggagccatgtttatgaaggactgcctaggcccttagccagactgccagaagcctatgtggtgggctcctcctgccaaccccagctgccatctacaacaacactgcagttacttttattatattgtacttgtttgtgctggtgtaatccatactgcagaacaacagtttttaaaatccctgtaagtctcatcaaataaagatgttactgacattattttattacattgtgcaacagactctgtaggataagccatagggaagatttagtatttagtgtacaggaatagtctgacaagccaagttttttgtttgttttttaataaaatggacacccaattgcttgacttctggcatttgctgctggaaaagaaagctcactgccaaattgtagaatgccatgataggtgttttttattcatctcattcctgacttttttctctcttttcctttccatttctcatttgttttattgggggtttatttgtccctgtaagtcacttgaagttttctgagctaagccaggggtggttgtgagaagagggacctcccgggatcccaagtccctgttggactgggcctgaaaggagcctcatggggctgtcgctgtcttgttctctgcagatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactgtgagtccagggctggagacagatttggaagcagacatgtctaggtgttcctttccatgagaggcccttgaaaatgacctggcattctctcagctttcctttctgtaaccttttccctcttccctaggcaagaacagcaagtccatttcattcctcagcctacctagtcagttttgaaaaatctcatattaagttgtggttttatacttgtatagatcgctgttgatggatggccataaagataagcacaggcaacagcagggtggtgatcaatattccgaatccctcaaagaatgtggaaattatgtctactatattttgagaatgcatcagtctagtaacagttgttagaaaattagtcctaacatgtttgatacatatgttaatcctttaaccatactgtgtcatttgtgttagtcaaaataacaagccgacattcttataacaaaatagagttttcaaatcctcctaaccttttaaatccctattacaggcatttatggttggcaggaagttggcatccccctttttacagagagggaaactgaggctcacagagattgcagtttgcccagggtctcttagctgctccaccacagagctgaggctagaaccaagcctcttgcccctatattttaggactgttttcactatgatggttttatcttttcaaacacttttatttctgtctttagtgtcatactgtgctaagtgctataatctacaccagctctgtttctgtcctcttagataaaaccttgtaattcccattactaagaaaataacagtcattgatatttttcaacatcatgaagcattatctgggcttgatattaccctgtataaagatatttagatgtagatctcagccttctgggaggttacaaaataaataagaatgacaagagacagaatgcatgtttttcatgttattttaccatgtgatgagcaagattcattgataacttttaagaaatgacaggatagaggatgcactggcaaattttcaagctgtattgaatttatgctgtattacatataataatctggatggtctggagtaagtgagcaggcatcatctctttattgtggagttttcaaacttaaacaacatcgatgtagacatatagaccagtgttctcagattatatttcagtggaatcatgagtaaaaccaggaagctttgtcactaaaatcaatcttggtggtcttttgtttatttttagagataaaaatgcaatgagtagattattttttctcaatttgaagttttttcttataactttttcttaataactttcgtctactggtgaactctaccagacaagaaaaccagtgaactggtatagcaaatataatattaatggaaaaattcagacatgcaatatttttagatgcaaagagctgaatatttataaaatgttattttttttgccagcaaagttgttccttgtgtgtgtgagatggaagtaagtctgttagtgtttcgtgagattccccagagaacaccctcaccaatacctggttcacctcctgaaccagtttgagaacagccaaggtagacacctgaaaaagcaattagtgggcatttgaattaaggaggaaaagcacattaacttgttgaaacacaactgtgaattgtgtagtatggccaaaaagaaaaaaagaaaagcagtagaaattttgtgcttagtgcaacaagatctgaaagcattttgtaaacttctgccaacttgtatagttcttcaagtaaagggagtggctcttttcaaagatgatttcagatgtcacctgagagtttgatttctgagcttgttggtgatgctatgaaattaactaggaggtactatggaatttaggaatgttgggtgttttataactttaggtagctatacaaatccagtatttttgaggatatttttatattttcttgcttagaaacggagccacaactcccttttggttgtggaaaagtacataaggatagtgccagttgcccagaatcctgcctactgggtgattatcctctttgctttgtaaacaccacagtgttaactccattttgcagatgatgaaaatgaagcctaaattgcagtgtcattcttcaagaatccagctgagaaagagcccggagctcttctcagtccagcacctgagagttgctgtctgcttccttggagtcttaggaaagttaaacgtttatccctgaaagatagagattgagttggtacagattaccatcagtgtgatggctgaagccagacactaaattctttcagataataattccttaagaacttgatgcctttttgtgtcttaatagaaatcaatttttataatggaaaatccaagtagaaaacagatttgtgtgtttgtgctttgggccatcagaacctttggatttctaaagccattgatttagtgcatttctaaaccatggatctgatcaggatcattgctctaacttaattcaggaagggagccagcatcagctggaggctggactagatgaccataggcatgtcttccagaccctggccagctatgaaatcctgagttggaagggttaaaatggggacttattttttttatggttttagttgaataaggaggccctgtggatctatagaaagtcccctctctccactgccaccagttttttaagttactttttagtcccaagtttccttgcaattttgcaaatcatggtgactccagccaagcactgctgacctgcctgtcaagaattgattctttgttccttcacacctttccatctggaagaatacatttcttaaaaagctttatatcacaggagccaaggtgaaggagccaatttatagaatgtaatgtataatcaaagacttttctcattttttcagctgaaataatggatatcgcttcacaggcaaaggaaagctgactgtaatcatcttttgtctaaagccattttttcatcctcaagaccagtaacagagaaatggaacaagtccatacagatttcctggtaacaatatcagttcacccttgccatttgacaatccactcaaatttccaatgtagaaaaatttaaaaactccattggatctaatttaattaaggtctagtcaggaacaaagaatgcaggttatttaaaatttcctggccagtagctggcaaaagaagtaagatcattaatagagagtattaggtctgcacagtttgggggagtttttttaaagctgaaactattgatttctcccacattaaaatagatatctattgtataaaatctgaaaaataaagaaaaatacttacaatcagtaacatttattgaatacttgctctgtgctgggcatggtgctttacgtgtattgcgtcattaaattctcaccatcagcccagatatttgagcctcagagcctgcacttttaagtgctacaaattctggttctaccgtttagtagcagtgtgacaagtatactcatttgactttttttgcctcagtttcctaatctgcacagtggtaaagtagtgcctccctcatagcaatgctgattattaaatgagttaatgcatatttagttcttagaacactgcttggcccgtaataagtggtatatgagagttagttgttatttttattactatactataaaaaagaatcatcttggggcggttccaagatggccgaataggaacagctccagtctacagctcccagcgtgagcgacacagaagatgggtgatttctgcacttccaactgaggtactgggttcatctcactggggcttgttggacagtgtttgcaggacagtgggtgcagcacaccgagcgtgagcggaagcagggcgaggcatcgcctcacccaggaagcgcaaggggtcagggaattccttttgctagccaagcaaagctgtgacagatggcacctggaaaatcgggtcactcccaccctaatactgcgcttttccaatggtcttagcaaactgcacaccaggagattgtatcccgtgcctggctcgcatggtcccacgcccacggaggctcgctcattgctagcacagcagtctgagatcgaactgcaaggcagcagcgaggctgggggaggggtgcccgccattgctgaggcttgagtaggtaaacaaagcagctgggaagctcgaactgggtggagcccaccgcagctcaaggaggcctgcctgcctctgtagactccacctctggaggcagggcatagccaaacaaaaggcagcagaaacctctgcagacttaaatgtccctgtctgacagctttgaagagagtagtggttcttccagcatggagtttgagatctgagaacggatagactgcctcctcaagtgggtccctgacccctgagttgcctaactgggacacacccctgagtaggggcagactgacacctcacacggccaggtacccctctgaaatgaaacttccagaagaacgatcaggcagcaacatctgctcttcagcaatattcgttgttctgcagcctccgctgctgataccgagccaaacagggtctggagtggtcctccagcaaactccaacagacctgcagctgagagtcctgactgttagaaggaaaactaacaaacagaaaggacgtgcacaccaaaaccccatctgtacgtcaccatcatcaaagagcaaaggtagataaaaccacaaagatggggaaaaaacagagcagaaaaactgaaaattctaaaaatcagagtgcctctcctcctccaaaggaatgcagctcctcaccagcaatggaacaaagctggacggagaatgactttgacgagttgagagaagaaggcttcagatgatcagatttctctgagctaaaggaggaagtttgaacccatcgcaaagaagttaaaaaccttgaaaaaagattagacgaatggctaactagaataaccaatgcagagaagtccttaaaggacctgatggagcttaaaaccatggcacgagaactacgtgacgaatgcataagcttcagtagccgatttgatcaactggaagaaagggtatcagtgattgaagatcaaatgaatgaaatgaagcaagaagagaagtttagagaaaaaagaataaaaagaacaaagcctccaagaaatatgggactatgtgaaaagaccaaatctacatctgattggtgtacctgaaagtgacggggagaatggaaccaagttggaaaacactctgcaggatattatccaggagaacttccccaacctagcaaggcaggccaacattcaaattcagtaaatacagagaacgccacaaagatactccttgagaagagcaactccaagacacataattgtcagattcaccaaagttgaaatgaaggaaaaaatgttaaaggcagccagagagaaaggttgggttacccacaaagggaagcccatcagactaacagttgatctctcggcagaaactctacaagccagaagagagtgggggccaatattcaacattcttaagaaaagaattttcaacccagaatttcatatccagccaaactaagcttcataagtgaaggagaaataaaatcctttacagacaagcaaatgctgagagattttgtcaccaccaggcctgccctacaagggctcctgaaggaagcactaaacatggaaaggaacaaccagtatcagccactgcaaaaacatgccaaattgtaaagaccatcaatgctaggaagaaactgcatcaactaacgagcaaaataaccagctaacatcataatgacaggatcaaattcacacataacaatattaaccttaaatgtagatgggctaaatgctccaattgaaagacacagactggcaaattggatagagagtcaagacccatcagtgtgctatattcaggaaacccatctcatgtgcagagacacataggctcaaaataaagggatggaggaagatctaccaagcaaatagaaaacaaaaaaaggcaggggttgcaatcctagtctctaataaaacagactttaaaccaacaaagatcaaaagagacaaggccgttacataatggtaaagggatcaattcaacaagaagagctaactatcctaaatatatatgcacccaatacaggagcacccagagtcataaagcaagtccttagagacctacaaagagacttagactcccacacaataataatgggagactttaacaccccactgtcaacattagacagatcaacgagacagaaagttaacaaggatatcctggaattgagctcagctctgcaccaagcggacctaatagacatctacagaactctccaccccaaatcaacagaatatacattcttctcagcaccacaccgtacttattccaaaattgaccacatagttggaagtaaagcactcctcagcaaatgtagaagaacaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaaggtgttccttgaaaccaatgagaacaaagacagaacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacattcaaaagacagcagaaggcaagaaataactaagatcaaagaagaactgaaggagatagagacacaaaaaacccttcaaaaaatcaatgaatccaggagctggttttttgaaaagatcaacaaaattgatagaccactagcaagattaataaaggagaaaagagagaagaatcaaatagatgcaacaaaaaatgataaaggggtatcaccactgatcccacagaaatacaaactaccatcagagatattataaacacctctacgcaagtaaactagaaaatctagaagaaatggataaattccttgacacatacactctcccaagactaaaccaggaagaagttgaatctctgaatagaccaataacaggctctgaaattgaggcaataattaatagcttaccaaccaaaaaaaatccaggaccagacggattcacagcctaattctaccagaggtacaaggaggaactggtaccattccttctgaaactattccaatcaatagaaaaagagggaatcctccctaactcattttgtgaggccagcatcatactgataccaaagcctggcagagacacaacaaaaaaagaattttagaccaatatccctgatgaacatcaatgcaaaaatcctcaataaaatactggcaaaccgaatccagcaacacatcaaaaagcttatccaccataatcaagtgggcttcatccctgggatgcaaggctggttcaacatacgcaaatcaataaacataatccagcatataaacagaaccaaagacaaaaaccacatgattatctcaatagatgcagaaaaggcctttaacaaaatttaacagcccttcatgctaaaaactctcaataaattaggtattgataggacatatctcaaaataataagagctatttatgacaaacccacagccaatatcatactgaattggcaaaaactggaagcattccctttgaaaactggcacaagacagggatgccctctctcaccactcctattcagcatagtgttggaagttctggccagggcaatcaggcaggagaaagaaataaagggtattcaattaggaaaagaggaagtcaaattgtccctgtttgcagatgacatgattgtatatctagaaagccccatcgtctcagccccaaatctccttaagctgataagcaacttcagcaaagtctcaggatacaaaatcaatgtgcaaaaatcacaagcattcttatacaccaataacagacaaacagagagccaaatcttgagtgaactcccattcacaattgcttcaaagagaataaaatacctaggaatccaacttacaagggatgtgaaggacctcttcaaggagaactaaaaaccactggctcaacgaaataaaagaggatacagacaaatggaagaacattccatactcctgaataggaggaatcgatatcatgaaaatggccatactgcccagggtaatttatagattcaatgccgtccccatcaagctaccaatgactttcttcacagaattggaaaaaattactttaaagttcatatggaaccaaaaaagagcccacattgccaagtcaatcctaagccaaaagaacaaagctggagtcatcacactacctgacttcaaactatactacaaggctacagtaaccaaaacagcatggtactggtaccaaaacagagatctagaccaatggaacagaacagagccctcagaaacaataccacacatctacaactatctgatccttgacaaacctgacaaaaacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggaaacctacagaatgggagaaaagttttgcaatctactcatctgacaaagggctaatatccagaatctacaaagaactcaaacaaatttgcaagaaaaaaacgaacaaccccatcaacaagcgggcaaaggatatgaacagacacttctcaaaagaagacatttattcagccaacagacacatgaaaaaatgctcatcatcactggccatcagagaaatgcaaatcaaaaccacaatgagataccatctcacaccagttagaatggcgatcattaaaaagtcaggaaacaacaggtgctagagaggatgtggagaaataggagcacttttacactgttgatgggactgtaaactagttcaaccactgtggaagtcagtgtggcgattcctcagggatgtagaactagaaataccatttgacccagccatcccattactgggtatatacccaaaggattataaatcatgctgctgtaaagacacatgcatatgtatgtttattgcagcactattcacaatagcaaacacttggaaccaacccaaatgtccaacaatgatagactggattaagaaaatgtggcacatatacaccatggaatactatgcagctatgagaaatgatgagttcatgtcctttgtagggacatggatgaagctggaaaccaccattctcagcaaactatcgcaaggacaaaaaaccaaacactgcatgttctcactcataggtgggaattgaacaatgagaacacttggacacaggaaggggaacatcacacaccagggcctgttgtggggtggggggaggggggagggatagcattaggagatatacctaatgtaaatgatgagttaatgggtgcagcacaccaacatggcacatgtatacatatgtaacaaacctgcacgttgtgcacatgtaccctagaacttaaagtgtaataaaaaaatatatttaaaaaaagaatcatccttacatttgatatttgaatggacaaatgaactgtatgtaatatttttgggtcaactgggggaattttgaacatagtctcagtagtagatgagataaaatgtactgaaagagaaagttactaaaaaaacaaaaccagattaaggaatggtatgtacaataaaattttatattgatgtaaaactagaaagaggtgtgtgtgtgtgtgtgtgtgtgtgtgtgtgtgtgtatgtgtgtgtgtatgtgtataaagacctggaaaggtaaacattaaggtaatgagcattggtggacactgatggtaattaaattgatttaattaaattcaaaaatttcctatagtgcacatgtgctgcttctgtaactatactttttaaaagtacaaacaagataataaaaagttaaccaatttaaaaaaaaagaatcatcttttatacaaccataattttggcatatataatttgagtatttttctataattatgtgtgtatatgttgctttaagatatatttttatgtatctgcatataaatatatataaaatattatatatgcaataagcaatatgtgtattttaaaagcagaactgggatcatacaaacacgtcaagtgggaaggaaaacaggttactgtcttatgaagacttttccatgttgttaaatattctcttaaaacataatatttagccaggtgtgctggctcactcctgtaatcccaacattttgggaggccaaggcaggaggatcacttgagcccaggagattgataccagcctggacaacatggcaaaaccctgtctctacaaaaaatccaaaaaaattagctgggcgtggtagtgtgtacctgtagtcccagctacttgggtaggaggctgaggtgggaagatcacctgagtctgggagtttggggctgaggtgagctgtgattgtgccactgcattccagtgtgacagacagagaccttgtctcaaaaaaaaaaaaaacaaaccataatatttaaagactgcatagtgttttctcacacggctataattttgctaatcgttttgttgggcctttaagttactttcaattgctcactattctgagtaatactgtactgaaaaagtagcttacatagaaatttgtgcacatgcaattttataatgagaattagttttaaggagtaagttgctggatggtagggttttggcatatttaaagggggttggtacgttttgctgcatcatccccaaaagggctagcccagtgtaccatcccaccagtcaagtataataaaagtgtttgtttcttcatactctcatcaactctaggtgctaaatgttagagcaagattcctgaaagtgcttctcagcagttttccatctgtttgttttgccctctttctttcttattagggagtatggcatgagtgagtgtaggtgggaggggtaggctctctctgaaggacacgagtaaaactgaagatgggggccaactggggtgcagtctgatggaggcacacatgctgcgagtgaggtcatcacatgtaagcctgccctgcccctttggctactagaaactgcattgggttggagggcctagcctgctcctggggaccgttagacgtccatgaatggatttcatgaagtctgagctcactagccacaggtgaaaagttgtgtatgtttccagagcgtgatacaaaataggagggtaggtggctgccactgccaagacacatgtaggatatgaaagggatttacagtctaatcagtgaccccacagcttcctgggttcctcagcatctttcttttttcccgtaaagtcctggaggaaagataccattcaaagctaagaagctggccagatgcagtggctcatgcctgtaatcccagcactgtaggaggccaagatgggaggattacttgagcctaagagtttgagacggacctggacaacatagtgagatcctgtctctacaaaaaataaaaaaaaaaaaaaagctggtgtggtggtgcatacctttagtcccagttacttgggaggctgaggtgggaggattgcttgagcccaagacgctgaggctgcagtgagccatgatcgagtccagcctgggtgacagagcatgaccctgtctcaaaaacaaaaacaaccccaaagccaagaagctgttttaaccagacagctttttcctccatccatggttattagttttaggtacagtctggctgtggttgctttcctgagttatcaagatctcaagaatgacaggttcaaggctatagatgttattgctgttgaatcacgtctttgttccctggggaagctgtcctgtcagtcacagatcttacagaggccaggcacaagaaggggggtgcacctgtactatgcttgctggtgaaaggagatggccacctgtcttggtccttttgtgctgtaacaaaatactttagactgagccatctataaacagaaatgtattgctcatggttttaggggctgggaagttcaagatcaagtggccagcagattcagtgtctagtgagggcccagtttctgtttcaaagagggcggaaggaacaaagaggctctctgtccttatgatctaagcatctcccagatgccccacttcccaccaccactgcactggaaattaagtttcagattatgaattttggggggacactcttaccaatgatggtaagagtatgatctctgggaggccagagcgatagtaaatgttatctcacattattatgaaatgatttgagcatctcctgtgttagcattctttattaggagtcacttaaatgtaaaccataaagaaaacaccgtttcttcttctgggaagttaattaccttatgtgggaggtataccaagaacacctgaataatggttttaaaatgatactaaaatgggccaggtgcggtgactcatgcctgtaatcccagcactttgggaggctgaggtgggtggaacaccggaggtcagaagttcgagaccagcctggccaacatggtgaaaccctgtctctactaaaaatacaaaattagctggacgtggtggcacatgcctgtaagtcccagctactcggaggctgagacgggagaatcgcttgaacctgggaggcagaggctgcagtgagccgagatcgcgccactgcactccagcctgggcgagacagagcgagactttgtctcaaaaaaataaaaaataagataaaataaaatgatagtaaaatagactagtcagggtccattggaattgattcagtaaatcttggacagaggtaagctctgtaagtcaggtatagtcacagcttggcagaagaaaagagggaagcaaaaagcaagttggggaaatgtcacatgtaagttgtcaccaggctgtagtaaataggtatgcttagccaaggccacatttcagtggttcacatgggtctggtgtgtatggtgaagccctacctgaaatgcgtctccaaagagcttttgtgttccttgcctcttggattcttgcaatggttcttggacaatggcagagtagctctaatgccgtctctgaggacaaaacccgacccaggcagttcttctgacttggccaaagtgaaaggggaatcattgtcagcaccagggtctcctgactctggtgacgggtggttgagatttgtaaagcgcataggagcaataattagatccactcatcccagagttctcagactggggcacttaacattcttaacttatctttcaacagaaacagcagcagaaagatgccctcattctcttcttcaacagaacagctgaagctaaaatcccatctgtcatgtaagtggtcactaagtgtcgacctctctctctctcatcttcaaaaaaaaaaaaaacaacttattactttattctgcctgaatgattttactgcgtctaagaaatgaccagagattattaaatgtgccttttgttgaggaaggaaaaaataaaacagatgatcagagagtagaattatagctgccttgaaaataaagtttaggggccaggctcaatgcctgtaatcccagcactttgggaggccaaggtgggaggattgcttgagtccaggagtttgagaccagcctggacaacatagtgagaccccatttatacaaaaaatgaacagaattagctgggcatggtggcatgcacctgtggtcccaactactcaggaggctgaggagggaggattgcttgggagggaggacggtcgaggctgcagtgagctaaggtggtgccactgcactccagcctaagcaagagactaaaaccctgtctcaagggaaaaatgaaaaaagtaaaagtttagggcaccctgctgttaattacacacaaggcataagttggccggtaactggagcgactactaggatgtacctgggtctctaagagatcctgtcttgagccaagtaggctggagctgctgctcgttaaaaggagggtggggttgtccccagcaccaaaggggagagtttttctaggaggactgtgatcatttgcctttagggaaaaaaaaattagaaggaaaagctgccttatggggatacttgggtcttccccaaggtcaggaattgtcatccattacttacctaaataaaaagacaaatgtcaaagtttgttcaaaagatatgggcatatggccgttgtcacgcctagttctatttccaccttataaattaaagctaaagtaataatttctattcttacaattattcatgacaaaatctcaattgtatgcctttcttaaagaaaaacccactcctatttaaatatcactggggtagaaacctggcaattctaatgatgtgcagtttgcctgatttttttttttgtttaacattcatgtgatgctctggcaggataatggtccaactgatgaaattacaatgagaatggattccgtagggctgagtggtgccagactggctgtggggactgagatctggggataaattaagaaatatatctgccccatcctcgtacttggcccacctacctctccacaccctccactgtggcaagagagctccccacaccactcgatctgcaatgccccctggaaagactgcccagtgctggcctcctccccttcacctcctgggcactgcccttttcatttatgaccctgctaatgaactccagatgtggtttttatggcctggaaacttttctcccagaaacacatctgagttgcccccgctgacccatttctcatgtgctgtggaataacagatggcaagggtgtgcgtttctcccttgctccctcagctcaggacctgcaaaattcagagtccaccaggtgcctctctcttcagatactgtgcccagagccacccatttcccttagaaattttaagtctttctaccacctcataaataaactttggtcataccttatacatactttctcaaatttctattatacaataaattgtatagtgctttgtagtttccaaacattttttacacctgtgaactcatttcacatttacagcatctttgtgagatcatgtaagtcacactggctccatttttaaaaatgcaaacactgagtaaatctatgactctctggacctcagagtcacacagctagtaagtggaaattagattgtatgtcttcaaaaccccaatttcctcagctagttgtttttcttttctttttttgctgttgtttgttttttcattttaatgggcatcttttaatataaaagccaaggttattgtggtaggcagatatttccagcctaggaacttgtagaaggttatagaacaacaaagctgtgtatgagatatagaggggaaagacgcattaggaaaattggggcctgtggtttttatgagctcaccaagtggattttgtggccttgtgactttttgatgctgtagccgtaaacttttttgcttatatcatggcaaattttatgtctctcaaaataattaaagtaaattctattagtatcaacaattcacaaattgaactcaaatctggtgccctggtcagtcatagtgttgtttgaaatgactcttggatgtttacagggcagtccacgtacctttccctcacctgagacatatccttctttaaggaaggcagagtctgttccctgtccagacgcacccatggctggcaatggcctcagcaaaggagctcacttgcctgtactgggcttacctcttctttgggattgtgatccctcttcagggagctaccaggggagggggcacctagccagggtctgttaacctggtgacttcccaccccactgctccctgagggtagccaccttaaggccaagcgaaagataagaggtgggaagcttgccgggtgcggtggctcacgcctgtaatctcagcactttgggaggccaaggtgggcaaatcacttgaggtcaggagtttgagaccagcctggccaacatggtgaaaccccatccctactaaaaatacaaaaattagctgggcgttgtggtacacacctgtaatcccagctactcaggaggctgaggcaagagaattgcttgaacccaggaggtggaggttgcagtgagctgagatttcagcactgcactccagcctgggcgacagagcgaaactcagtctcaaaaaaaaaaaaaaaaaaaaaagggtgggaagctaagaaaaaacacagtggctggaagagagatgtaaattaagggaggccaaacaaatgagaaccttctctccatagtcctctgccttggaagagaattaactgacttaactactggccctgtcatttgaggtctaaagtgggaggagctggagatccttcttggaatgtctctttagtattatgtatgtctcaatatttagcttctagaaatttgtgtactgtcattaattccttagtcccctccctaaatgctttcagatctacagaggacactctaatttgtatttaaaacacattataatgatagtcggaggtaaagtgaaaactgttgatcatcttctatgatcccagataataagaatgtttcagtaacataccagagacacataaaacataaggagtatatgtttaatctgttttgttgtcattgtcaaatgcagtgaatatatcttggacctactggaaagtggaagagagaagtttttagtatttgcacaccataaggtggtcctggacgcaattacgcaagagcttgagagaaaggtgagctccctttgaaattcaccatgggctacttttgccatgtcccaagttgttctaagcaggcttaggtcagatccaagcaaagtgagaccgatggcttccggaagcattgctgaagactttctgaagaagagttcttgcttgtagaaccacagtggggtcaaaatgtttccccagccatgtcattttaacttcctccatgctccaaatagatatcccaggagtcttgctttaggaacatctcccaggggctgttccattattctgcataaataattacaaagttggcaagagaggagatagcaaaattgtccttttgtatggagacaagtatttatgtgaatgttttcctcttttccttcctttcattcctcctcagcactgtcaaagcacttttattaattccacatggcagtgtgcagacattagtagagagttttatggctctcctgaaattgaacgaaagggatctagaaggatttccaaggatgtttatgaaaactgaacacatttcatccccttttcatttttggttaaatttaaggctgtaaattgctctttgtcttccctcatcgtttatatttatataacatttgaatgtactttaagagtacagagaaatatacagcaaatacccatgtatctcccacccagatttaataaatgaatttatttcaaggtttttttattttgaggcagagtcttgctgtgttgcccatgctggagtgcagtggcaggatctcagctcactgtagcctccgcttctcaggttcaagtgattctcgtgcctcagccttccaagtagctgggactacaccacctcacctggctaatttttgtatttttagtagagacggggtttcaccatgttgcccaggctggtcttgaactcctggcctcaagtgatccacctacctcggcctcccagagtgcttggattacaggcatgagccaccacacccagcctgaaggtttatttttttaataataaaatacttaggtcccctcagtattctaactttattccccttccatctctccagcaataacatcactattacgaaggcaatgggtatccttgccctccatgttgtcatactatattctaggagtacgtatccataagcaatttatcgtctcctttttgcttatttttaaaaatttaaaataaatgacagcacggtgtaattatcctgcaacttacttttttctcagcattgttttagagatttcttttttttttttttttttttttgaaacagtcttgctctgtcccccaggctggagtgcagtagcacgaccttggctcactgcaagctccacctcccgggttcaagctattctcctgtctcagcctcccgagaagctgggactacaggtgcccgccaccatgcctggctaatttttttgtatttttagtagagacagggtttcaccgtgtgttagccaggatggtctcgatctcctgacctcatgatccgcccgcctcggcctcccaatggagatttctttatactgcattacacgtatagttcattcactgtaactgtggaattgtatctcattggatagctatactgcagtttatccattctcctgctgatggttgctatcgtgtgaatattatagtaggtgtatgtttgtatctatgcatttctttatggcttgtgtatgtgctttgtgtaggggaggcatattcaggcatgctcttgcatggttattaaataggttcatcttcatactaaatgttgtcaaattgctctccaaggtggtcattcacatttataatctcactaacaacatataagggttcctgctgttctgtgtgcccattaacactggtattatccaactttttaattttaccaatccagagaaatgaaatatcatctcattcttgctctaatttgcatttccctgactaccagtaaaatgtgtatcattttatttatttatttatttatggccattttagctgtctcctgtgaatattctgtttgtatcctttgcctgtttttctgttggattgtttttttcttactgatttaggaaaattctttataaattctggatattaatgttttatcagttatctttttatcttttaaatttattttgttggggaggggggtctcgctccgttgcccgggctggagtgcagtggcttcatcttagctcactatagcctccgcctcctgggttcaagagattctcatgcctcagcctcctgaatagctgggattactggtgcacaccaccacgcccagctaatttttttgcatttttttagtagagacggggttccaccatgttggccaggttagtctcaaactctaggcctcaagtgatccacctgcttcagcctctcaaaatgctgggattacagatgtgagccaccaggcccagctggtttaattgaattctaataaaaactccaactagatcttttttttttttttgaagcagagtctcactgtatctcccacactggagttcagtggcacgaatgctgctcactgaagcctaaacctcctaggctcaagtgatcctcctgcctgagccttcccagtagctgggacctcaggaatgtaccaccacgccttgcaaatttttaaatttttctgtagagacagggtcttgccatgttgcccaggcttgtctagaactgggctcaagcaattcttttgcctcagcctaccaaagtgctgggattacaggcattagccaccgcacccagcctccagttggattttttaaagggaactttatactgttactcccaagaacatctcaaaaaaaaaaaaaaaaaaaaaaaaaaaagcaggagcgatatctaaacaactatgaaaaagaagagcaatgttggaagacttgtcccttcagacattaaatattaaaatctgttataaaataccaataattaaaattcagccatgctggccccagagagatggccagatggtggaatagaatacatggccctttaccataaatggaaagcaaatacatgatcaaggaattgtcacaaatccgttttcaatttcttcaacaaagtttgggtaattgcctaaataattggggggtgggagggtagatgaaactttaactcactgtttactatattaaattgcaggtgaatcaaagatccttgaaaccataaagtattagaagaaaataccaatgaacaatagctgatcactgggtggagaatgactttctaagcataaaaaccaagaaattacaaaggaaaaattgatttgaattacctaaacacatgtattttttctgtgacacatacacagtgattaaatttttttttttttttttgaggtggagtttttgctctgtcgctcaggctggagtgcaatggtgcaatctcagctgactgcaaccttcgcctcctggcttcaagcatttctgcctcagcctcccaagtagctgggaatacaggtgcctgctaccatgcccagctaatgtttgtatttttattagagacaagctttcactgtgttggccaggctggtctcaaactcttggcctctggtgatccacccaccttggcctcccaaagtgctaagattacaggcgtgagccaccatgcccagcccacagtggctatgattctcttgtacatttgtacatttttggagggcagtttgacagtaaattaaggcgtgcactcaatttttcaaattttacttctaggaatttatcctaaggaaatcatcagactagtcagatttataaatgagaatattagtcatgctgtttataatattcaataattaaaaatctaagtttttatcaacagatatactattaaataaattatagtccattcagccataaaatataatgttgatcagtggttcctaactttggagatcattgaaccctataagaacctgaagaaactccaaaattgaaggtcttggtatctggttagtatatattgctatcggaagatgtccatactatggacaaaaagctgttgtatgtataataatttttaaaaattgtcatgttgtccaggcgcagtggctcacgcctgtaatcccagcactttgggagactgaggcaggcagatcacccgaggttaggaattctagatcagcctggacaacatggcggaaccccatctctactaagaatacaaaaattagctgggcatagtggtgcatgcctgtaatcccagctagtcaggaggctgagacacgagaattgcttgaacctgggaagcagcggctgcagtgagccgagatcctgccactgtactgcagcctgggtgagagacaagactctatctcaaaaataagataaataaaataaaataaataaaatagtcatccatagaaaaaagcctgattaatatataccagtacattaatgatgattatctctaagtagtcatcattatctttttagtttttctgtatttttgcaatgagtgtgtattatttttataataagaaaaattacatttttaaaaataaaggagaatttagaaaacaacagaaaagtaatagaaggaaataagctagggaaactattagccacctctgtgacatacaaataatggtttttacatgtaaaggtatttcctaactcccagtaggaaaaaaaaaaagggggcaacctgtataaatagatagttcatcaaagaaatgacaccagtagccaattaaaagataacgaaaacacccaatttcactagtaatcaagttagtgaaaaataaaatttttttttttaccccatcaagtcagtagaggttttaaaaatgtgcggtgctcactgttgatgaaagtgtacgaagatggacatgctaatacattagttattggaaagcaatttggcaataatatcaggagccttaaattaagttttttctttttgctatcgtactttggtttgtagtccaatctaagaaaatcaccaaaaattggcatcctcttaaaaactttccattttaatagcattcttgaggtataattgacatgcagtaaactgcacataatgtgtacaattaatgagaatcaagataggaaacatatctgccacccgctgcccccacccccagagttttcctttgtaatcacgccctcctgccccttccctcaccctcccatcctcaagcaacctctggtctacggtctgtcactaaggattagtttgcggatttttagaattttatataaatatggaatataatggaatataaatgtggagaaaaggacattcaggatgtactttttttttttgagatttatccatgttgttgtgtgtctcgttcctttttagtgttcactccttggttttccttttttttttttttcttttttggttatctagacctgcagatgttcactcccttttagtgctaaataacatcccattgtacatcatctgttcacttgttgatggacatttaccaacatatccttttaggaaaaatttgagacccctaaatctgcagaaatagaagggttaaattatgctgttgctgcataatgacaaagggccattaaaaatgatattttagaacacttaacaatacagttttacttataatgtgttttattgggggaaaacaggatataaaactttttatttaaaagatatatataccatacacatcaaaaaaagagacaggaaaaagtagattggttagattactaaatgtttttattttccttatcatgtttatcactagcaagaataaataaatgccatttaaaagaaaataactaaactaaacatgcagttaccatacaacacaacaattgacttttgagcatttttctttgggaaatgaaaacttaggttaacagaaaaacttgtacacacatgttcatagcagctttatttgtagtagccccaaactggaatcaactcagatgtccttcaacagatggatggtgaaactatggtatatccatactgtgggctatttctcaacaataaaaagaagaaaattattgatacaggtaacaacttggatgaatctccagagagtgctgaatgcaaaggcccattccaaaaggttatatgctgtgcaatttatataacatttgtatagcattctttttttttttttttttttttttttttttgagacagagtctcgctctgtcacccaggcaggagtgcagtggtgccatcttggctcactgcaacctctgcctcccggattcaagtgattctcctgccttggcctcctgagtagctgggattacaggcgcacaccagcacatctggctaatttttgtatttttagtagaggcggggttccgccatgttggccaggctggtctcaaactcctgacctcaggtgatctacctgccttggcctcccagagtgttgggattacaggcatgagccactgtgcctggcctatagtgcattcttgaaaaaaaaaaaaaaaattggccaggtgcagtggctcacgcctgtaatcccagcactttgggaggccgaggcaggcggatcacctgagatcaggagtttgagaccagcctggccaacatagtggaaccacgcctctactaaaaatacagaaattagccagatgtggtggtgtgcgcctgtaatcccacctagttgggaggctgaggcaggagaatcacttgaaccccagggggcggaggttgccgtgagccaagatcgtgccactgcactccagcctgagtgacaagagtgaaacttcatcttaaaaaagaaaaagaaaaaaaatgtttttagaaattcaggtcagattagtggctatcaggagctaaggaccgtggaaagaggagggaggtaaaaggatccttgcaatgttggagttgttgagtatcttaacattggaggtgaatatatgaaaacctacacaggtgataaaattgtgtagaacacacacatacagtaaaacaagaaatctgaagatcagtggattgtatagaagtcagcatcctggctgtggtattatactatagtttttatagaatgttaccactgcaggaaactgggcaaaggcctaagagggatctctattatttcttacaatggcacctgagtataagcagtcatctcaataccaatgtcaatttgaaaagaaaagctctgaaggcaggggcctctgctgagctggaacctggttctgtgctggagctgtggctgggtgtggtttgctgagaagcccccggggctgttgcccaccttgcttctgccccttgttcctgcagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtaagagacgcagaagactcagatactccccaggcatgctcatggctgtgggcaggaagcagtgagtgtcggtcggggaaagtgtggtttcccttttatccattcattatacttcccacaagtcagttttcacttcctttaagcacttctatgttgattgactagtctctttttttctttttttgagacagagtctcttatcacccaggctggagtgcagtggcatgatcttggctcactgcaacctccgcctcctgggttcaagcgattcccctgcctcagcctcccgagtagctaggattacaggtgtgagccaccacgccaggcgattggctgttttctagattttcacagcaacctgtaggattatcgactccattttatcaacgggaaggttgaagtcttccagggctagaaggaatcttgacttcatgtctcataggaggaagttagggcaccgagagctcaaggggtgaggcaggactgcactgccataactgaagagggcacttggtggcaccaggttgcagcccaggcctcacgttccagcctgtgccccctttagtagccatcattgtgagctgctttaacaatggacctcacacagagtgacagcagtgagggtttcctggacaccaccactggcctcacctgaccaactgaggacagagataagacatttgtttgaactcttaaatttttctggtaatctccagaaaagttatatcccctttaatatttatataatatttaataatattgtggtttttattggctacacataagagactacattaataatgggtagaccttgagggtgtagccattttatacaagaaataatgctcatgatgttaggtggttttttttttcttttgcttttttgagacagggtcttgctctgtcacccaggctggactgcagggacttactggctcactgcagccttgatttcccgagctcaggtgatcctcccacctcagcctcctgagtagcaggggactacaggtgcacgcctccatgcctaatttttgtattttttgtagagatggggtttcaccatgttgctcaagctgttctggaactcctgggctcaagcaatctgcctgcctcagcctcccaaagtgctgggattacaggcgtgagccaccacatccagcccttaagtatttattataaggcttaccactatattaaaccaccaccctatgcccaaatcatggatagcctctcccttgtgtgtgatgtttttatttatttagaagataactttttatttcatacagtgaagaaatggaagtgtgcaggcctccatcaccagcccctccccatgcagcctgatggcagagcctgtgcctcttcatttgcagcacctagctcagtgcccagcactgaacagccacctgcagatcttctgcttcagattccagttccccagccagggctgttttgggttctctcttttgttaaagtggcaggtcatttgtaggtctgagatggtaaagtgcaggttatttctaggtctgagacagtgaagtgctttgaggagggagggttgtggtgggactggaaatggggtggagaggaaccatacctgctatggtggatggaactgcttcaggcctttacctgcctgtctcaattcctggacacacaggtgctgatccaggctgaggaccgcgtgcaccgcattggacagaccagctccgtgggcattcactacctcgtggcaaagggcacagctgatgactacctttggtatggcttggttgggtggcctggcagttggagtcgagcaagggtggaaactgatgatatgtttactttgctcccaaagtgcttctgcttttgctaagtaaggtctttaaggatctatagaaaattgactagtgatgccctcctgctttcatcatgaccatatttggcctccctcactagcgttcactggtggcttgcagggtgcatgctgaatcttatagcaataaggggttgtggctccttttgctgctggtctgaggcagggagaagtgctgattatgacaaaatatagatggaatttagtttgtaaaacaccctgttcccagctgtgaaggcatttgttaggacagggtgacagtcttttaccttttatgatgtgcatttatctggtgggcacatcttacattgctgctgctggaccacagggagaaagtggcttaccctggactgtgtagtgtacttcgttagcagagctggagtaagattttcaaccctagggttttctgtctgttacctaagtgaaaaatctcaaaaagcttcttccccttatctcccccttcctgatacaaaatttcttgattatctcatttgtttccactgcttgtctctgtttccagccttatgactaaggagtcttccctttgcaatgtgtgtgggtcactcctacttccccctttttagtggatttgttaattgggcagctcataataccaccagattcaaaattgtgttgaaatgaggcagcatttatttcctacacatcttccattagaaagaatattgaacctgatgatattcttagccctaaattggagtttttacaaatgagagggggcaaatttttcaagatgggtgtttgcaccttgagagatgcagagatgtgaaaccgtaaacaagccgttgtcccataagaacaaggagggtggcctcattttcattagtctggtggttctgtgcaggttgtattcactgcagctcatttctccccaacaggcccctgattcaagagaagattaaagttctggcagaagccgggctttctgagaccaatttttcagaaatgacagaatccactgattacctctacaaggtaatgccagcacatggctcttcacccctggagcagagggaggcattaagctgtctgccaagtctttgggtcctgagtaggaggatgtgaatcactcctagggacctcccccagcctagagctgaaaacaatggcctgcagtcattctcagttgaaccatgcatgcatcgctttatggggaaatgatggcattagctcctacagctgctgacattcccgcacaggctctgaatgctgcctcttccagcaggccattagaaactgacaaaactccccatggcaaatgttgaattgtttcaaaaagtacacagcaacaccacacatagggctgccacaggaatgcatccccagcacagaatggggagtgtttaaaatagggtactggcttcatagaatatattttcccttctgtcattttatttattctcagtgtctccccacttgatagaggggtaaactgagacatggcagtatagtaggtttgcacaaagtcacagggcatgtgaagccagcccaaggaagaaggcttcctgacttggcccagcattcctcctttgagctcagcccttgttgtaaaggagtataagaggcatccctccatgaccaggcaggccttgtcaaaggtgctgagggggaaggctgttgcctctgaacaggacagccctgggcccatcatgcctgcctggtttcagtgctgcagcccagtggctgccacagactcttcctcccccatttcagtgaaacacagtggagtgagcaagagacccagagccttccaaaagcttgttttccttccccagcttggattgttggccagaaggtgaaaaccaggagtatgccctcctcgagcacagctcatggttgaattgtttctgccaggagagtttgaaccaggtctgagcctcatgcagaaaggggccttacggtagcttatcaggaaagtgaagcacctcctccttcctgtgaaatcaccatcagaatattgagttaggccacacatggtggtgcacacctgtagtcccagctactccagaggaaaaggtgaggatcacttgagcctaggaggtcaaggctgtagttagccatgatggtcactgtactctaaactgggcaacagagcaagagcctgcctcaaaaaaaaaaaaagagaaagaaaaaagtttaaataaataagaagttgagttaaatcttatcgttgacaccaagacttaagactctgtggatctgctcattcacttacatttatttagcaaataaattctttctttgcaaggatttatttgctaaatattgggataaataagactcagatcatatttttaaatgcagactgcaaattatcctttcagacatatatagttaataagccaattttaaaacaaccttatttttaagctttttaaagaactctccagttcagctgaatggtaaatggtaacagagcctaggttattacaagccttttgaaaagaaatagtctgagcaggcatagtggctcaagcctctaatcccacactgaggcggacagatgacttgagcccaggagtttgagaccagcctgggcaacatggtgaaacccccatctctacaaaaaatacaaaaattagccaggcatgatggcacatgcctgtattcccagctactcaggagactgaggcaggaggattccctgaacctgggaggcagaggttgcagtgggccaagatcacaccactgcatttcagcctaggcaacagagacagaccttgtctcaaaaaagaaaaaaaagaaagcctatttttaaaggattctcacttgaactcatttattcctccttgcctttctcttactctaaattggttaagcatttctacctaaaatataagtacaaggtaatataaatgagttttatcaatattttgatcaataactatatcaatttattttttaattaagatggggctgaaaattttatcaactactagaaaaagaaaatgttgcttccaatataggagacaaaagcagaagaggttatatctcactgagatagccttccttctgagaggggaaatgaaatattaatctgatcttggaactcgcttccaattaattatgcatgccccgagtcagcatacagtgttgccatcatcataatcaaatgcacattagcagctttttctacttggaataggctgccttgcagggtggcgtttccttgacattgcagtcattcagaaagaggctgatgagggcatcctggaggaggacatgtgggttatttgggggtcagccttgatgatctttcatatcatttccctctctgcaaggctgggatcctgaaaggctaggagatttcgggtgcaggttaattgaataatctggagttcttacatgacaggctgtcatgatcaattttcaaggaactctacttcaccaatgtggagggatttggttaaggaatagtgaggaacagtggccaggtacgttgagacctaattctataaaggcctgaaaagccaggggagcaactgtagacttgatgaggtagggacagcggagcccaaagacatgaccaaaaaaatctttaaaggagagcctgggggtaaaaatcagctggcaaagatctgtaggctgtttgaaatgggaagaagcctgaggcaggaagcgcagttgagctgttgcaaatccatgcagtaccaagtgatgtggcccaagtaaagatggtgcctgaaggagagaggagggaactaatggggggaacaaacttgcataagccgaggactctgtttgcctggatgatttccacctgggagactacgagaatgcaggtagactataaaaactagacttatgggaagagaagctgctttgagaatataggagatgagagatcatttgattttttatatttatttatttatttatttatttagagacagggtctcactctgtcacccaggctggagtacagtggcactatgctggctcactgcaacctccgcctcccaggctcaagtgattccccccatctcagcctcccgagtagctggaactacaggcgcatgctgccaacacccggccaattttctgtatttttgatagagatggggttttgccatgttgcccaggctggtctctaattcctgagcttagatgatccccccgcctcggcctcccaaagtgctgggattacaggcgtgagcccttgcagcagccttatttttatgtatttattttttttttgagacagagtctcactctgtcacccaggctggagtgcagtggcgtgatgatggctcactgcaacctctgccttgtgggttcaagcgattcttgtgcctcagcctcccaaatagctgggactacaggcacgcaccaccatgtctggctaattttttgtatttttagtagagatggggtttcaccacgttggccaggctggtctcgaactcctgacctcaggcgatccatccgcctcggcctcctaaagtgctgggattacaggtgagagccactgagcccagccaaaagatcatttgattttaaaccagtttagttttatgaaactgtgggatgtcagtggagatatggaaaatatacctctaaattgaaaaatggtcaaagttggaaatttagatgtaggaaaaatcggcagaggggtgatagtgatcgtgtgttgtggttgtatccactgggcatggttttaacactacaccattgtcatcaatgtatagatgcagttggtgggtattttgattatttgtaatttaaggtaatcagaataggtacacatatctacttatgaatatgttaaatgtgtgtatgttttttcaactactttgaaaattaggtataagccatggctgaacacagagatttggaagttggggggctgggcacatggtggctcacacctgtaatcccaacattttgggtagctgaggtgggcagatcatttgagctcaggagttcgagaccagcctgggcaacatttagtgagatcccatctcttaaaaaattataaaaataaaaataaatttaaaaatagagatttagaagttgaattataccttaactgacccttagtagagaaaggctttggaggaagtgagatcttgggtgctatttcagtattgaaataatgatttggaaagttcaaagggagaaaacatttccaatgtaaattatagcgtgagagcagcttctttgttgcactcacaaccatttctttttcctaactcaatgagcacagagagggtaagatgtcagacactaaaacagtgaggctgctttagtgatggtttgctgagatgatgcacacttgccatcgtgtagctccctgacaccatgaaatgtgtggtctctcatctttatattctctcatcagccctagtggaggagagtcagtgttggagcctgggctcttccttttatcttttgttttctttctctgatgaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaa

SEQ ID NO: 2771 - DNA, 10911 bp, Homo sapiens
  source 1..10911: mol_type = genomic DNA
caatagacaaaaggatttatttggaaatttccaaacctgccagatgtggcactcgccaagccctaggcccaccctcctcaccaagctccaaagggcaacaccagtcctcccagcctccccattcaccttaccctggcctccacatgcacataccccatacctcaggccatgctagagaactggagtgtcccctccccggcccaagccgctggagaggcagccctctggcatcccaggagatgatggcggccagagccgcttgcatagattgaggaaagaaaagaaggaggcacctaacaggctccctgaaaacccccaacttacccctgtacaaaaaaagtggctcccacatagaaaacttgctcccaaaatagtgcaaatacccaaaggaaaggaaaaaaccagcagcaaggctgggcttgtaggaatggcaaagaactttggtttagaaaggctaggaagagtctgggctgcacctcctcttcctagcccagctccccagagccagctctgaccctcgccccagggggagtctgtaaacatgcaaacccagcagcctttggttcggaaatgtcttacaatgtcaaagcacagcctccagcagtcctacttgggcctgcctgcaggggggcagaggaggcatctgctgaacccaattaaagccaatgcaaaaagtataaggctttggggaccaagcaacaaggaatcctatcactacatttataagactaaagctggagagtagagggtgacagcagacactcctcaccccagcctacgtgtctgcggccccagcaaggacccagagggtggtctccctccaggctccagggctgggaagaaagatccctgagcagttaggtcaggcgaattcccagcacctgttccagttcctgccttcgctgctgcacctggagaagggagaaaccaagtggctcaggcctttgctactcacggccaaaggagggaaaacagggcagagcctcaccttggcaaagatgtgcctgcctactgcttcctgggcccagggctggtggtagaaagcagctcgtctctcctcctcaggatttccaatcacatcagtgatgatctgcaaagagccaggaggaaagccatagcataatccccacccctgggctaatccaccctgggaactgctgtgggtaaaaatcacccagagctttacataggagtcccctcgggaaagaggactacaccttgaggtctcggcgctgggaacggagccattcctggatgaagtcctgggggtcggtgctaaaactgagcatgaaatctctctgggtcttcagctggttgatggactcaatggtctcatggatctggagagggtacctgtgtcagactgtgcccccaaagcttacatgcaagcaactgagccagagttcccatcccgtcctccaggtgctacatgtatggaaatgctggacagagccagcccaccccaatcctgggccccagaggaagctgtggagccagagggcccaccttgacatcaagggaggcgatctcctgctgattggtggtagaggccagaaaattgctcatttgggccttcagtgggtcgtccacctccacatcgatgtcgtaacaggctgtcttcttctggtcgttagggtcgacactgcaggcagcacatggggagggaaggcacatagctgacttcatcctgcccacctgggccaaatctggggcccattctctgcacacactcagggaaaaagaaacctgatgctttctttggctttagttcaagccaagggtgaatctgctcttagaagagccttcctgtccccctccttgcatttacctaatgacatggttgatgacaatggggtctggatgctgcagcaaccctgccagcttcatgggaatctcggagaaacggagtcggccacaactgaagatctggaggaaatacgaaaggctcagcgttggcttgtgggcacagtggagtggaccattccaggaccagtgagggcagcagtctgcaggctgtggccaaggagtagcccagcaggcaaggcaaagcaagggctgagaaaacgggggctggcatctggctaacctggcggaagtaacggttgcagttgatgtactcccgctcgtgcccatcctgcagctggttgtgcttgatgtaaagccacagggcctgcatgatggcggccctcgtctgcgtgtgcactcccagcagccttgccaatcgggggtccaatttgtactggggaggctggagttggatggaggggagtcagaacgggttcttatagtagaacagtgggaaaatagggcagggacaggaagggtttctaggaaccagctcccctcctgaggggtccctgtgggcccagaaatgaccccagggtctctgtcacctgatgatccagcatgagcaggagggtgcacttgacgttgaggtctccaggccgttttacttggaagccatctgtctcctgggtggtgggcatccggtgccactggcagggagggaagcatggcttatcaccaagggggtgggcgtgaacacagggcctcccaagggccctgaggccatttccctgccaaacctgcacatcagcctgcttttgccccaggcccactctcacctccaccaggtgattgtcaggcccgtacagctccttgtccagctcaatgacgaggctcttaaagaatgaagaaaacttcctcttctgtttgctaggctggggatggaaaggggtgtgagatggtgctgctgagctctcaaatctcaagctatgctaaatcccaagaaagagaagccccatttcagccctggagctccggatactgaagattcctgggccctgaaggatggaagcaggactctgggcagactggaggcagggaaatggtgccctcttgcagcccacgagggacttcctcgagacactcgactgccatctgcaggaacactgtaataaccacacaaatcaacctccaacgggcttggagcagcgcccccctccctatggcaggacttctctgggagcgcccaagtgtctggcccagtctttttttttctgagacacaatctcactctgtcacccaggctgaagtgcagtggtgtgatcataactcactgaagctcgacctcctgggctcaagccatcctcctgcatcagccttatgagtagctgggactacaggtgcatgccaccgcacccagctaatttttaaattttttgtagagatggggtctggctctgctgctcaggctagtatcaaactccttggtctcagtcttaaacccacacaggcctccttccctccagaacctccctccccaactcacatcatccagcagttttccttccactcggagttcccaggaagccaccttgtcccctgctggggttcccccaggggtccctgcagttcctgcactatcgccttccgccttgctgggactgaacgtattggaaatgtagatccgaagctttcgcttttgctaaagagagaaaggcaatcacaactggaggtggaccaagatgctgggacacagtgctaccgcatcttctcatatgaaccattcaacaatcagtactgagcaccatgagccagccaggcaccttgtcaggtactgggaatcagaagtagtaagtcccagtcccagccttttttttttttagacatggtctcactctgtcacccaggctggagtgcagtggcgcgatctcagctcacttgcaacctctgactcccaggttcaagcgattctcttgcctcagtctcccatgtagctgggactacaggtgcgcaccaccatgcccagctaattttttgtgtttttgtaaagatggtatttcaacatgttggccatgctggtctcaaactcctgacctcaggtgatctgcccacttcggcctcctaaagtgctgagattacaggtgtgagccaccgcacctggccggaactcaccattttatggggaaagagatgcatcaccaacaatgccagcacagtgggactggtgctacggcatgatggagtaacacgcagccagtctctggctcacatcttacatgaaacccaaacacccatcacggctccaaaatatcctagtcccctggaaaggcttcaccactcgggactgttctacattattattaagaaaagcttctcggctgggtgcagtggctcacgcctgtaatctcagcactttgggaggccgaggcagtcaggagttcgagaccagcctgggtaacatggcgatactaaaaatacaaaaattagccgggcgtggtgacaggcatctgtaatcctagttactcgggaggctgaggcaagaagaattacttgaacctgggatgcgaaggttgcagtgagccgagatcgcaacactgcactccagcttaggtgaaagagcgagactccatctcagaaaaaaaaaaaaaaaaaaaaaagaaaatttctctatggatggggaaggggaaggagaaaggaactacctttatcccctagtctagtggttttcaaacttttgaccaccacccataagatttacattttcaattatgacccaaggtctgcatatctatttatcagaaacaaaaatgtcatgaaagaatccatttactactatggtaagtactactgtgaagtattttaagattttctactgtcatatattcatttaaaacatactggccccaacacattcaactgagttcgtactctactagtgggctgcatcctgcatgtgaaaaacccggctctagcccaacttgcttggcccctggaaaacaagggggtggaaggcaaggaaacctgggaaggctagaggtggtcagggccacacatactgtcagaggctttttgatggcctcctggatctccatccgcttgcgagcaatggtctggtccagcttccgctcaaaagccaagagatccatgtacgcctgagactctggaacaagctcccggatctgaaggaaggtagcagaagctcatcagcttgcttcagccaaagcctggctctttcctcccttcctgctgcagcccagctttgagagagatggacacccaccccaaggtggccactgggcaggcctcccaggtgtcctcttaacacttactcgctgaggtagaaccttatctgccatcttcctcctctttaacctggggaggacagaaacccacttaagaggtcaatggtccaaaaaaggacactcactcccataacgcccctccagtctccaggaccctctcccccaggagagcctggagtcatcctcagtcaccaaagctcttaagatagaaggaaaccctctgctaccaccagagctgagttaggcagagtgagagaagcaggatgctcttacccccggcgctgggcaggcatgggaggctgcgcctggggcacaagcaggcgttttcggaatggatccatcatggtgggtggcatgccaggtcgaagcggagctgctgcaccaaatggggagccagcagggggtcccacctgcaagccagccatgggcatccggttccctggtgacatgccaggtcgctgggggaagtgagccaacgggggtgcataggtcaggggcaaggccctccgggacccatagcccatgccctccatccctctcgtcagccaggtagggcctgagcagcacaccagagccctgctggagccccaggaacaaaggggagtgggcgcctgagcacagagtgtaaaccacacctgccctgccccctgcaaccgccctggcagccatgccagcgaatgaggcctgccagaacctgggctgggaggagggtcctgcctgcagagggaagggccttggggagcttttcagggcccattgctaccttccagccccagcatgctgtgccctattccctgggcaagctggtccctattctctcagacagtcctgccaagccctgccctccttctctttctcccatcatgaagaagaagcatggctgagaggcacaggggcagtgtcactgccaggcagaggagtgtactatagtatgagtaggccaatggcgcagagccccaatccccatcctctgtggccgagggagaaaggggtctggtaggcagcagcaccccaggtgagcagggctgcaacaggatggcttggaacgtgtaccagctggtgggggtggcctcgggcagggtacagggaccctgtaccctgtagtctggtatcacatagcccccacccacagcccagaactggaccctcctcttacctccctactgcccaactactacccctatgacagaagaccccagaagggaagctatggctcctgggtggcctgtgggaaagagagcagctagcacctggactctgccagtggtccaggcaccacctggcagccaggactggctctggctccgtgtagccctggcaatcccaagctggagaagggggctaagattatcctgggaggcaaggatagaggcccaggctgagcagcaggaaagtgggagacagaaatagcttctttagatgcctgcagaaggatttcccacctgaggccttgctccctgacatttctgtggagcccatctgggagtcacctccacccccacccgcctccccatggctgctgcctgcaaggcctgtttggcagctctgccttgcacacactgtccctggcagcttcacagggctggccccagggcccagattatgcaacgagcacaaccagccaaccaagcccggcagggtggagacttgtaccaaatcaaaggaccctcccccaccccagcatcatggagatgagattcttccccaacctcttcatcccgcactaaacccatgttcccaacacagagggtcagattcttgaccagatgcggagatggaaagaaacatgacccacagacgtgaggatggggagaggaggagcagggtgggacggaagtgtttgggagaataaaaagttcaaagtggggggctctggggctttgggagtcctgccaaagtctctctgcatcaggaagagattaatcagagctgttgaaaggcaaaagacagcctctttctctgccttaaagattgttctttctctggcctgagattatagaaaaaaactaagtgtggctacagctgtaagcccaggcccagacatcccagactagtttttcctagtgcctgagacaaagacagggaagaactgaagcagtgggtcctgcagaggtgagcgagggccctgtggtccccaggaagctccctgctgcagtgttcacaaaacctgcagcaccacccatccctcctgggcaggtgctccggtaacaggaagtcccaagacaaggcctcataggcagggtctggaataggctccacccagacatctgctccaggtttcctgggcccagagcccctggctcactcagggccccaggggaaggctgcttatagttcaagtcccagctgagccttgccaagctccatagggcttataggcgctagcaactcctcccacttcaaaaaacaaaacaaaacaaaacaaacaaaaaaaaacaactcaggagttaaagaaaaaaaaaaaagcagtccagcactctgagcctccctaactccctgcctgcagcaggaccaggtaggcctggatcaatcccctgaaccccagatgaggaatccagggctccggtgagcgtgctttgccctgccccaaatgtggccctgatgctcctggaacctgggcctgagggcctcagttggggaacataccacccactctcccatgagtaaaaaggattttgaggccgggtgcagtggctcacgcctataatcccagcactttgggaggccgaggcgggtggatcacaaggtcaggagttcgagaccatcctggccaagatggtgaaacctcgtctctactaaaaatacaaaaaaattagccgggcgtggtggtgggcgcctgtaatcccagctactcaggaggcttgaggcagaggattgtttgaacctgggaggcggaggttgcagtgagctgagatcatgtcactgcactccagcctgggcgacagagtgagactccgtatcagaaaaaaaaaaattttttttttgaactttttgaactctctggagtgaacccagcaatctgaggtttttgttattttgttgcccaggctggagtgcagtggcaggatcatagctcaatgcagccttgaactcctggactcaagcaatcctcctgccacagcatcctgagtagctgggaccataagcgcacaccaccatgcttggctaaatttttttttttttttttaagagatgatggtctcactatgttgcttaggctggtcttgaactcctggtctcaagtaatccttctgtctgggcctcccaaagtgctaggattacaggtgtgagcccaccatatcctgccctggaggtttttttcttttctttttctttttttaggttcctctgttaactgtgatccacagctagaaccaccctctggaggaagggaggtcatcacttcccttctttcaactatttgctcagcttgggcctcaaattctcacttttcaagtgcatctcatgagccctaacagacaggaacccctttgtttcccagatctcaagtcccttctcctggcagtcatacaactggacttggaaagaaggcaaataggatcctcttcaaactcagccaaagttagctggctgggttctccttcccatctacctctcctgccaggaggaggaaagctagtgggatgggaaacccagactcagggccatctcctacttccgcacagctagcagcccaggcctaaccagccagccagcttggccttgccacaggcccaaggccaccccccaccaaaacatgtggaatccatcctctcaggggctgtcccaagggcacatttcctatggcttgcatgccaaggaaactggagcggcttgtctgttccaggtccttccaaggccaaaggcccacagatggtgcccaggccaggtctcagtgggcaggcccaagggctacaatgaatgatgcagggagccctcagcaacaccctgggcccatgaatccccaacggggacagcaaggtgggagagatgagccccagctggaatccctgggaccaggtctgtctctgcccatacccagactctcttttctcttgagaaaggaggaagaatgaggagtaagaaggaaaaaaaaatccagtcactgtccctagttaagccatctccttagaagtgagggcccagtggggcaggtaggctgtgtatactccacgaggatccctaaggacctctgcctggagacatgagtcgaaaacagaggaagcccacagcaaacccgtagatgagcaagaagccagtgtcaaatgcttgggcacatggcttcggacgtggtggagttagaacctgaaggccaaataaaaatgcagagagggtgacaaggcagatgggcacagtttccaagccctctggggcaacctgaacagcagactagagcactggcagggtcaggctgaggtcctcacacactgagcagaagtcgctgctttgcaagggcttttgaagctgcaatctgagcagctctcaaaaccccaaaggggtcaggacagcactctttgaagcaactctcgcagactcctccggccccagaccagcagggctccactctgcacgtccagactaatcaactcccggacacgatgacaggaggcagaaagcccagaagagagccggcctgtgactgggctgggcctcccctcaggccaggccaccaccgtctctggtctaagctggagtcctcccagcgaaggcgcctggccctgcctcaggagtaaagtccgcccgtgcacaagctggaatcccctggccctagcctcagcgtcccgtgcccgtgggaagccaggctccttcctccttattagcagccgggagccatctcagacacgctagagctccgccagttcccaatcagaaaaaacagggcagacttggactgggaccaaggccgatgcagggtaaccccggtttctcagcgagggccctttcccaaactttctcatcactttccagccctcctaccctagacttctcaacccacccgccacaattcactggctccccaaactcctccatctcccagtcactcggaatccctgtgccgcggaagcccccaggcctcccagctgcttccagccctccgctgcagaacctgcttccccttcccacttctccaccgcgacccgccgcagcccgagggtcccggcccgccctccaccgtctcccggagttcctcatgcattccccagggccctcactcgaggccccttcagccgccggcccgggcgccctcgcagcgcctctcgcccccgtccgctcgcgtcctccttgctcacctggtactgcgccgcggggcccgcggggcccatggggcggaaggcggcggccccggggccccccacgcctcctgccggacccggtccccggagcgccggtccgggcagcatgccgggtcccgcggggggaggcggcgctcccagggccgcagccacggcgccgccgccagggcttagcgggggcagcgggaacccgcccgcgcctcggcccgacatcgctccgtcccgtcccgcggtgccgcgatccggactccgggctccgcgtcgagtccactccgtgctctgtgctccgcgatccgggacttggcgatcttaattccgggttccgggatttgtcgatccgggctccgggatttcctaatccaagttcgcgagttcctcacagacccggttcgggacagattccgctcctgcccgggagattccggatccaggatctgctgcgggcccgccttccgtccccggcctccggaggtttggccgcccgagtcgagttacccagaggcggctacgaactccctgccccgcccaac

SEQ ID NO: 2772 - DNA, 36944 bp, Homo sapiens
  source 1..36944: mol_type = genomic DNA
ttttgtttggctgaggggagcgagcggcgctttgggggaggggtcgcgtaggcgcctcacctgaccctgcggccgtgcggttgctgctccggggcaggtctccttccaggccaggggcccggaatcatgtacataaagcaggtaaggccttcgcgtccctccaccccgtcatgggccggtaagggccgctccttgaggcgggagtgttgcggcgccacccgcagcctctcccctgtctccacaggctggaccagggctgggcggggactgtgggggaggagggagacccgggtcccgctagtgccccggctgcggggtcgcggagaattggggcactcctttgcagccccggcctccctgctggcgcttgtctgggagaggcaggatctccgagaggtgtggaagggccggcgggcgggccgctgggagggactgggccttcctgggtggccccagagctggcggggggcaccccgccggggcggccgcgggcgggaagggctgtgtggtcctgcaggggtggcctcacacggcccatgtgcctgggatgtgtggaaaggtggcttccccggcccgggggcggccctgggggcattggctggggtgtcgtcacctgtcactgcggggagccgttcttctccccagttaacccgcgaagtgagcgggaccctcctgcttgcaggatacggagcgccgcctccctcggttgtttacttctgtcaaaatggtcttcccgcgcgggactccaccacaaagatgagcccaggcacacggccttggagacggttttctgttgggtctgtcgggctctgagcactccttctttggaacgtgggttctttcaggctggccggcgtgagtgactgaaagcagcactcggtggtcttggagtcaggagagctggggcccgtcggcctgcttttatagacttgctattgtactgcagcgtttagggttcagttaagctcacacagtgtttttgattttgaaaggtccttaacaggttgacagcataactcctaaaaaaaaataaaacccagcagcattgccttggcaaagattaccgataaaagtacctttttttttttttagcagatttttaatcaccactttccaaaatgaatttttcttatatgaaatttcgagttttctatattgcattaaatgaaaaacaagaaagaaatgcaagagaaaaatgttaattttttttgtggggtgggttctcaaaaatgttttttatttactaggtgattatccagggttttcgaagttacagagatcaaacaattgtagatcccttcagttcaaaacataatgtgattggtaagtgttcttggtttactcggtcatatttatagtctatacagataatgtaaattctgtccatttctatattggcttaaggagacaggaattgtctttgaatattaagttatatttttctgcgtgaaataacttttctgtcttattgcactgatgaattgcttatttttataaacttaaaatgtttggataagacactcataagttatccattttttatctaggtagccttgtatgtgtgtgtaagagtgttttaaagcatttccgctcttctgttcttgttatatatcctagtgaaaatgctgactgttgccttatttcagagacagacaatttttattcacaaagtagatgccaggattccccccccaccccggcagtcagtgtctctaaggacagaccatgtagctagattggaagagcataaactttggagcataacagaatggggttcaaatcccagttataggggggtgggggcctgggggagggatagcattaggagaaatacctaatgtaaatgtcgagttgatgggtgcagcaaaccaacatggcacatgtatacctatgtaacaaacctgcatgttgtgcacatgtatcctagtataacaacaacgaaaaaaaaaatcccagttgtggcacacgttctttttcactttctgagaagcttcagttttctcatttgtaaagtggagatgatacctgtctcatagggctgttgagaagattaaatgagaaaccttatgtaagtgtgaagataaagagctaatggtgattgccattaacaatatgtagtcattatagattgctcagattgtagtgtgcattttgctgatacagctaacaaaaatgttttctgacactctgctgagtattttacaggatagatgaaaggagtgcttctggacaccagaaacacagactgctgttgacacagttttgctgtacagagtccaaactaagtggtgtattagtttgctaaggcagccataacaaaataccatagactggtggcttaaacaagatattttttttctcatagtctggaggtcagacatccatgatcaggatacctgcatggttaggttctcgtgaggctctcttcctggcttatggacagctgctgtcttgctgtgtgctcacatggccccatcctcatgtcctcatttaaccataatcatcttccaggggtccccatgtccaaatactatcacattcgggattaaggtgtcagttgtttcagggtgtcagttcaattcagtctgtggtgcgtgggtgagattcacattactaatgtttccagaagacctttagagaatcatacttcattttgtataaaatgataaaattgaaggcaggtttttttgccctcgatttatcaatagcagccttgtagttgggaataaagaaggcatactttttttttccctgcttgtgctctgtctactgaagtcatttaattgaattgacatgccatagggtggcttaattgtactggggttttgcttacatataagtactttctgatttttttcatcaatcagaaaatctttagaaatgtagaaaaataagaattattagatttctgttttctttaacttgcaccttaaaataagtaccttaatatttcatttgtgtgattttataaatgatctgtaacttactagctagaatgattacattttgtctataaggtccatcaaataccattgttttagctgttatcagttagttgtgttacctctgtgattgcagcattagatttgttaatagtcactgttacaaaggaaaatggttttgtttaactaaaacaaatgaacccaagataacagtactgattaaacatattttaaaaccagacacgttgtaagacataatgtaagaaagaccaaaagtagttaggtactgagatttgccttaaaaatatctggtgaaagcataccactttgattgatgaatgatgttgactattaaaaaatatctcttgtactgatgttgggtatatgcatcaaacatatacgtttttagggatttttttccccctaacctttaacaaaagaaatacatgttatagaacattatggaaaagctaaaaggaagaaaattaagataaactataatccttttactcagagataaccattctttgttttttactgcacaccatgattcttcagagataaccattcttaataataacagtctatacttgtgattagtcctggtttcctagaaaacagcacagacaggattagctgctaaggctttgatgggaggtgcagtttgagggcaagaatgaagagaaaagctggtcatagatttctaaagaagagacaggtggtttgcagtcatgttaaataactcacagactttgtggacccaccataccttagaaaggtcagatgatagaggaatggatttggattctgacaaggatttgtttgcaggcacctgtctttcattggtcaaagttttctacatctggcattgatgcctccaagcttttggattgtggtgctctgggaactaacacccggaagtagtcagggagttatagcctcctttccatgttcacaattcaggagtacctgaatgtactcccaaggtagcttgaatctaccagaggtattaggagactgagcttttccattgattggcagccaaggcctgggttgagaaaggtgaatctggggccacatataaactgtgtttacctcagtacgtttttagtctttgtatacatctttttaatatatatttaaataaaaatgggttcatttttaaataaaaatgggttcatttttaaataaaaaatgggttcatcatataacttactggtaatctgttattctccttcaggataaatcttgaaatatctttattaaatattcagcatcctttaaaattgctatatagtgttccactctagcagtaattcttaaaaggaaattcttaaaatttcagttatttatagatggattgtggtttgaaatatttattcatttaatgataaattgtcatcttaaacttttatttagaaatagtttcaaatttacagaaaaatttccccaataagaactgttcagagactactcataaaccctttacctagattcacctgttgttaacattttccccacttgctgtatcatttccactttttacacacctttttccttaaagttatttacaccatggtcctttacctctgactttaatgtgtactttctaagaggagggatgttctctttcataatcacagtacaatttacaacttaagtaaatttaatacatagtaatctgtccattttccagttatgttgactgacccagaagtgttcttgatagcatttttccccctccagtacaggatctaatttaggagcaggtattgcatagttgtcatgcttctttagtctcctttaatctggatcatttccacagccttcctttgtcttttataacattgttatttttgagaattaagacataagtgatgttgtgtccctctcaggatatcacatctggaggcacatgaggtctgtctgactcttattgatgatattacttttgatcacccagtcaaggtctaatgtttccactgtgtaggtattattttttcccttgcagctaataagtaatataggcagatgcttttggaccatgtaaatcttgtgctccttttcaaactttgtgcctgcatttaccatctgttgatgacccttgcctttattctgacggtcacaaaatgatttttcatttccagcactcctttcacatttacaacttggcatttggtaattctcctccttccttacctacttatttatctttttattattggtatggatgcatggattattccccccaccaataatttataatttatttggccattttgatgctcagattacccctagttttagctactgaaaggccccttcaagctggctcctgtgtctgtcatatgcgtttttttaaaaagtacatcctttctggcatgacatgaatgatctttttgagatttactttgcattaaaggtggtaactttgtggttaatttgctcaggatatttctggctcaagagtgagaagactgacatagttatttatgagtcttaacactgaaaatttcactaaacacacttaaaaggatttgatacccttttacgtattgaattgcttatatttgaattttgttagtcaaaaagtaccttaaaattatttatatttttgtggttctgtgagactacacatgataatatagggttgattttaaacatgagaacactttaaggatttaaaatgattattttagaacgttagcaatatatgaatctttaaattgttaaacatatatagttaaaatagaattatatatccattgtaatatgatataagagccaggtagtatatttagctattcctattcattttaaactattgggtaagagcaaacggatcaactgtgaaatatctttaaagaaaaaactattagaagtctgtacaaaaattgaatttatttggtgattatagttgttttattggtttcttttgttcactgtttaatttcagatgttaagatgtattagaaaattggattttaaaaatattgagtatttttaaaaaggtaaacagttttaattttattggtttttatgtaaaataacttgtactttttgaaattttccagtgggcagaaatggatctggaaaaagtaactttttttatggtaggtgttgctttttgaattgtaaatatattaagacctgggtatcttagggtagattattaaaatcattaattttctgaggttatgtattcatgaaacccaagaaatactttatatggggttgcagcttagtgtagagggtttagagtatacagatctgaattctgctttatacccagtggctgattagctgtgtgagagtgggcaaaacacgtagcctctcaaatttttcttttcactttaaaaatggagatgtttggatgtttgccctgtctaccttagatggtttgtaagaatggaatgcaatagtatgtatgaaaatgctttttaaacttgaatgtaatatataaatgttataaatgcatattttaaacgtatgtaaatgcagtagaatagttgatagtattgttttggaaaattgttcatctttcttatttcacctttttgaaaacgttttctaaaccaatcatctttgtaaaggatgaagaggtataaaaaacttgaaactgaacagactgttgtcactttgaagatagtaaatagagcttcaaaaattctctctaaattgcatttaagtgtaaatagcaatgcgtctgttaacaaatcctttgaggagaaaaacattttaacaaaattagacagttaaggagtaggttgaaaaatttgaactttttagttgggtaatgcttgagggaaaggggcatttagtggactggcttagtaagaacaaaggttctatctcttctgtgcacacgaatctgaaaggcactctctagcctgtatatcctattgtggttgtaatttggcaatgatgagagaatggactgaagtggaagtatttcagaatctccagggcagtgtgaagtctcctcacctcgacctgtgtccacagcacacacattaatgcttatgcacgtacttgctgatgtgggcacccccaccacctccacacacacacagtgccagaggtctcttgggtggactgggacaagaacagctgagtaaagagttccacttcctaggcagggtggtccagttaggtactctataccgaagtaggaacggccccttcttacagagctcggtatagtataagaagtgtagtataagttgggcatctcaaacatttccctgtatttccttagttttatttcttttggtaaagtatccacttaagcatattctcaaaatacatcctattttgttaaaaaggattttaactcatatcatttatgtctagtggggaaaaaagcaaatacagtgttaacctaatccagtcagtgaacactttgagccagaggtataccttagttttgcttgtctgttttcatgtatttcggtggtttctctttatttccttaccttaaatgtttcaatgaaaacttctcagtatttttcttatatcatttcctacctgattagtctgatgtgcaggcacattttctgcatttccttttgtccatatgaaacagataatttatttgcattgtctattaccagacacactatgttctattgaggtgtgggaagttataaataagttataaacacttttttagggtatactaatagttgtttttgtatttccagcaattcagtttgttctcagtgatgagtttagtcatcttcgtccagaacagcggttggctttattgcatgtgagtgagactgctttaagacattattgatattacatatattttaaaaataaattttccatgctggttaaaaaagcatttgttcaagtttcagattctttgtgaacaagacacaatctttctcataagtgtgttactctgctgtgaaatttagcctaacatattaatgccagataaaagcccaatttttatacagtggtttaggagaaaattataggatttgcctatagatggatatgtcctccatataaatgtcttaaaggagacatgatatatatcataagtgttttattctgctgtgaaatttagcctaacatgttaatgccagataaaggcctaatttttatgtgatggttaggagaaaattataggatttgcctataggtgggtatgtcctccatgtacatttctttaaggatgtgatctgcaaaggcttaagaagcaggtttgctgaggagaaagaagagtttgaggttgcagattaggaactttaagatgcagaaccaaaaattaattgggaacatagagaaacaaccattgcaaactaaacaacatacaagttgtttgttgttttagccatatttgtacttagatagtaaacatcattttccagtatgaaaaacagtagagatgttctgcaacttacagcggggttatgtcctaataaacctatcataaactgaaaataccataagtcaaaaatggacattagcctacagttgagcaaaatgatctaacacaaaagtctgttttataataaagtgttgaatctgtcatataatttattgaatactatgctgaaagtaaaaaacagtgattttatggatactcaaattatggtttctactgaatgtagactgctatcacgttgtcattcagccatttgttgaaccatcgtaagttggggaccacctgtatatttacagtaatgtgagttaggatattttattaagtgggtccttttgtaatgcataagcacgatgattgggttttcgtgttcatgtgagtcatgcctccctcaaaccttgttaggacattggcacattaccaatgtgatgtggaaaaaaatatgagtaatggactaaagtaattttaggatagaaaatcatgaaagactacaataaaacgattaatccttctgatttgaatattgtttattaaagactagaaaatgaaattcctcaacatgtcttaacagtgtttctcacacataggaaattgttttgtttagctcttgtctgtcttttccccttgtttagtttgaatttgtagcccagtaatcagaattgatttcctttagaaaaattctttttaggtttttcagattggcattaaaataattaataacctctttggtacagttcttcattgtatttactacatagtttctataatctggaaggtatctggacttggtaccatagtttttgtgtcatagattggtttaaatgtgacacatgttaaatgtgtatatttctataatagatttaaaactgtagaatgtctcaatttttcttaaaaaacagacttttggtaattatcccatgatttattaggatttctttgcagcattaaaatgagactgtaagagaaaagcctcatggtgtattagatattagcaaataggtagagttaaatgtccccagtcttgcagtctaataaagtggtctgtagaatcatatttaaggatatctaactttgacatgtcttgcatagctcttattttttatttagaatcaaaagctatttggttgagaagttttgttgtcctaatctaacgtctctgctgttttggcaagagggatatatactataactctggggatatccccaaagtatgtatccctcttgccaaaagagcagagacgttagattagtgtgtgtgtgtatatatgaatctagcagaaatttttctccattgaatcagacttgttattatgccctagactttaagaatcctttaaaggatatgaatatacaacttaaatggcaaatttctcacttctttcatttttaggaaggtactggtcctcgtgttatttctgcttttgtggagattatttttgataattcagacaaccggttaccagtaagtaactttttttttaaagtaatgttgagaatttaattggtttagctgattttcttcatactttgaaactttttaagcttttataatttgttataattacagtttatatactgattttatcttaaaatgacaatgaatactctgttaacaaatgggaatgtacaaactgttgtgaaaagtgtcttggttaagagtattgagtatttgtagtattatttttagtgagataattgaaattttaaaataaatacttatgggcaaggactttaaaatgaccttatttaaaaagttttctcctttactattaaattaactgtgggcttttacattttttcttagatcgataaagaggaagtttcacttcgaagagttattggtgccaaaaaggatcagtatttcttagacaagaagatggtcacgtaagcatttttcttttttttaaaaaaactgaatatgtacttaaatagagatggggtattgctgtgttggccaggttggtctcgaactcttggcctcaaatgatccacctcggcttcctaaagtgctaggattacagacatgagccaccacgcccagccagcatttttctttttctcaatacggagtcttgctctgtcgcccaggctggagtgcagtggcgcagtctcggctcactgcaacctccacctcccgggttcaagctattctgctgcctcagccttctgagtagctgggattgcaggcagtcaccaccacacccggctactttttgtattcttagtagagacggggtttcaccatgttggcaggctggtctcgaactcttgaccttgtgatctgcctgccttggcctcccaaagtgctgggattagaggcatgagccactgcgcccagcccgcaattttatgatttccttacaaaagagtaaaaagtattcttttacctgcttcatatatgaggaatatttgcttcatcttcaacaagtcaacatatagaggataaacataagaatcagaaagttctgaggatgatacagatggtttaattactgatctttcctccctaatgctatcaaccaaggggctactctactcattgcttaatggtgctttaaaattatttatcggaaagtaatttcattgtttgtcaacaggaaaaatgatgtgatgaacctccttgaaagcgctggtttttctcgaagcaatccttattatattgttaaacaaggaaaggtaaaacaattgtatgtcctttttaagtagaatttgttttctgagtaattcttgagtgatgaatttggtttattgatttgagtggttaagctgaagcaaaaatggccatattcttttacatggccataaagtaccaaataggtccattgcatgttgagatggaagtatttcagcatattaagtggatcttgttttcctagtgactggtattacttactgaggtgaaagtatgggaagacattattggcttatgaatgttgcaataattaagaatattgtaggaattctataaaaatcacatttgaaaaactttctaaaattaatattttgtgttacctaattatttatcacaattaaaatactgaaaagctaacattaccagaaatctgccattttgccacatgttattttccctaatagggattatgtttttacattttttcagcagccaaactacaaacttttttagctgattgttctgctctcttctcatatactttcactttttttttggactagggaaaattctcaaagaatattcacttattttatactgtaggcctttttttctagatatgtattggaaagttagcatttagaagaagtgattaggaagaatatggagtttcagttttagaaaatgtgttactggaagaacacgtttttttccgatttaactatttgtgggagataaatttttttaaatggaggctgatttgaaagagcacttttctgagatccgtctgctgtcaatctaggcccttttacttcatttcagtttctgcccgtatgccatccttgattgcctcatctgaaagcattgccgtcccctcaaccctatgtgctttatttccttaatctgttttatttttcttcataacacttacactgttaggatagtacttattttctgtctttttccattagaatgtaagctccatgagggtgggaccttttctgctttgtttgctcttttccagtgcccagcagtggcacatatgttgtagccatttgaaaaataatttttaagtgaggaaattgcatgaaccaatatgtataattggagcgttcaataatgaggatctgaaggatgattctttgatgtagatacttttgatagacctattttcgtagagataatttcaattttttaatgcagtgatatcatttttgacatttagggatacttgttatatattaagttgcatggcacttaagttgtaccattctctctatatttaaagcataccatttttgtcatatcattagccttctgtatctgtaggttccacatctgcaagttcagccaaccatggatcaaaaatatttaaaataaataaaattttaaaacagtacaataagaaataatacaaatttaaaaatacagtaaaactatttacatagcatttacattgtattattataattaatctagatattaaagtatatggaaggatgtgcataggttatatgcaaatactatgccattttatataagggacttgagcatccttggattttggtacctgcagggggtcctagaaccaatccccatggaaactgaggaagaattgacttttaatatattattgtagctttaaaaaaaagtgtagtcagtgatggttttcccttataaaaatactttgttttttgagaatggagctcatcttttataccttatcatattgactaagaaaaagatggtggtgtgagatactccttcacttgttagccctattcataaaggagagttatgaccgtaacagttgtatttggattttatttggtaaatttcatttaagtaaaggagacatagatatgtaggcatgcgtactatacaaatgacattagccaaatcataatctgtttaaaacttggcatgtcccaaattcaaaagtctgaaatacagaatgctctacaatctgaaacctttcgagtgtggacatgacattcaaaggaaatgcttgttggaacattttggatttcaaatttttggatttgggttgctcatctggtaagtataaatgcaaatattccaaaacttgaaaaaatctaaaatctgtaacacttctggtttctaaccattttgcataagggatacccaaccttcatgtgtattaaaaacctttcaacgtggagttcttcttcttaaacggaggctacagctatgtaatgattatttttctaaaaattttagatcaaccagatggcaacagcaccagattctcagagattaaagctattaagagaagtagctggtactagagtgtatgacgaacgaaaggaagaaagcatctccttaatgaaagaaacaggtaaaataaatgtgattctgccttatttttttgttgcaaattactgtttttgtgacagagtggctccatgatgggaatatagtaggtgtttagtatatgacagcattagataatgctgttattaataaaaattgagaatccataacaccaatgatgttagtagcttttaaaaatattgtggaaacgcacactgactttttttttttttttttttgagatggagtcttgctctgtcacccaggctggagtgcagtggcgcgatctctgcttattgcaacctctgcctcccgggttcaagtgattctcctgcctcagcctccctgagtagctgggattacaggtgcccaccaccatactcagttaatttttgtatttttagtagagacagggtttcaccatgttgtccaggctgatctcgaactcctgacttcagatgatccacctgccttggcctctcaaagtgctgggattactcatgagccactgcgcctggccggcacactgactttttaaaaggaagcttaaactgaggcccttactacatgttataaaagaaccagtgtcaccatgtgtaaatttgttctctggtgcttttcataataaaggatcttaacccatttatgcctagcattccattattggaatcctaagcttgtggatgttacttatattctactgctcaaggtcattgccaaggtctgatttttcacagaaaaaaatttgcaacctctggcataaatgggttaattgctattttagtattttaaattgggttaccacatcacatcaaagaaataatgctacagttcttaaaaataatttaattcaaggtatatttaagaagtgatattacataaaaatcttattcaattcttccacctctctccccatttcttttaagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgaggtaaaatatttacctgtgacacttaaaatcagattaattttgtttttatgaatttgttaaactcaggccataattacacttttcagtgattttaaatagaaacttaaaaaaaacctctcaatgaatttattagtcagcaagtttttttagttcaaggaaattagccatgtggtccttgctatatagtattatctgaaatataatcagatggtggtattaggcagacaagatgagaggaaagccattttgaaggcttcttgtagttgtagtatatcctaaactacacattttgtacaaaaatttagtgcttcagttttctagtttaaaatcatttttaaaatttttgtagaaaatttgagcagttacttttggtttattttaatagaaaaatttttattagatgttatgaaatatttagtaattacaaaatgagttagatatgataagttgttttttttcttagctttctgctaagcgagagactagtggagaaaaatccagacaattaagagatgctcagcaggatgcaagagataaaatggaggtaagattataaacaaggttcatgttaacttactttttacttttgagacagggtcttgttctgtcatccaggctggagtacagtggtgccatcatggctcattgtagccttgacttcctgggctcaggcaatcctcttgccgcagcttcctgaatagctggagcacaggtgtgtaccaccacacctgtctagtttttaaatatattgtagagacaaggtcttaccatgttgcccaggctggtcacaaactcctgggctcaagtggtccttctgcctcagcctcctgaagttttttttttttttttggaagacagggtctcactccattgcacaggctggagtgcagtggtgagatcacagctcactgcagccttgatctctcaagctcaagtgatcctcccacctcagcctcctatttttgttattttttgaagagatggaatctcagtatgttgcccaggctggttttgaactcctgggttcaaggagtcctcccacctgggcctcccaaagtgctgagtttacaggcatgagcaaccatgtccagccatcgtatgtttttgaccatagtaaacccttttgtaccagaattatggaatgattacacaagggagagttagaggaattgaatattgaaaggacagagtattactaaacattaagtgaaagagaattaatggtgtcacaattctgctattgtacttctaattgccttattttctgtttaatacttttgaataggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaagggtaagttaaaatgctaaaaatgaaagatgtgaatgttcaggtgagtagcaactgtagaagacagccctttctgtgactggtgtgtgttggaatttttttttaagctttgctacgttagcataatttgtactcaagtaacaacttggtactgtccctttgtttcttacattaaaaaagagtttcatgttacaggtgggttttctcatgaagtttttttcctgagaaaacatttatgctagacctaaattatgcaaaaaatttaaagcagtttgcatttttactttgtttacagaaacgtttattaaaagagaggcagaagctgcttgaaaaaatagaagaaaagcagaaagaactggcagaaacagaacccaaattcaacagtgtgaaagagaaagaagaacgaggaattgctaggtctgagaactttcaccaacactttaactttctacatcatattatgtaaaactaggttgtccgaggagctcaattatatagtagctgctttttacacttaattctttttgtatctttttgaaaaatggctttatgtttctgtgtgcagttgacattattggttgcaattaaacttggttattattctccttttcatcccatttgcttctattttgtgtagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataatgtaagaacttctatagctgctttgtaaaaatctttcagaagagataaatgtgtttagttttatctacttcaagttttctttttaaataagtctacatgttgctcttaaaatatatgacagatacttatttagaaaaggcctgcacagtttaatatacatatagttcttttttaaagaatattcatgtcattgagcctttatgtagattaagtatattaaaatgtatgtatgtatttttaatttttttgagatagggtcttgttctgtcacccaatctggagtgcagtggtacaaacacaactcactgcagcctccaccttccaggctcagcgatcctccatccttagcctcctaactgggaccacaggcatgtatcaccaggcccagcaaaatttttatttatttttttgtagagacgaggtcttgccatgtagcctaggctggtctcgaaatcttgggcttaagcaatcctccgaccttggcctcccaaagtggtgggattagaggcatgagccactgtgcccagcttaaaatatgtttttatgaattggtagcatgtgtcttacatacccttaatttaacaagatgtcacaacatatgtctaaaatagcttgttggtaactttttttttttgagatggagtttggctcttgttgcccaggctagagtgcaatggcgcaatttcggctcactgcaacctcagcctcctgagtagctgggattacaggcatgcaccaccaagcccagctaattttgtatttttagtagagatggggtttctccatgttggtcaggctgctctcaaactcccaacctcaggtgatctgcctgcctcagcctcccaaagtgctggggttacaggcgtgagccaccgtgcccagctgatagtaacaattttttttttttttttttaatacgagtctcactgtgtcacccagtctggagtgcagtggcatgatctcagctcactgcaacctccacctcctgagttcaagcaattctctgcctcagcctcccgagtggctgggattacaggtgcctgccaccacgcccggctaatttttttgtatttttagtagaggtggggtttcaccatcttggccaggctggtcttgaactcctgacctcgagatccacccacctcagccttcctaagtgctgggattgcaggcgtgagccaccatgcccggtgtaattttttttttttaaaacttcattttttggtattccagcatcttatgttacatttagttgtcatgtttcttttatctgctttaatctggaccagttcttcagttttttcttgacttttgggacttgacattttaaattatttgttataaagtacatatattaatatttatgtacttattaattgtatattatatataattatttgtccctaatctcttttttttggagatggagtgttgctctgtcgcccaggctggagtgcagtggcgcgatctcggctcactgcaccctccgcttcccgggttcaagcaattctcctgcgtcagcctcccaagtagctgggaccacaggcacatgccaccacgcctggctaattttttgtatttttagtagaatggcgtttcactgtgttagccaggatggtcttgatctcttgaccttgtgacctgcctgcctcggcctcccaaagtgctgggattataggtgtgagccaccatgcctggcccctaatctgttatagtgatttgcccactttaagtttttggtgactcacctttaaatgtatccaaaacctcagtgaagttttaaagaaagagctgtttactttgtactcatattctcactttacataaagaaaaaaatatatagtggggagaaaacacaacagcctctgtaggcataaacaataggtaggtaaaattgcgaggagtgtagcctgctgtttttggaagtccagtcgtgctgtgggttttagttgtgatactttgtggaaggagtggaaaagttgggttaatccaggcagttctttatatggttagtatagtctgaactgatagttaacacctcctttcttgaaataaaatgagttttctcttgagtttatgaaaccaacctcagcagatgccctttttgaaggtgcctccagtgagagaatttattcattttttgtcatgcttgaagttcattattttccagtattccagccacacttttggttatcagaatgaccacttgtaaagatgaagcctttcctttggacagagatgattttatggcgctgattttgttatgtaaatagccttttttttgagacagccccactctgttgccaggctggagtgcaatggtgcgatcttggctcactgcaacttctgcctcctgggttcaagcgattctcctacctcagcctcccatgtagctgagattacaggcgcccgccactgctcccggctaatttttgtattttagtagagacagggtttcaccatgttggtcaggctgttctcgaactcctgacctcaggtgatccgcccacctgagcctcccaaagtgctgggattacaggcgtgagccaccgcgcccggtgtaaataggcttttgcctcttggtataatcctaaattaatttttccacagtgtatttttaaaacctgcagtatgaaaaataaaatgtctttttggtggttttattatgctttattacagttcatttatgtgatacatatcctacatacttatcaaacttaagtttttagacttttctaacttatgtcagtggtatcttggccgtagcaactgctgtggagaaggggaagctcttagatagtttcagtgcaaactaaatgttttctcttttccaggttgtaatgcatttaataaagtctacaaaacattatattttgaatttaatataggtagcttactttattactggttctgagtagcatcatggtgtcagaaagggaaccattagtgttcagatacacctggaaaaaaacaaagtatgtaggacttaagaaatactgtaagctgccaggcgcagtggcttacgcctgtaatcccagcactttgggaggccgaggtggacggatcacgaggtcaggagatcgagaccatccatcctggctaacacggtgaaaccacatctctactaaaaaatataaaaaattagctgggcgtggtggcgggcgcctgtagtgccagctactcggggggctgaggcaggagaatggcgtgaacctgggaggcagagcttgcagtgagccaagattgcaccactgcactccagcctggacgacagagcgagactccgtctcaaagaaaaaaaaaaaaaaaaagaaatattgtaagctgtaatgctagttaataacacaacagtctgaattgtttaggactgtaaaagttgaaacattaatttaggaaaactgactcttcaaggtttatactcttcttttagcatgtgttcagatagcctggggatgaattaagtaattgctgcagaaaagttaaattttacctagggaatttgttaactcttttatggtttcagataccactgagtcccaaattccttatgtgtagaattaaagggtttaattatccaagatgttaaaagtcattctgattatccaagattttttgagacagagtctcgctgtgtcaccaggttggagtgcagtgacacaatctcagctcactgcaacctccccatcctgggttcaagtgattctcctgcctcagcctcccccagtagctgggactacaggcgtgtgccatcacgcctggctaatttttgtattttcagtagagacggggtttcacgatgttgcccaggatggtctccatctcttgacttcatgagctgcccacctcggcctcccaaagtgctgggattacaggtgtgagccaccgcgcccggccaatctaagattttgtgactcagtagtaacattgactttttgtcagtggaattagtagtaacattgacttttgtccattaaaattttggacaaaaagtcagtgttactactgaggatgaataattgtcagtactctgtgggaatatttacaattactttgatatctgacaataattagttataatacaaacagatgaatgtaattactttatgaagcagtttgaagcccttcccctgaaggatgatcttcagctttattttgcttgtcttattgcttcccagtaaggcaaggatttttgtttgctttggtcttttatgattccccagctcttctaagaatgcctggtacatactggggttttggtaacttcactaagtggatgaagtgtcagcttccttaaactctagccagtgaggctattggattttttcagctcagtatagtctactaaattaatgaatacagttcattaattctccttaaggaaacagcatcttacgttaggttcttagagatttgttataggttctgccaagatttttaactcatttttcttgaatgtaaaatagttgaaaatagtttttgtgttctgttgtgtgtgtgtgtagagggggcagtatgaaagtatataatggactattatgagaacttagaattttttttctaaaattctggagtgtatattatagaaataggaagatttagatcactaatgaacaaattaacttttagcaacatgttttatagtatttaatggtttgtgttttctggtgtggtatgctcttttgcctaaagacaacttttaaaaactgaaatggggccgggcgcagtgtctcacgcctgtaatctcagcactttgggaggccgagacgggcggatcatgaggtcaggagatcgagaccatcctggctaacacggtgaaactccgtctctactaaaaatacaaaaaacaaaaaaaacaaactgaaattggatttttcaacagcatcattgaggtataattcacatacagtaaattgtacatatttagtgtacatcatttttcctagtcaggaaagtggcaaaaataaagtatataatttgatgagttttgacatacgtatacatctgtaaaacaccacacagttaagacaccacacaccacagttaagacaataaacacgtttattacccaaaagcgttttccatacccctttgtaattcctccctcaccttttgtccgcctcccccatccatctgcaaccactgatctgctttctatcagtgtagattagtttcatgaaattgaattttaaatttatttttatttccatagaaactggaccaggatcttaatgaagtcaaagctcgagtagaagaactggacagaaaatattacgaagtaaaaaataagaaagatgaactacaaagtgaaagaaagttagtatagactaaaatgtgcattaatgttttcagtaatgttcgttactagctgttatgtggtctttaagttacaagttaaccggtcaggcttgttttctgtattttgattctaaactgtatactgttaatgcatcctcatatgtgtttaaaattaaagacagtctactttttatttattagctacttgtggagagaagagaatgcagaacagcaagcacttgctgctaaaagagaagatcttgaaaagaagcaacaacttcttagagcagcaacaggaaaggtgggcaggttcttttcatcacctctgtttacactgagtcattgagttaatcgttatgtaataattttttacctttcaaggtgtaggtcatgggttccaagtgataaataggagtccaaattatcttctaaatatgaaatgatagagattaaatagttttattactacacatactattaatagcacttttgatgttcagataaagagcccatttttaacactactgttatggaacagagcctatcatataaggtgttacatgtagttggcatattgtgaggaggtgatgtgtttgttggagaggatgtttagtttaatcactggtatatttttaaaatgtatggtgttgtgggctcattccttaccaggagtgccattgatgatattattttaatatttttcatttctgacaacttacaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttaaagcttttgcttgatatttagcatttttagaagagggaataagaatagcttaaacaacttttgtagtttttgtacaacatatcttccattatctttttatatctcggttccttaactttctaattaaagaagtagatgctaagtatttgttcctaattatagaagctagaactttcctcttttgggagtttctccctccccgccattggaatttttaaagtagtcttattttccaaaattatttggattatataggaaaaaactgtttgatgcttaagtgtttataacattttaaaagtgcacacctttagtcccagctatgcaggaggctgaggtgggaggattgataagtttgggcaacatagggagaccctgagtaccaataaagatttgtcttactctgtttatatttaggttattttatcacattgttgattcagatgaagtcagcacgaagattttaatggagtttaataaaatgaatcttcctggagaggttacttttctgcctcttaacaagttagatgtcagggatacagcctatcctgaaaccaatgtgagtcattgtgtgataaggtgtatttctcttttataatgttattttttatcacataatctaacacatgctagtgcccaggcactatacactgggattcagtggtgtatgagataaaaatatctgtcttcccatggaccttagtgctgagtgggttttggggagggagacagaagtcacagctatgattggtgtggtgatgcacgcctgtaatcccagctacttgggaggctgaagtgggaggatcatttaaaaagaagagaaaaaagctaagatatgaaacaaatcattgcaaatgtgcagtgttaaaagcgtaagtacaggatactttgagagcatatctgggagtgacataattaaggttagggagttggagaaagattcccaaggaactgtcatgtatagtttaaaagtgtcttgacgtacttaggattaaatgaaaaaaatggctagtaaggtgatagacttcggaagcataacattgcttttgttggtaacaaaagtgcactttaggtggattaaaaatattcttcagacaccattcttagaacagtgtaattgctttgaggtacttgacttcagaatgttgatggtagcatcaactgttttaccatcctctgaagttaaagctgaaaccccatgagaatgatcaataatttaagtggaacattaagaatcttgtaagctatcaaagggtctgactttttctgctatcacatctacaaattgtctttgaagtttgggtaagaaaaattgagtctcaaaaacatgatgtatgaatggaacgagacacaaaggagtacatggagcgtggttccatttacgctgagtaaacaaaaccaaacttagggccaggctcggtggctcacacctgtaatcccctcactttgggagggggaggtgggcggatcacctgaggttaggagttcaagaccagcctggccaacaaggcaaaaccctgtctctactaaaaatacaaaaaattagctggacatggtagtaggcacctgtaatcccaggtacttgggaggctgaagcgggaaaatcgcttgaactggggaggcagaggttgcagtgagccaagatcatgccactgtacttcatcctggcaacagagcaagactccatctcaaaaaaaaaaaaaaattttatagaactgggaagtgcaaggaagtgattagcacagtcatggcagtggtcgtttctcgcaggtaaccactgtaggtaactgctttgtgattaggaaaggagcacacccatgacttctggggtgtcagcagtgctctgtttcttgtggttatgttggtgttctattaatttacactgaatacttaactacatttttctatatatgggatatattttcataattttaaaaaccctgttctaacagtttaggagagaggaaatgaaattttatctgacaaaatattttcctatctaatttagatatataaaatatgtaaaattaaaacattttgaggaagtactatttatatttagcccttttatgtgagagatactatcgtaagttttgcatatattaactcatttagtcttcacaactttataaggaaggtatgtattgtctacgattttgtagataaagtaactattatctgaggaagttaagcaacttgtccacagtacacatctgataaatggtgaaacgagtgtttgaatttgggcagtctagcttcagaaccactaaactctttagcactattaggctctactattgaaaaccttgattacaagagcaaaattaccaggatattctagtggaatgagtcttctaactacttcagggaaaacgccaatcgttttgaaatataatggtgtttatggtttatttgtatttcataaagatgtaatttcataattctaagttcttagttaactgtgttgtgatctctctgttgacaaaatttcatttttaggatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtttgtaatactaattcttagctttaaacagataaattctaacaaatcatttaaaacatataatctggctgggcgcagtggctcatgcctgtaatcccagcactttgggaggctgaggcgggtggatcacctgaagtcaggagttcaagaccagcctggctaacgaggcgaaaccctgtctccattaaaaatacaaagattagctgggtgtggtggtgtgcacctgtagtcccagctactcaggaggctggggcaggagaattgcttgaacctgggaggcagtggttgcagtgagccgagatcacgccactgcactccagcttgggtgacagagcgagactctgtctcaaaaaacaaagagacatataatctgtataatatgtcagttgagctgtatgcatgtctgattaatatatcttacagtattttggagacattctggttttgagagtattcgaaaaattcatcctttgcctttggccgggcatggtggctcacatctatatataaccccagcactttgggaggctgaggcaggtggataacttgaggagggaattcaagactagcctagccaacatggtgaaaccccatctctactaaaaatacaaaaaattagctgggtgtggtggcgcacacctgtaatcccaacaactcagaaggctgaggcatgagaatggcttaaacctgggaggcagagggtgcagtgagccaagatcacacccctgcactccagcctgggtgatagagcaagatcctgtctcaaaaaaaaagaaaaatttattttcaattattttatagttttttaaatagttggtttgttcaattaagagtccagacagggttcgtacttgatatttagttgatgtctctgaaatgtgatcatatagcaggggttcttaaccttttttgcagtgtggactgctttggctgtttgaagcatatggatccttcacaattttttttttaatttttaaatttattttttttttacttttttccacaacaaaagccacattcaacacaatttttaatgcataaattaaaatactttggatcacaaaggagatgaattgtattcgcatggttattattttaaaaaatattatataattatttaatgtattcaaaaaacaagatagtagtgggtctaatagctaccataagtttgaagtactgatacatgtaaacaatattttgacatctgacaagtgttacctaatatgaaaatagctcttcttttggtagtcacagatactaatactactactgtggttcttgtcgtgttcgttatagaagggaaatgctaaatctcattttgaggttaataaaaataaagatgtaaatttttttcctactcagatcacagatcttctgaattttatctttgaaatccaggttaagaacctccagtatataggtttagtttacctgccctcaattttttttttcctctttatttgttgaagaaagcaggtaaacccatctccccccaagctttgtttctgtatatgtacgttttgttgtggttgtttttgaaccatccaagaataagtaaaacatcatgtcatgtcatctctaaaatttaagcatgcatctcctaacaataagaacattcttttgtatagccacagtatcattgttacacctaagaaatttaacattaacctaatatcctctaaaaagtatccatattcaagttttctcaattatcctaaaatatttttctatttaggattaaatcaagtatgcatatagtgtcttctctttattttttttttttgagatggagtttcgagcccaggctggagtgcagtggcatgatctcagctcactacaacctccgcctcgcaggttcaagcgattctcctgcctcagcctcccaagtagctgggattacagacatgcgccactatgcccggctaattttgtatttagtagagacggggtttctctatgttggtcaggctggtctcgaactcctgacctcaggtgatctgcctgcctcaacctcccaaagtgctgggattacaggcatgaccaccatgcccggtctagattctttaaatataagacagttcctcctgctcccttctccccacccagagaaatccagaaaagttccattttctggatttgtcttattgcttcctcatcattgtttaaatattgttggcatgaatgctacatgaatgatatgtacttatggtgtcatataatgtgtcccattgttagtgatactaggtttgatcacctgcagatctctccgttgtaaaggtatccctttgcccctttgtaatttaataatatgtgagattattcttcaagtcaggttctcccaacaacttcagttgctttagcactttgttgactcttgcctgaatcagttgttacactggggggtttcaaaatggtgattcataaattctgttattgctgctgcatttattagctgtcactcttctgtagaaaagagtctccaattttcattttttaaaaaagtatcactgtgattcatgaattttttttttttaattcaatatgttattacattggtattgttattttgatgctcaaattttcccaaatatggccagtggaaatttcaagctaggtcctgtgtcctactaatatttcctctttagtcttcacttccttcccctctggtagatgttcaggttcaactggaggttcttttttttttttttttttttttaaagactgcaaattttggctgggcacagtggcttgactctgtaatcctagatacttaagaggctaaagcatgaggatcacttgagggcaggagttcgagaaccgcctgggcacatagcaagacctggtctctacaaaaaaggtgtggtggtgcacacctgtagtcctagccactcaggaggctgaagcaggaggatcacttgaatccaggagtttgaggttgcagtgagctatgaccgcaccactgcactccagcctgagcaacaagagcaagaccctgtctcaaaaaaaaaaaaaaaaaaaatctagcattgaaaagcaaaattttttcagggtggtttaaattactttcaattctcattatctacttaaagcctgtaggttagtttttttgttataagtcaatttatcattgaataaaaaagttgtacagacctattacatatgttttgtttataggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaatatctttttgttttgtgcatagtgatagatattgtgggggaagaactgtgttttggttgccatatataatcttttgttttttcacatattaaaaatttcttgtgttttaagttcaagagcttatgtttgtttagcttttgaagactaaaagctattttaatgattctttgcttaagtgttaagtagctaataccatgaagtcacttggaagaaaagaacccatagaacacaaaaataaaggttgtatcaggcaaagaaagaggaaactgagaaggatcagtttgtgaattgtacaagtaaaaccttggtagtttttttttttttcccttcttccctgttgaatttatgtaagcaagagatactgttttaaggaagagagtgggggcggcatcagtaatgttacatattgcttagaagtcaaatatataaggactggcattttattgtacttgtacagtggcacaggcctgtagtcccagctacttgggaggctgaggcaggaggatcacttgagcctgggaggtggaggttgcggtgagctgagatcacaccactgcactccagcctgggtgacaaagtgggaccctgtctcaaaaaaaaaaaaaaaggtgacaggggagggtgaaaaatgttagattttactgtcttgaagttatttggtgcagatttaatgttagtggaggaaatggctgtcagataaccaagtcggagtagccatagtttttttttttacataaaaatggtgctgcatgaggagtggttagttcagttcacaaatgaaacaattgtatatgtggattttcttaaaaccaccatggtgctttggtataagaagtactttatgtgtgctttccattttgccacacaagttgaaaaatataggtacttgagcatcaagaatagatataaagttaatgatttttaactgcttcaggtgaaactggaatttttttaaaactgcagatttataacttctgtgccatcagtgcaagcacagaaaaagaaaaataagcacctgagctttgaccttgcaggggtctgcatatcgcactttaaagaactgcctgaatttggcaagatgttaacacaaagagcgtatggggaaatactgaggaaaaggaggatgttgacagtgtataccagctgtcttcctgtgtttgataatccagctagattgaattattccacacatggcaagaactcttcatacataaacccttaacatagtgccttaagcatagtaacagtaaacatttgttgaatgaaaagatatttaaaagtatgtaatattgttagatttcacctaacctcctttatggttttccaagaatttgttttgtataacttttagtaaaacagtatacatgttattctgagagtgaaatggggtgaaatgtttcaagcttctttatgattgaatgcattttgggtaatatagttcagcattgttttggtccataaatttgaggacataaatgttatttgggggtaaagaaaaggaagggatacatggtgttgtgtctaaaaagaattaagaacatacgatatatttacaacctggagataattttccttagccttgtatatggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaaggttcgtaagtatatctttggttatagatcgattgttacagattaataatatggaaatatgaatcatacattatatgggttatccttgaattttatgtttcatttttgtttggacccatactttttttttttgaagacagagtctctttctgtctcacccaggctggagtgcagtggtgcgttctcagctcactgcagcctccacctcctgggttcaagcgattttcctgtctcagcctcctgagtagctgggactacagacatacgccaccacatccggctaattttgtgtttttagtagacatggggtttcaccatgttgtccaggcttgtctcaaactcctgacctcagatgatccacctgccttgccctcccgaagtgctgggattacaagtgtgagccactgtgcccaggctagacccatacttttggatatctacatctattttaccattcttaaacccatggatacccaaagtctcctattgttggcacgttcaaactttccaccttcattgaacaaataggcatttgaagctgtgacataagagtactgtctgatggtcagtttttgtcagtaaccatttttatctgaagcacaatggaattagttgaatatttgattccgttttgtccagattgtattaaaattagaaagcaaacttataagtgatagtgtgttattggtctcataaacttgacagttttgacaaatcttttacttagtataatactaaaactacaaagagcttaaaaaaaaaaaaaaagatgtgcctacagttgtaccatcccaaccatattctgacaactttttattttttgagggggatggagtctcgccctatcgcccaggctggagtgcaatggcgtgatctcggcttactgcaacctccacttcctgggttcaagcaattctcctgcctcggcctccagagtagctgggattgcaggcgtgtgcctccacacccagctaatttttgtattttcagtatagacgggtttcaccatgttggccaggctcgtctcgaactcctgacctcgtgatccacccaccttggcctcccaaagtgctggggttacaggcgtgagccactgcgcccggcaactttttgttcttataatatgcctgaagatttttgtatagtttaatcatggaatatgatctgccccaccctgccccacctatactattacatcatatttttcttgttgctagagtcctaattaccaaattaataggcacctaatatttgagttgatatgtctatatatttagctcaatcaaatatagattgttttaaaattttcactataagtaatacagtggctaataccttactaataaatggataatgtcatatagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggtaagtagacagctgactggaaaaagaattcgttagtaattggctattgtgaaaagggcctttcttgctaactagggcaatatgaaagaaaagaactgagaaaatattaaaatgaggcttggacttttaatatacataggagtaaataagattttgtttttctaaaccaatctagctaggttaggattatacaagaaattttcatttccttaaaatttagttaattagcattacttattagttgtaagtattgctatgagtttgagcttgttagccttaccatatttatcttactgcctttacatatttaatgttttgatcaagcattttaattgatttttaaaactgcatagatgtaaactaccaacaccgattctaaaaaatgaaaagcatttaaagaaactgtttttgacagcatgcgttataaaaagggccagccacaaaaatttaacattatgaattgataagagaaaaatgaagaaagtatagggcttttttgaagaatataacatattaaacttcatttcagctcacatgagcacaagtactagagaggacagcaaatgagcaccattcctgtgtgtgaaatgtacatgcttatatagacaactttttcttaattctaggaaaacagacagttgctaaatgaaagaattaaattagaaggtattattactcgagtagagacttatctcaatgagaatctgagaaaacgcttggaccaagtagaacaggtgtgtatgtgtttttttttttttttttaagggctccttggtggccatgacctattgcaagtggttatatcagaggctctgattgaaagcatgggctttggggacagaaagcttagtgtcttgtgggccttgggttggaattctgccacctagtgtgtgattttggacaagtcactatttctaagcctcagtttcttgtgtgaattaagcattatcatacttgttttatataattgctatcctgacacattctaagtactttgttaatattttttcagtggtggttagatgcttagaaattttctagtaattgtgtcttttttttcttccctttaatggatacttctaagtatttgtaattatatgatgtatttatatttttttgttttcttgaatgtttattcagacaatagccatagaaaatgttggcagtcataacatttgaaactaatggaatttgtattttttgttacaggaacttaatgagctgagagagacagaagggggtactgttctcacagccacaacatcagaacttgaagccatcaataaaagagtaaaagacactatggcacgatcagaaggtgaatttttatgtagtaaaattttgtttatatgcatgttttataaaattgtttactacagaatgaaatgtccaaataggcagaagcatatgctaatgattttttgttttccattataaacaatgtatagcaaatggaatttaggaagttgactataaatagtaacttttgttttactgaaatgtttatgacaattttgagaccataaatgattcattttgttgataaaatatgaaatacctgacgaaagtttctcatcacttagttgttagaaaataactatagtttataagcattaacattgaataatgaaaattatatatttgagtgactcatatatacttctaattttgtactgacttaacatggttcataaattttcacagaaaattttaaacacaaaacctaaaacctattttggtaggtttgatcataaaaatctatactcaacatataacactggctttataggtattatagcctaattttgtttccccccatcttagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacaggttggttttaaatttgaagtcttgttacaaattgctcagtatataaatttatttatatgaatacatattttctctttatagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcaatcatggaactgatgaatgtacttgaacttcggaaatatgaagctattcagttaactttcaaacaggtatgtttcgctttgtagttaaaacatacacacagaggacaaaagcttccagctcttttcagtttgtaaagattttaaagctgttttcctcattaccaggtgaatctaatacatgtgaacaaacctagcatataggtttacagtaacttgaatgttttacacagcccttagaaggatctagtctgttatccttgttcttaagattaaaaaataattggttgcttttaaatattttacttaagtgttatatataattctaagcaaaatttatatttcaatctgcttttgttttaaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtaaaatacctttatattccattttcctcagagcattaccataatagaatttatagtatcttttgcaaatctgattggtgcattatatgcaagttacttttgaaagatggtggtgattctgccctttaggatattaactcataatatgtttatttttaggtgtcatttacaggaaaacaaggtgaaatgagagaaatgcaacagctttcaggtggacagaaatccttggtagcccttgctctgatttttgccattcagaaatgtgacccggctccattttacttgtttgatgaaattgaccaggctctggatgctcagcacagaaaggctgtgtcaggtacagtttcagtacagttttggttttgtatttaacaataagctggtaatatttgctgatgtatatatgaaaaaatcaaactcaggcagttttgaattttagtaagagtaaagatagttgctttttaaattttcagatctgctgaaaagaaatttgttaaagcacaattttctttttacagatatgattatggaacttgctgtacatgctcagtttattacaactacttttaggcctgaactgcttgagtcagctgacaaattctatggtgtaaagttcagaaataaggtaattttattttacattgagtttaagtttgtatttattcaattatatttgttgaattctgattttatgttacttaaatagtgaaagaaaacttagaaagtctttgcttatctgatgtctttgtaaagaaagaacttttccttcaaataactatgaagtttagcagtattttatggcgttgcattggttttattttcattggcattaataaacaatatctttctgtccagtctattcaatgcttctgtaatgcacagtctttaacaattatatatgttcatttgtatagactgcatagctcttcctgggtgtcttcccaaccttaaaattcttgatgaaatagcaaagtaatagaaagtgaacaaaaaggtagtttagatgtttaggcatgatatttatttcttcagagcattaaaatacatattttttaaatctatgcattgaacaaacaccactgtaaataaaggttttataagtcagtgcttcagaattattttccttcatatgtaaaatataggtgataggccgggcgcaatggctcatgcctgtaatcccagcactttgggaggccaaggcaggtagataaccaggtcaggagtttgagaccaacgtggccagtatggtgaaacccccgtctctactaaaaatacaaaaattagctgggcatgctggcgtgcacctgtcgtcccagctacttgggagtctgaggcagaataattgcttgaacctgggaggcggaggtagcagtgagccaagatggtgccactgcactccagcctgggcaacagagcaagactccatctcaaaaaaaaaaaaaaaaaaaaaaactaaaaattaaaaaatgtagttaaatgtagttgataggctgtatatatttaccctatacaatgtaaacactgatgtaattaacagatttttgtttttaacatttattcttcaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaa

SEQ ID NO: 2773 - DNA, 117652 bp, Homo sapiens
  source 1..117652: mol_type = genomic DNA
ccaagggaagcgggattcccttacttccaaaatgaactcttcaaagtaatttacgccatagagttagaatcactgttcatactaccgcccctcaaccccacttcattctgttaggtaaaagcaggattttctaagcttattaataatctttagagcaaaattcttcctttttcataactgtagctgattaaaattatgagcagttaacgctttaggatggttttgttaatggaaacttacactgtagttaaaatacaatataaattaggtgcacttgtcagagactttggtttataggaatagtccatatattaaagataagctgacccagcaaaataacgaaaatcccatcccatccacatgctctgagaagctataaaaatgcagtattttaagattaaaagtaaatccaaaatacctaatcatattgactcaagataaaaacattaggtttttttttttttaaaagagtctcttaaaaacagggagcccctgaacacatcttattgtcacaaataaatgactaagtttagactaaatggttgcattaggaatttgacaaccaaaattatatcgctgtattccaggaaatccgttcttgaaaaatgtaaaaaagacccacttagactaggttgaaacatataatgcaaaatataatgctctgctatagaaaaacacaaacatgtaaatggcttaatttcttaaagatgattcttttagccaattgtttacaaaggtagaataattcaaaataattttatttttttttacaaagagcaagtacaggagctgttcaagatcatgtattcaatcaaaatgaaatgtgacttgtaccgactgctgaagttgtcttgatgtttgagagacttgaaatctgtgaagaaatttgaatagattaccttttataaaaatagtagtagtctttaagtgtagaatactgcctaactctggaaatgtaggaaaagtcagcattctttaggttcaagatattaagtttaaatagcagctgaatgtggcctcatggcaaagcataaagaccttttttttccttgaaaaggaatttcaaaattgtcctttcccctcacagtgtcctaaaatgtaaaaaaaaaaaaaaaaagggggggggggggagtgttttcctgtatttcagcatattctttgaaactctgctgaaaggaggctgtcagtcagggttgtataaatagagtcctgggtaaatccttgaagcttgtcattccacagcaaatccacatgtttcttcaatggctgttagcagcttttcatatagcttttcatagctttcatagggtggaatgtctattcgattgaagctgtgaataagcaaatcaaattttatacagttcattcaaaataagtaaactggcctagcaagtgtataccagtatagccacatcactctgtgtcacacagaaaactaaaaggtatttctctaaaacagagatgaccacttttgggttttcctaccaatttccgaataatcttaacttttaaatcacttaagttgcttatcattccctttaaaggcccatttaacactagtaagtacaataaataaaaagtcaaatctgtttggaactaacacttatgtacatggaatggggaatacagctacaaaaataccttaccaagtgtgggctttcggcaggttgttagtgcaggcatcaatctggtgtatggtaaagagtctcgggcctgcagcacctgcaaatgaaggaaatgtggatgaaatcactgcaggtgcgtgcattagtctccaaaatcttaagaataaaactggtaagttaaccacaggatctggggataggggaatgctaatgaatccacacatactaccaaagggcagcaggaaaagcatctgggttttaagagccagaattaaccttggataaggcttagattccgtaataggttcacatttccatttgagaaaaaactcaagattgaaatccctttctcaatttctatcttttatagaaagtcaatatcccaaaagcatgagaagaaaagtaatcaggcaaatccaaggtaaaatacataggcacacattcaaaaagatgacgacctgatgcaaatttagatttcatgactcaaactgggctgacagcaaaagagccgtctatagaatccatttcagttcgcacaggcaccccatataaatacatgtagcagaaatacaacttcactttatgcatctgggaagtgtgaggatgaggagctctccttacagagaagggcagcacagctgaaagcacgctctccccccagggatttcagcgcatgcgctgtgggcagcactgtcgaattatgtaccagtgtcgctttgtgtgtccttattcatcaccagcagctttgaaaatgaagtgcttaagaggtaaaggaagcaactgccacccagtgaagcaccacaatcattagcaatattaccagctcctcccaaaattaaccagcttattccacagaaaaccattcttaaaaaaggaatatggttgtaaacaaatggtctgatgccatgcagtaattaaaatgctctgaccgaacagatggtttccatgacccatgctgcttctgtctaataagagaaagaacgaaaagtagaggggagaggcatcccaggcaggtaaacgtttcaccaggtcaagatgtgaacatggaagtgaacgacttccctacaggaatgtgcaacagaattaaaagtaaggtgaccagaaaacaaaggcagagcatcaccacgtacggtctctagcatgcggcactcactacaatcagagaagcccgcagaaaaggctcttgggaagggaacaaaagaaaggagggagaagaaggtatcacaatgtgagagtcacagataagaagtgaaaaagagaatctctaagcacatggtttacaaaatatctccacagaccccacgctgacagccccgcccccacccgctgcccagcttgcctgcacctcaggctgttaccttgcaatgctttgaagccctgcagaggcactcgagaggatcctgtcacaaactgaagcaatcttgctcgtcgctcttcatcaaaaaactccacagctttccagaaccatttgacaatgttgctgtctggtgtacagtgttttaaccgggtgtttaccttccagtcattaacatctatctttccaagtccacaaataatgagctgtgaaaatagtacacagtaatgaacctgtggaaaccacagccagaccaaaaattcctcaaaagagaactttaggtttgtactgctggctgtcatttggtggttcctaattaaagatgcacatcagaatcatctgaaaagcttttcaaattgacattccaggtcctaggctcagagatgttaattctgtgcacctggggtgacagttgggatctatattttaaaaagctccagagatatctactcactgcaaactccctctccagggtctgagaaccacagctgtgatagacttgaccaggtaaacaattgagaatgtttcataagttcataataaaattataaagctttaaaaaaaatggacagaaattgagacccaaagagtaaatacagatatgtgccttctttggacctgcatcatctactagtttcaatacctattagctttgttgattgagggcaattcaatcaattcctctgctgtaatatggtagtaacatccatttcactacatcctggggaagcaaccgataatgcacagaaacttcagaaatgggtgttgaataagtgagtcatacaatttgcttaataattttttttttttaagacagaattttgctctgtctcctaggctggagtgcagtggcatgatctaggctcactgcaacctctgcctcccgggttcaagtgattctcctgccttagcctcccaagtagctgggattacaggcatgcaccacaatgcccagctaatttttgtatttttagtagagatgagattccgccatgttggccaggctggtctccaactcctggcctcaagtgatccgcctgcctcagcctcccaaagtgctaggattataggtgtgagccactacacctggcctacatttgcttaataatattaaattgatattaaagcacaaaatacatgagcacattgatacagacctctgctaaacacatcctgatggagggtcacacagatgaactatatccaaatcattttatactatcattaatatgtctccctagggttcaagactaactcaccatactaatctaacatgtttgtttatagcagtgaattccatgtatactataaaacataacttgcaaatcctgtattttatagaattacacccaggattaatatatacaatgctaaaataaatgttatacatattgtctttaaaaattggtagggtgtggtagctcacgcctgtaatcctagcactttgggaggacgaggcatgcagatcacttgaggtcaggagttcaagaccagcctggccaacatggcgaaaccctgtatctactaaaaatacaaaaaggtagccgggcgtggtggcgggcacctgtaatcccaggtaaggcatgagaatcgcttgaacccaggaagtagaggttgtagggagctgagatcccatcagcctgggggacaagtgagactgtgtctccaaaaaaaaaaaaaaaaaaaaaaaaagccaaaataatgttagccaggcgtggtggtgcacacctgtagtaccagttactggggagactgaggtaggaggatcacttcagcataagagttaacagtgagctaggatcatggtactgcactccagcctaggcaacagagtgagactctatctcaaaaaataaaaataaaaagtttaatgattcaggcctggtgcagtggctcacgcctgtaatcctaacaatttgggaagcagaggcaggtggattgcctgagctaaaaagttcaagaccggcctgggcaacatggtgaaaccccatctctactaaaaatacaaaaattagccaggcatggtggtgcacacctgaagtcccagttactcaggaggctgaggcacgagaatcgcttgaaaacctgggaggcagaggttgcggtaagtggagattgtgccactgtactccagcctgggtgacagagtgagattctgtctccacaaataaaaaaaagaaaaaagagaagaaaaacaaagtttcatgacccattagcagtagaaactatattaaaaatcctaaccctaccaaataaagtctccagtaaggcttctatggggttctgaaataaaatctccaacaaagcttctacagggttcactgaattaacaccacactgaacagggaggaggttatccgaaaaggattatgggtgtatttaatgacataaaagacacctcctaaattcttttcttcagaggaatggcagttagaaggccaaatcctcgtttattgtataaagagatgaaaatgcattatatttcaaccttatcggcattcctgctatgttctccttctaactacttccttctggctatttcactatgaacaattcaatcacaaaaggaatggggagagtattaagtaaaaccaacctttttagatttgtttgctaacaggtctattaacagatttatttagaaaggacattgaaggcattgaataaaatcatgtttcaaattattagtagacttcaaatatttgtgttatccctaactactaaataaatttgggacctttaatagaattaaacctcgtgttttttagttgttcagtaggaaattcagatgcatttgtttaaggtcttaattacaaaacctggggtgtttaagggccagctttaaaaggaaacaaaaaactattcactgtttagtatggccgttaatctaaagacatttagaggccaggtgcggtggctcacacctgtaatcccagcactgtggaaggccgaggtgggtggattatttgaggtcaggagtcccaggccagcctggccaacatggtgaaaccccgtttctactaaaaatacaaaaattagctggacgtggtggcaggtgcctgtagtcccagctacttgggaggctgaggcaggagaatcacttgaatccaggaggtggaggttgcagtgccactgccctccagcctgggcaactctgtctccaaaaaaaaaaaaaaaaaaaagagagagacatttagattcaatttatcctaggtgttttagttattttctcgatgatcttgtctatcaaatgctttcttgcaagcttagtgtaaaactaattcagagtaggctcttacccaaataaatttcaaaatggtagattaatgaggttttacttaactaaatcagtaaccactaagttagggaatagacatatattggaagaatgtacatataagtcacgaaatctgtttaaaacaagaaagtacaggatagaaaaataaattaaaaattttcacaatataagagagactgctcacagctgggcatggtggctcaagcctataatcctagcactttgggaggccaaggcaggcggatcacttgagctcaggagtttgagaccaccctgggaaacatggcaaaaccctgtctctaccaaaaaaaacaaaaaaattagccaggggtgctggtgcatgcttgtagtctcagctacttgaggggctgaaggatcatttgagcccaggaggtcaaggctgcagtgagccatgattgcaccactgcaccccagcctgggtgacagagtgagaccctgtctcagaaaaaaaaaaagagagagagagacagattgttcactcacagaaattccaaagcatgaaaggccttcaaaagcatgaaagacttttcctgtgaataagaattctcaagcatagaaccatgaaacttagaaagcaccagaaatatgctttcctctaaaactaagtaacaaaataattcccaatccttccttgttacactagtgatgttataatactaatgcactaacctctaactccttctcatcaaatgtcttcagcagatgttgtggaattacttcattaaatcctttctgcagagccaagaattgagcctcaatgcctcgtaaaaatctccagttcacatagagcctgtaaacattcggcaggatttcgtataatcacatgtattttcagatctggtaattattattataaatctctactttagcaacaccgcatcttacaagcatctaacattaacggtttagcctcaagtctaacaataaatctcagactaatggggataaatgaaccctgaggtgtgacacagttcaatgttgatgaaaagtggtaaactactaacaaaagcagcatcagcagagcaacccttcaaatcagagaagctcccaggaaacaggacgtctactagagctgagtcttgatgaaatttctttctaaacttacagcatacatgccaataactagaataaagagctctttcactcaaaaatgacttatttttctgattttacttgcaaatgtaatttgaatgtgttgggtgttttgtttctatttgagggaggcctacgggagaagaggaggtagagaatcctcataccaaaaatgagaagaataaatagtaaaagccaatagcaagcactttttgattaaataatcattgttctctagaggatataaaaattctggaagatgtaattttaccaataaaaaaatgcactaaactacatctattgtgtgaatgtacgatttataagtgaattgtttttatttatctacccaagaaaacttctccatctcatgcatcacagaacttactcatctgtcaaatttgttaacatttccaaatttggagaaatggttctctactttaagaaataagttacttaacattatatcctttggaggaccgtatttttgtttgttgggttaaggggacagcaaaactgtgtaactgtaaaagtttttctttgaatttttaatctaataactgtagttggcaagggattattacgtgctgtaaacacgactgaaccctgaagagtgggatccagggactgagtaggacacacgaggtcttgaaaaggagacactgctaagacttaggaaattctcatttgttctttttttattatttttaatttatattaggtggagtctcgttctgtcacccaggctggaatacagtggtgcgatctcagctcactgcaacctccacctcccaggttcaagcggttctcctgcctcgggctccaaagtagctgggattacaggtgcctgccaacacgcttagctaatttttgtatttttagtagagacaaggtttcacaatgttggctaggctggtcttgagctcctgacctcaggtgatccacccaccttggcctcccaaaatgctgggaatacaggcatgagccactgcacccagcctgttctttcattttttttaagtagaaacgtaatacatactttttacgtatataacaaaaaaatcaaacattaactatggagacagtaaaatatgaaagtccattcttttaccctctttctccttcctatttccagtcgcatcatctccactccctcatcctaggcaaaaactttatttggttgcagcctcctgaacatcttcagtataatcataaaaaaacagccaggcacggtggcttacacctgtaatcccagcactttgggaggctgaggcaagcagatcacgaggtcaggagtttgagaccagcctggccaatatggtgaaaccccatctctgctaataataaaaaaaagttgccaggtgtggttgtgcgtacctgtactcccagctactcgggaggctgaggcaggagaatcacttgaacctgggaggcagaggtgcagtgagccaagatcttgccactgcactccagcctgagcaacagagcgagactccacctcaaaaaaacccaaaaaaacaaaacaaaaaacaaaaaaaaaaccatggattttgttcctacataattcttctaagacttacttttaaaatttgacagcttatgcacttttaaatatccacataatattctgctgaatgtataatataatcattcttctctaaaaccattttagtagtgtaactttttttcacaagtagcatttaattgaccgtctttccccgtattcgttcagttacatgtgtgtttctgcagaagagccctaaacacagagctgctagttgaagggcacatgctgctggtatcaaactgctttccagaaaagctatgccagtgttcactccaatcaagtggacctcatatttaaactaggaaacattttagtaagatttgggaacataatctatacacagaaagtatatcatgcaagtttctgtgtacataaagttcaagttcaaactcccaaaactgattaccatagttctatatttagaggactttttatttctcataagccaaattagcccaatacataaaaattcctcaatttttactttatgaaatctgaaaaacatttatttacatttatccctaaactcacaatgtgctcatttataaacaggctaagtgttagtaagataaagcacaaaagcccttctgaattgccacctgtgatagctacaccacatgtggccccagtgcccacatctcctggtattcacacatttgtacagctcctcctccatgatgaaactgggctggctgtctcagtttaaccagaagtagacagcagaagtcatgttggccaggaccaggcttaggccttaaaaagatctagcagcttctgcttttgagctttagaaagctggccaccccataagaagtctggctatcttgttgggagagagagtggctatggggggagggagtggctatggggagagggagtggtcatggagagagggaatggcctttgatatcacatagggagaaccaaggaactcagccaacaatgagaacaaggccccagacagtgaccccagtcaacagccatgccagctagccctcagccatttgagttatcctagttatgagtgaagaggccatcttggtgttgcaggcctagctgacatcttgtggaacaccagtgttgtcatccatgttgttcttttgcccaatttcctgacccatggaattgtgagaaataataaaatgtctgttctaaataagccactaaattctcctgaagcggattttgtaacactaagtagtactatctaaatatttaagtttgttcatactaacattctagaacattttaaaaaattcagccttgagaacacaggagtgtttacctgacatattcttttttattttcttcattaacagggatacttttgccatttggtttaagttcatgctgaataatttcaccatatgcattatgttcaacacagaaggtatggtccaaaacacctgtaatatcattctcactggataggaaagaggaaaagatatgtaactgggaaacctaaaatacagaccctatagatgtattaattggtgagataaaactaagatcattttataatataacaaatgtgaggtcagattctgcttccataccacctagttctttctggacagaaaagtcaaagagctttaaccttcataaacacagaaaacatttaacttcctgagtaatgagaaagagccttggtcaaagctgggccttgctagaaccaccaatataggacaatttcagttacatttggcattctgaagagccctactcggtactgtactccaaggggccaagtgcctgtgtatccctagtgagaaagctactgtatactttataaaaaataaacattgccagtgtatcttcacaaaataatgacctcttgcaaaacagaatcagttcttagcttaaattcaacaattagttcttattctaaaagtacggttccaacaatcgccacttcattaaaagcaacagcagccaagaatttgctattctaacacacgcaggtttggaacagaatttgtatcacattgaggaaacaattatataaagtacttttaaaaatagaaatatactagttgttttttcctttttaaagtagtaacacttgctaagtttaaggaatttgaaatgtataaagaagctacaggaaagggggaaatcatatgcgatcctatcactcaaataaccactcaatattttctgtgtaatttttttaagtacatcagttttgaaacatatttttttttaaagctcagagtttataatgaagagatagaagactcaatacatacagtatccacactaaactgttgtgaagatccggatctactaactccatgtcatccaaggtaattgacttcccaagcaattgcttataaaaaggcaatgtgaaaccaccatcaatataatgtccatgaaacacagccattcccattattcgtccaacaaagtggaaataggataaatgttcctgaaattgaaaacagtatatatactcgttaggcactacccaggaaaattttaataaaaatgaaatatttcagcaacattaatctttttgagaataagcataaaatttttactcttcaatagagtcaggagggagtatttctctagggcatgctccagagtctctagatcaccagagaacagcatattacacagggtaatatgcccttctcgcaggggccagtcattttgtaaattttatcttttagaaattaagtccaaactatggtcccggagcttcattcaactacttgcagatccttttctcttccttctctcacctcctgctgagccctttgtcatgaaaaaaaatctttcaatcctaaacctccctacttccttgacctaaccagaaattaaacatcaaaacaccatagatttaagagcacagacttggtgtcagacttgaattagaatcacgattctgccagtcaatggcatatggacaaattaacccccgtaagactaactgtccacatctggaaatatgaggataataacagtatctaaaaagcatctctatgaggagtaaaatgaggtgatgtttgaaacccatggaactggacctggcatgttataagcagtcaatgagtctgggctattgttactacaggggcagtagtgggccctccaaaaagaaccttcacctcaaaatcctccctaaataacttcttgaaacaaatctaacatttctacccttttatatatatttggtctttcgtcacagattgttttgttagatgtttgtatttttaaattcttttacctctctatttactaagtaatcttttaagctcgtctttaaaccttttatcttgtttttgtttcttttttaaaagtaacacacgcgcacgcacacaaacatatatatttaccaaagttgcattatactatttgataaccttcgtttcacttaacacatcataaacaccatctttccatatcattaactattatcccacattatcattttagtggctgtatagtatgcccttatatggaaagacaatataaaaacaatacattagtaataactgctaacttctgttgagtgcttagtaatgtagttgatagagttgtagagtgaataacatacagcactgtgctaagtgcttaatgtgcagggtcccatttcattctcataacccctctttgaggtacaaatgtatttattagcaatgacaaaactgaagcttaagtccatgaacttgccctgaaaggtcacaaagctagtaagtgatgagaccacgacacgtctttctaattccagaacctatgcctttaatcatttgcattattctgcttcatgtcataatttaatcagtccccgctcctgaagacaactatgttgttttcagttgagtgctactataaacaataaacatccctgtttccaaattggtgcatatatccataatcatctgcttgggaaaattttatagaaggggaattgctgagtcaaagggcacaactaagacaaggacaaataatttctatataataaactacattaacatgtaaacatgaaaagcattattggtcacaattcacatcataacttcaaatcataccggattaactgcagaatcaggattgatctgcaatgtataaatatcatctcttgaatactggaagaggccatagtatggattcaacatttcatgtgacaagagatacaaccattccctagaaaacaagatatgaccaaggaatttttttgttaatgtatacatttttattaagatatgtcattaactaatcattttagcaaataattatttaaattaataaaaggcaaaaaagcactaactacagttatataagatcacattggaaaaatctaccgtacccaaatagcatataaaaactctattatattgaagtaacatctcacgcaaaatttaggcaattttattatattttagcatcaaagagtataaaagtattatccaacagttcagctactcacgagatgatacggtccagtggtctgttacttttaattgccaaataaatttgtaatccataataaacataaaacaaaaggaagaatatggttttatttcaaaatgtccatgtgaggctggggacggtggctcacacctgtaatcccagcactttggggggccaagacaggtggttcgcttgtgctcaggagtttgtgaccagcctgggcaacaaggcgaaatcccatctctacaaaaaatacaaaaattagccaggttgatggcaagtgcctatagtcccagctacttgggaggcagaggtgggaggattgcttgagccctggaggttgaggctgcagtgagctgagattgcaccactgcaccccaggctgggtgacagagaccctgtctcaaagaaaaaaaaaaaaagtccacgtcatctctattatcctggtctactcctatcacgaccagtttatacagacatataatatagtattgatttactcttcattttggacaaggctatattttgttgtagtattaaggacatttcattattcatttcattatcattcactgtataaaccctgaaacataccatgataaaaatataagtgggcaaggattgcaaggcatttggtgtaggtatggactcaagggcaaacgtgcattctttgggtatgttccataccacttcttgacttcaatgtaaatcaatgtttttaaaacctggaataaaaagtacttccaccttgaatttattaaaaccttcaaatttttcaaagtataaaagataatttgttactcactttggaaattcactagtctaggacttaagagatgtagttctagtcttaattcttgtcattccttggctagggaaggttatttaaatgatatattttgatattatggattaaacagattgaataatatttttgagcaaatgcagaatagtattaaaactagttaaaggaaactgtttcaaaattctatgtgatggagtctaaattaaattactaccattatgtaacatttgaaaaactactctagagattaaaaaaagaagtaacgtctccacataagcagccttcccaacataacactcatctgatgtgtcttgtgtttttggtgtgtgtatgtgttttttaaaaagaaaatccaaatttttgttttgttttaccaagtatttagaacacaaataagagcagaactcaactactttgagattctactatggaataaagttcagaaaaagcagatcactgtcacattccatttattctgctcaaaccctgacagtagtaaggttaaaaaacaaaaaactgggctgggttcggtggctcatgactgtaatcccagcactttgggaggctaaggcgggcagatcacaaggtcaggagattgagaccagcatggccaacatggtgaaaccccgtctctattaaaaatacaaaaattagctaggcgtggttgtatgcgcctgtagtccagctacccgggagactgaggctggagaatcgcttgaacccaggaggcagaggttgcagggagccgagattgcgccactgcactccagcctggcgacagagtgagattccatctcaaaaacaacaacaacaaaaaaaactgactacgagccaggcatggtggctcgcgcctgtaattccagcacttagggaggcggaggctggaggatcacttgaggccaggagtttgagaccagcctgggcaacacaagatcctgtttctaccaaaaaaaaaaaaatttttttttttttgagacggagtcacactctgtcaccaggctggagtgcagtagcacgatctcggctcagtgcaacctttgcctcctgggttcaagtgattcccctgcctcagcctcccgaatagctgggactacaggtgtgcgccaccatacccagctaatcttttttttttagtttttagtagagacggggtttcatcatgttggccaggatggtctcaatctcttgacctcgtgatctgcccacctcagtctcccaaagtgctgggattacaggtgtgagccactgcacctggccaaatttttttttttttaattaggcatggaagcatgtgcctatagtcctagctctttaggaggctgaggcaggaggatcacttgtacctaggagttcgaagctgcagtgagccatgatcacaccactgcactccatggagcctgggtgacagagtgagaccccgtctctaaaaaactaaataaataaaataaactacttatttgatctatacatataattatagtacttagatgccaccagtagttgatgatgaagtgttcccaataaacattcactctagttatgagtaagtaatacaaattccacagaaactgtcaagtcctaagtatgatgtacaagggattatttttaaaaatccacactaaagaaactatccatccgtaggtttaaaaggtgacagaatgaaaataaggctacaaatacacacatgtaatgctaaataacaattaatgggaattattgaaaacataattttggttggatttaagattagggaaagcagaattaccacaatgatccttggaacatttcaatacagagctacagtgtttctccatttatataaaacgaattttcacacatagaaaagaattcttgtagtaaatataatatcagaaataaatcactggctgggtgtggtggctcacacctgtaatcccagcacttcggaaggctggggcaggcagattgtttgagctcagaagttcgagaatagcctgggcaacatggcaaaaccccatctctacaaaaaaaaaaaaacaaaaactagccgggtgtggtggcttgtacctgtagtcccagctactcaggaggctgaggtgggaggctctcttgagcccaggatggggaggttgcagtgagctgagatcacgccactacactccagcctgggtgacagagggagaccctgtctccaaaaaaaaaaaaaaaaaaaaaaagaaagaaaattaatttgacttgacctgtgagttacaaatgtagcagaagcattctaccttctgtactgaaacattctgaggaccatcatgatatgtacatgtgtatacacacatgcatgcatacacattcatttaacaaggaaaaaaggcataacaaatggaagcaaagagaaccagtattcagttcaggttatatatcatttaaatctcaaaactgttcctgacaatgtaaagcagaggcaataatgtacttaaagagagagatggagaaaacacagggcctgcagtctcatgggactcagatggtctactggggagttccagaatacttgtccggtagcagtgccaccctaacctcattatgaatatatctattaggatatcctcagtgatacaaacattagggaataacaaaaaataaatgtcgatgagaaagttacaccacaggaagtagcttaaatttgtaagtacaaagatccatatgtcataagctggcaagcaagtccatacctggcaacgcctccatagtcaaggccttcttctccacgaaattttatcattaatcgcttccagagatcttttggtctcattttcatgacctgtcgatatgattcctgaaaaaaataatttttaataccctattactattaggtccttttagcctattacttaatctctccctgccaatccatccaaaaaactcaagtctaaataaggtgaaatttggccaggtgcagtagctcacacctgtaatcccaacactttgggaggctgaggcaggaggatcacctgaggccaggaattctagaccagcctgggcaacatagtgaaactctgtctatacaaaaagttttttcttaaatagctgggcatggtggcatgcacctgtagtcctagctacttggaaggctaaggtgggaggactgcttgagcccaggagttcaaggctacagtgagctatgatcatgccactgcactccagcctgggtgacagagcaagaccttgtctctttttaaaaaagaggccaggtgcagtggctcatgcctgtaatcccagcactttgggaggctgaggcgggcatatcacgaggtcaagagatcgagaccatcctggccaacatggtgaaaccccatctctactaaaaatacaaaaattagctgagcgtggtagcgtgtgcctgtagtcccaggtactcaagaggctgaggcaggagaatcgcttgaacccaggaggcagaggttgcagtgagctgagattgcgtcactgcactccagcctggcgacagactccgtctcaaaaaaaaaaaaaaaaaaaaaaaaaaaagagagagagagaaaaattagcactctcggtattcttggaaaagagcataaaacaaatttaacttctaatttttttttttttttgagacggagtttcgttcttattgcccaggctggagtacaatggtacaatctcggctcaccgcaacctccgcctcctgggttcaagtgattctcctgcctcagcctcccgagtagctgggattacaggcatgtgccaccatgcccagctaattttgtatttttagtagagatggggtttctccatgttagtcagcctggcctcgagctgcgacctcaggtgatccgcccacctcagcctcccaaagtgctgggattacaggcgtgagccaccgcacccggccaatttctctctaatttaaaataaggtttgtattagcaagcaatgggtttctggaaaaaaaaatagtaaaacaaaataaggctcgtaaatttacctcaaaaatctcttccctggaaacctcaatgcggcaatgacctgcctgaggctgttgttgggaaagttcttgccgcaaaatttttagtttctgaaccaggtctcgcttgtaccttgggactgtcaggcattctgtgtcatcaggacataacgataccacttgctgttgctgttggtctttcaattggttctgccgactagaagtaaacatagatgttattattaaagtatatcaaattttaaaaattgcaattatagatttaaaatagcatcatattataaagcaagtctagctctatcattttccaagccttagtagaacatatacttggcttgacattttttggcagcaataaaccagctacaaagtttatttctcatagtccacataaactgacagaattggataatggaattttatccataaagctttatacagcttctgaggacaaatttttccaatatagcttccattttcccctacagagtttaccatcacccactttaaaattcaggcatgtgccaaacactgcttgttatctagactctttctttctggaagagccaaacaggagtctgaaaggcagcttggcagggatcccttctttttatacaccaggccaaatattatacctaaaacatatgaccatacaaagaaaatacacctttgtttaaaatgccaagtcaatattaactactcttacaaatactataataaagatgttttaacatacacacaaaatcaaaacagattaccgtgtacataaatgcattccataaacaactgtataatcttattttttaaatgaacttgggtatatttcatatcagatacaaaaagtaactcaaaatggactgcaaacatcaatgtaaaatccaaagccataaaacttctaagcacaggagaaaatttgttatgacatacatcaggcaatgaatgatttcttagatataacaccaaaagcacaatccatgaaagaacaaatggataaacagaacatccatttttaaattttttttaaagaggcagggtcttgctatattgcccaggctggccctgaactcctggttcaagtgatcctcctgcctcagcctcctggtagctagaactacaggcacccaataccaccctcagcttaaagaaaattgctgctcttcaaaagacactgtttaggaaaactaaaagacaagtcaagtcatagactaggaaaattcctttggaaagcatatatcagatatgtaaatatctaaagaagctcaaaactcaacaaaaaactgagctgctcgatttgggagggctgggggcatggcaaaagattctgccaaagaagccattctactcctaggttatttatttaaccaagagaaatgagggcatatacatacaaagacttgcacataaatgttcataatagttttatctgtcatagcgaaagactggaaacaacccaaatgcccatcagtagataaatgaataaactgtggtatacccatacaatggaataccaccaacaatacaaagaaatgaactatgtaacaatgatgaatctcattatgtgagtaaaagaaatcatactgcatgattccatttatctagaaaatgcaaactaatatactgacagaaagcaggtcagcagttggctggagatggggtgttatgggttgagctgtgtgtcccccaaaagatatgctgaaggctcaacatctggtcaacctgtggatttgaccttatttggaaataaggtctttgcagataaaattaaggtgaggtaagatcatactggattaggatggccttaaatccaaaaactgatgtctttataagaagagggaaattaggatacatacatacaggaaagaagactatgggaggacagaagacaaagactggagcaatttgtctacaagccaaggaacaccaaggtttccagaaaccactgggaagttaggaaagaggcatggaacagattctctctcaaagcctctggaaggaactcattatcacttactatagagtcagccccttaccctgtagttctgcctccagaattgtgagagaatgaatttctgttgttttaagccatccagttcgtggtattttgttacagcagccctgggaaactaacacagggtggaagtcccacagggagggacagaagaaatcacaaaagggcaagagaaaacttttgggggtggtgaatatgttcactatcttcactgtggtgatggtttcatggtgtatatcaaaacttaaactgtacactttaaatattcagtttattgtatgtcaatatatttcaataaggctgattttaaaaaatccagcagatatcaggcctcttcacaaagcctcctgtgaaagaccaagccatgcaaatggaaaggtggcttagagctgaaggacaaaaacggacacaggagaaaatccttctgggatgtgggcagctagcctggaactattgttcctgatgcactcagggaaaaaaaaaatctaactacccaataaagcagcctgtctcttcaggtgtgctagggtgcaaggggcagttctgtaagggctgatgtgagagtgcaggccaggaaacagtgggggtgctggtctatcctttagggcctctgccaatgtctaaaggctttatcaaacaagcaaatgattttcttgaaatcaagtagatctgataagcagggaaaagactcaaattgtaatccccttgcccataagtcatctttttctttaaaaagaaaagcttcctttaagggtataaggcagaatatcttcatgcaatgccagtcaaaggaagggaaataagtaattagtgttactggaatcaaaacatgaagggaaaaaaaaaaacctccatagtcagactgggtggattcaaatcccagctctagcaccttttatgcacctctggacaagttctgtaactgcttgaggccccatttttctcactgatgagaaagaggtagcccaggattgcaatgaagatgacatgggcactcagagcatggtaagtgcaaaataaatatcagttactatagctactattaagatagttactgagttacaaaaacatgcttttcaagcaaaggaaataaaaaaaaaaactgactaaaatgctttcttagaagaatatgcttccttggcaaagttatttattaaaccccaatggcaatgttttgcaatataatttatattctaatgacatttttgccaaaaaaatttccaagagagaaaaacaataaaaaccataatagatgtaccaaataaggtaatactatatttgacggctcatagacatagattcaaaactccgttaacacttgtctaaagaaaaaccccccaatttaaaaatctttaaaaaatagaaatcaaacattaatagaaaagatacttctatccgacatatcctgatatgtaaagattaataaattaactgttataatttaaaattagtgccttatgaatctttttaaaactacaattttaagattaaaattgtttcttatgtatctcaataaattgtttcacatataaattatatactacattacatagctgaataaaaactaatttatcactttaaagttaatttatgacagaaactttaatgctgcaaataatttttatatattttatgtaatgtaacacgaatataaaccccagggaggatctatcaggttagggactttaccgaactagtagctggagttgtgaaatcctgtccttaagaagaaaaaaacaaaacaaaacaaaacaaaaacggatgtagaaatgcttaagctttctggttttttttttttttttttttttttttttttgagacagtctcgctgtgttgcccaggctggagtgcagtggcgcaatctccgctcactgcaacctccgcctcccagggtcaagctattctcctgcctcagcctcccgagtagctgggactacaggtgcctgccaccatgcccggctaatttttgtatttttagtagagacggggtttcaccatattggccaggctggtctcaaactcctgaccttgtgatccacccacctcggcctcccaaagcgctgggattacaggcgtgagccatcgtgccccgctgacagagagtttttttttttttttagatagagactctgtcgcccaggctggagtacagtggcgcgatctcagctcactacaccctctacctcccaggttcaaggaattctcatgcctcagcctcccgagtagctgggattacaggcatgcaccaccacgcctactttttttgtagagacaggtttgtcatgttggccaggctgatctccaactcctggcctcaagtgatctacccgcctcggcctcccaaagtgctgggattaccagtgtgagccaccatgcccagccttaagctttttcatagcacagtaacttgaaatcaaagatattgaagagaggaacaaattaatactaaaatacaaaaatgttcaaatgaaaactttctattaggaatatgtataaaacttccagataatgcaaatgctggccatattaatggaaactaatcaacaaaattggaaaactaacaattataagaaaactagtcaaatgttcttcaagttacttcctgtcatttactccaacaaacagaaaagacaacagacatttctaatcatcccacctgtagttattccttcagaacattatttttcattcagttatttaatacaactaactattcagcaaaaagatggaagatctgtaactgttctactgaaatattctactggcaacatcaaggcaaacatctattacctaaagcagagatgtccaatcttttggcttccctgggccacactggaaaaagaactgtctcaggccacacataaaatacactaacaatagctaatgagctgttaaaaaaatctcataatgttttgctttgtttttgaaacaaagtctggctctatcacccaggctggaatgtagtggtgtgatcttggctcactgcaacctccacctcccaggttcaagcaattctcctgcctcagcctcctgggtcccaactagctgggattacaggcacccgccaccacacctggctttttttttttttttttttgagacggagtttcgctctattgccaggctggagtgcagtggcgctgtctcggctcactgcaaagtcagcctccctggttcaagcaattctcctgcctcagcctcccgagtagctgggactacaggcgtgcaccaccacacccagctaatttttttgtatttttagtagagatggggtttcaccgtattagccaggatggtctcgatctcctgatcttgtgatccacccgccttggcctcccaaagtggtgggattacaggtgtgggccaccgcgcctggcctaatttttgtatttttagtagagacggggtttcaccatgttggccaggctggtctcgaactcctgacctcaggcaatccgcccgcctcagcctcccaaagtgctgggattataggcgttgagccactatgccttgcccacataatggtttttaagaaggtttaccagcttgttttgggccacactgaaagccgtcctgggcccagcctaagggccgtgagttggacaagcttgacctaaagggatgatcctggaggcaggaggtaaataaagcacaaccacctcttggaggcttcctgggcctctcagagagccatactggctcttgattaccattgtacatttgtcaagtactttgggtatgttacatactaaagcagcaaaaataaatgggatacacgtcttcttaagtaattcaaagtctagtaggggaagcagaaaggtaacaaacaattaagatacaaaagtaaaacaaaagccctctgtagagtgctccaacatcttttattccttatcatctccccaaattccaatttgctgcccctatatgccctttaaaaaaacccaggccgggcacaacggctcacacctgtaatcccagcactttgggaggctgaggcaggaggatcacttgaggccaagagttggagaccagcctggctaacacggtgaaacttcgtctctactaaaaatacaaaaattagctgggcgtggtggtgcgcgcctgtagtcccagctactcaggaggctgaggcaggagaatcgcttgaacccaagaggcagaggttgcagtgagctgagatagcaccactgcactccagcctgggcaacaaagcaagactccatctcaaaaaaaattccagaactaggcgtggtggctcacacctgtaatcccagcactttgggaggccgaggcgggcagatcacctgaggtgtcaagagctcgagaccagtctgggcaacgcggtgaaaccccatctctactaaaaatacaaaaattagctcggcgtggtggcaagcacctataatcccagctaacttggaaggctgaggcaggagaattgcttgaacccgggatgtggaggttgcagtgagctgagatcacgccattgtactccagcctgggtgacaacagggaaactccatctaaaaaaaaaaaaatccatacacaaaagtaaagtccacatggattaaagactttacagtaaaagacaaaactataaatgtattaaaaacatttacttgtagtgtgaattttagaagataaagattacattagaaaaataggcaaaaaagatataaattaacaaaaaaagttgatgcagctggtcaataggccaaaaaaaagctgttcaagctcaatagacaatggcaaaaaattgtgaacaggaccttcacaaaaacaggaaatccaaatagtcaataaacctataaaaaggtgctcaacctcatcagtaattaggaaaattcaagttaaagttacaatgggaaaccattaaacatcatcagaacagcaaaaattttgaagtccaacaacagcaagtactggcaagcttctgcagcaacaggaactcatatattgccggtaaaagactaaactggcatagccactttagaaaagttacctttatacattaaagttgaagatagaaatattctacgacatagcaattccacaaccaggcaagcgccctagagcagtgttactcaaagggtagactgcagatgacacttattttgctatctaggctataaagaccctaatgcacagaaacagtccatacttctctgtttcttcagatacttttacattagggctttcaaatacttgcgaccttcatttgtaagcaaggttttagaatcttctatctacaataaagtaagatctgctgacataatgagactgccaggataattatacatatttcgaagaaggaaccaaagatacacattttcaatgttttctcctattatcctaaaaaactggtagccagttctcatttaaattttttgctttattaacctaactccaaaaattaatgaaacaaggacattttcagaagtcattttaaagtatattattatttttgttgtgtttttaacattttaacatacataagaactttacaacaaatgaataagacagagcaggtaatgtcaccattcatttagagaagctaaaatgaattattcaggggtcagagtgaaccttgctctccaagttcttagcctaaaatccttgttgctataccactctcagtgtttttgccagaagtgttgaaaaagacactttgctacttagcttagtaatgaagttttcctgttctctcttttcctcctcctgcccccattcttcagaaggcaatgctaataagtaacagagttagaagaaatgaggcagctagagagaaaagaaaagcaaaggatgcaaataatatacacacaatactcagtatagtgcctcacaggcagctgaagccagagcatcctggtttcactccagacttcaccactggcaacgtatggaaagtcatgtaacctctatacctcagtttcctcatctgtaaaaatggcagtagctaactcacagagtttttctgaggatgaaattacgaacttggggtgtttttgtttgtttgctttttaaagacaagagtctcactctgttgcccaagctagaatgagtggcgcgatcacagctcactgcagccacgacctcctgagctcaagagatcctcccacctcggtgtcctgagtagctgggaccacaggtgcgcaccaccatgaccagctaattttaaaaaaattttttgaagagaataggactcacatgttggccaggttggtcttgaactcctaggctcaagtgattctccaacctcagcctcccaaagtgctgggattacagcatgagccacatgcctggccttaccaacatatgtaaagtataaagaacaatgcttgtcacacagtaagtgctactaaggtgttagccattaatataaattattaataattttgtattacaatggcaacacaaaattagcctgttcaacccctacttctcctgtcaagatattgcctctgtaaaaggccatcttgagcacctctaataacccttttcctaacattccaagacaggttcctacctaaaagcatagtaggtttaaaatactcatatcagagtaaaccttgtcacactcttacataaattttgctcaataaaagtaaattataactgatgaaagtagatgttctttcattttttaagagacagggtctccatctgtcacccaggctggagttggggtggtgtgatcatagtccactgcagcctcaaactcctgggctcaggcgattctcctgcctcagtttcccaagtagctaggactgcaggcatacaccaccacacccagctaattttttaatttaaacaactttttttttgtagagatgaggtctcactatattgaccaggctagtctcaaacccctggcctcaagtgatcctgctgccacggcctcccaaagcactgggattaaaggcgtgagccactgtatcgagactcacatttattattaaaagcatctatgcgtttcatcatgtttaactcccattttaacatgtattgtttcaaaaacttactttaaaactaaatgcaagttagcagacagccgaggatctgtaaattgtgttgttctgttgttatggtcaacgaaataaactctgcctgttgccgtattacggatctcccatccaggaggcaatggaccaagctcttcacaattgatgttgctaagatccctgcaaaaacaaatataaaataaaaaatacctcattgctcgccctgctgaaccaagcaagtgtaaatgacacagaacaattccacaaagtgtgagaaaatgtattgtttcagaaacttgagatgttcagctggaatctttaattcccaatggtttaacaaactttcatcttcaaagcccaatccataaatggctcagaaaaacttatcacatagcctacattttttagtaatttcctaggctttaatgtaatacagatttaaattaatataaaatcaatcccaatatttgccaacataaactgtatttcaacacgtgtttgacaggaagtaattttacaagtgtcagtgacataaagaattaaatgctttctaaaatgtcccttcatttctttactataccataaaatttgcataaaatgtccattccataattttaagctcgccaacaaagcaaaactggaaatgttactgaaattatgatcctgaaaataatcacagcatatttttaaagaataaactgcaattctaaaatctgtaaagttagtcaatgaagaacctgtttaagatacattaccaagagtgctctaagggttaccactgcaataagaaaagctaagatttttaatggaccaaagactattgctattatattatacattcttaaaatactagtatatatagagaaggattaatagggccttaaagaatgagttaaggagcttccaggttggtgaacacactgaggtactggacggtggcctgcccagagagggcatggtagctccttgccctccccccatactgtgtcctaagcattgcttccatttggctgttccagagttgtagcctctgtaataaactggcaatagaactgcaaattcttatcctctacactgttagaaaaaaatatttcagtgaagcttccaaagtgtggaaattgctgttgtcatccaccagaagagaaaagtcactgcccttggtgacataattgagactgcgtgtaacaatgtatgatatgatcaggtcatttcctgccttaaatgaatactttaggttaccagagccatgtgtaaataccaaagaaacgacatactctgaaagtgaccaagcaaactcaagcatctagatagtaaaactgtttttgtggtcctctttttattaaaaaaaagaggaggaggaggaggaggaggaggaggaggaggagggggaggaggaggagggggaggaggaggaggaggagggggaggaggaggggaggaggaggggaggaggaggaggggaggaggaggaggaggggaggaggaggaggaggaggagggggaggaggaggaggagaagataaaagcagcatgtttatgtaaatttaaattgtaacagataattataagtaatcacaaatttcatcaaaaccacattttaaaagttatactagaaaaatgtttttcctgagatgacttctccttagtcacagtgaaaccaatgatgggcacacagggacctatatttgccaaagcaatcattctgacttctgctataggtgttccaagagactcctgctacagaacagctaaagtgtaggaaaaaacaccatttgaaacactgctagtctcaaaagaggcaagggaaagttccaagaattctcctcaaattttaaaaaaaagggagttcgggggactgagtaaagatggtacctgagtggcaggtaggcagaagggcaggccagcagcaagactgggataggaaacctgaagcttcctccccaagctgagaactcagggagttcagcctcccaaattcagcctcccaaagtgctgggattataggcatgagccactgcaccggccccaaatagatttttaatggtttagaaatgaaaaacaggagctggaggacattatccttagcaaactaaagcaggaacagaaaaccaaatattgcatgttctcacttataagtaggagctaaatgatgggaacacatggacacatggagaggaacaacaggtactatggcctatcagagggtggaaggtggaagaagggagaggatcagcaaaaataacgaatgggtactaggcttagtatctgggtgacagaatcatctgtacaacaaaccctcatgacacaagtttacctataacaaacctgcacatgtacccctgaacctaaaagttaaaaaaaaaattaaaataaaaaatgaacaattctactgataaaatgtagaatttcatttcatgtcattttatttagaattttataaatctacagtcatacacgggagagtgctaaagcactgattaaaagagcaaaacactagaaataatctttatgtctcactgggagctggttaaagaaaaatggaatgttatacagtcatacaaagtaacacagatctgtatttcaagactacagtcactcagtatgcaatataacaaataacaaggcattaaccattgttttaaagagaaatgcaaaacatgatgaaatgagatttcttggataaatctaggtatcctggatatctttaaataaagtttgttttaaagagtctgactttgcaattttataaatatcttcgaatagtgatattgtaatagaaactaaatatttatagtatactttcataaaagatcttccatacaaaaggcatatttgctaaaggatcctccaaaacaaaagatgtaagtttttaaggtaatttgggggatacagaataagaaaaataatcccaagtgttatttcataaaatcatcattcaaaatacatgtcaatactcaacatgagatattcttaaagcttcgcagaaatcctttactcactaataaaaaactgacatgtttcctctggaataagagcctgttaccaacagtggtgctgaaatctgtctcaatttcaatttctgttgccagcttacatactattctttcaacatgtaactcaaggtcaactttctcactattgtaaatcatttagttaaaaaaaatgatcattgttattctatacatttcctacaagtaatttctaattaatttaaagaaaagcttattattgaccttcaactagataaacagaatccaaaaagctttttacaatttatataataaaactgattttgaaaagttaggcccttggattttttttttctttttttagtaagcttaaaaaaaaaaaagtaaaatttcctccccactactttttatctatttatttttttagagatggggtcttgctctgttgccgaggctggagtgccacggtgcgatctcggctcaccacaacctccacctcccaggttcaagcaattcttcttcttcagcctcctgagtagctgggattacaggcacatgccaccatgcctggctaattttgtatttttagtagagacgggttttcaccatgttggccaggctggtctcaaattcctgacttcaagtgatcctcctgcctcagcctcccaaagtgctgggattacaggtgtgagccaccgagcccggcccccactactttttaaaaactaacagcttatattgtcaagacatggaaatggcaaccttgataaagtaatgagtaatagcacattcccttggttgccaccctcaaagaattctgagctctataacacaaagtaagacattttcataatcacagttttatttataaatagagagtatcaaagcaacccaagactagctagtcacatctgttttttattcaaatacacaatagagtcctgagcataagctttaggcaggaaaaaaaaacaaccttctgtgggttgttctgggggtttgttttggaggaggggcgctgctgtgcttaacataaaatatccacatcctacaaatcctttgtatgtgcaacatacaaagttgatttagaatttaatttagaattcaagcttttttccagttgtaactggactacttggtactttgcatctgttcattaaaaaataactcaaaatagggccaagcatggtggctcatgcctgtaatcccagcactttgggaggccgaggtgcacagattgcttgagctcaggagtttgagactagcttgggcaacatggcgtaaccccatctctactaaaaatacaaaaattagcggggtattgtggcgcatgcctgtagtcccagctattcaggaggctgaggtgggaggatgacttgaacccaggaggcagaggttgtagtgagccaggactgcactgctgctctccagcctggacagcagagctagatcctgtctcaaaaaaaagagagggagggaggcagggagaaaacaatgttccaaaaattatggtaaatcactaaatttatttgtgtgtcatttcatctttttgaagttaaaagtaattgacattttggttaggaaatgcaatatctgcagctgaaatacacaagtttggatatttaaattaaattagggccaggcacagtggctcacgcatgtaatcccagcactttggtaggtcgaggtgagcaaatcacctgaggtcaggtgctcaagacaagcctggacaacatggcaaaatcccgtctctactaaaaatacaaaaattagctgggtatggtggcaggtgcctgtaatcctagctactcaggaggctgaggcaggagaatcacttgaacccgggaggcggaggttgcagtgagctgacattgcaccactgcactcccgcctggacaacagaatgagactccatctcaaaaacattaattaattaattaaattacgttgttttctaaaaatggaattttattaaggaacacataacagaacattgaatgcatttatgaggttaaatttttcaaagatttttttttaagctgaaccataattaagaatatcaacctactacccgtttttaaagggtatgtgttccgttattccccaggtcaattttctttttctatccttttttttttttttttttttttttttgagacgggtctcgttctgtcacccaggctacagtgcagtggtgtgatctcagctcactgcaacttccgcctcccactttagcctcgcgagcagctgggactacacgaattttctttctctttttttgaaatggggtcttgccccagccatcccattactgggtatatacccaaacgattataaatcatgctgctataaagacacatgcacacgtatgtttattacggcactattcacaatagcaaagacttggaatccacccaaatgtccatcaatgatagactggattaagggcacatatacaccatggaatactatgcagccataaaaaaggatgagttcatgtcctttgtagggacatggatgaagctggaaaccatcattctcagccaactatcgcaaggccaaaaaaacaaacactgcatgttctcactcataggtgggaattgaacaatgagaacacttggacacaagaaggggaacatcacacaccagggcctgttgtggggtggggggaagggggagggatagcattaggatatatacctaatgtaaatgacaagttaatgggtgcagcacaccaacatggcacatgtatacatatgtaacaaacctgcacgttgtgaacatataccctagaacttaaagtataataaaataaataaataaataaataaataaaacactaaaaaaaaaaaaagagagagagagagagaaatggggtcttgctctgtcatccaggctggagtgctgtagcacgaccaaggctcactgcagcttcaacctccatggctcaagcaatcctcttgcctcagcctcccaagcaactgggaccacaacagatgtgctctaccacatacagctgatttttaatctttggtagagaccaggtctatgtggctcagactggtttcaaactcctggggctcaagtgatcctcatgcctcagcctcccaaagtgttgggaatacaggtaagagccacctgcttggtgccctaggacaaatttcaaactcctaaaagatccatgttttcattccacttttttttttttttttttttttgagacagagtctcgctctgtggccaggctggagtgcagtggcgtgatctcagctcactgcaaacctccacctccctgggttcaagcgattccctgcctcagccacccgagtagctgggattacaggcacgcgccaccacgcccagctcatttttgtatttttagtagagatggggtttcaccatgttggccaggatggtttcgatctcttgacctcatgatctgcccaccttggcctcccaaagtgctgggattacaggcatgagctaccatgccctgcctattccacttttttttaaggggaagcaggggagggtggctaggaactggtgagggaggggagaactgaggtgggattgcagagcagtaggcaggactttctactaaacgttaaaactgaagtaactatcagaagagtcaaacttttacataaactatttttaaaaggtaaaaatttcttaaaaatcaaagaaatcctaggtgaaatggctctttgatggtctaaagagtgcttaaaatacgttcttacctgggcactcttggatcatgccatgtgctcacaccagtctgtgtatgtaagaaatacacctggccttgttgcgttgtcctctgttctgtaaaattaataaacactgataacaaaaacattcagagtgtccagatcaaagacagttatatacactaagatgatatactaatagggaaaaatctccaaattaccaatctattttatttattatcaaaaaagggctttacaaatcatttgttctgtctcttggaaacaattttacaaatgatgagggccacaggccagctatccataaacaaactaaacttataacgtggcttaaatactaaatatgttgcaatggaaaacaaatcaagattgtcacaatactaataactaaaaaattttaaatgatgtataaaaggctctgagaaagaggctggccaacattgggaagatttgaggaggaacttccagaaattttcaaagagtctggaggttgataatgcttattatgcctaattttataccaaaacttatgttttctctttgctagacaaaggtatattctcaagattacatttgagctcaaagagaagcaaaacagatgagatactggggagacattctatgtcataaacagatagagatggaaaaatagccaaattagaaagaagaggactaaagagcaagcacgcacactggggagaaaaaagtcaaggacaaaatgaactcaaaatccttgggaagacagaggaaaggccagggtgaagagaacaatctctaaaagggtttctttatggtgggttttgttttgtcttttttttttagaacaacagaaccacttttctttagacaaaatccagtgagaaacttcaatacataaaaaactattactaatatttattagtataaatctaatttgtttataaacgtataatgtcaataaatttaaactttaaactttcacagattataaacaaaatcatattactatagaggacagctgtaataacttcagccttggtatccactttatttttatgttttggttgtacagtttttaaaattcaaatcacagaaatattgtagaagtataaccactcccactctaaagagcttgccttataatctcaaagagaaatggcaggagagtatttcttctcaggtctgaacactgataatgacagttaaaatttactatgccagacactgtgccagcatttcacatgaaattagatatcactgatttcttgcaacaaacctagatggttggtgctgttattttcctctatagaggataaaattgaggctcaaagaggttaaataatgtgctcggtgttacatggcaaagccaggatacgaacctaggtcctaagtctgtctgtcactcaagcctataatttaatgattgtgctaaaagttaacctttgagtcatagcacagttaatggacaagttttttcaaattaaagagctaaaatacatttaaaactaaaataagaatcatgcatttgcagaagagttttaaaatatattcttgagtaaaataaaacttagatgtggcaattcccagtgttggtcattagatgtcaacatcaatccaaagtggtttatctatagtctgttaagagggcaaagatgtaagtaaccttggtgagcttttggcaagaagaggaagtcaagttcagactatatacaaggattcacaagatggtattaaattagaaacttccgtattctattaggagaagactcatgttatcttccacatgaaactttataatctaggattttatataagattgtaatcattttatacaaacatagaagtgactcagtcatttacaacaatccaatcagataatccaaaattacagacaatacaaatatatgatcagaaatatgcctttaaaattatttctaaatatatatgtctaaaaaattatgtcataggttgaacttcagattaccgttatcagtaacaataccatcttacctttctatacagtgcctatttacaaaacagtctcacttcatttcgtatgcttctcacactacctttgttataaactagtcatctcacttcattatagaagagcacaaacgctgaggctgaatgatgagcacaaggtcaaactgttggttaggtagtcatctaccacttcaaagacttttcaaagttgggaggttttatatttattttcatgcagaatccctaagctcagattaataactttttcaaaatatattttctgacttcctcagcaaactgaaatcagtaaaccacattttatttttcctttgtagttgtcataccatagccttctggtaggtctggaggagtatgtaaatgtgttctgctcatgtaatttctatgtcgttgtgacctgactctcctctctgccagcctgggatctgaagactgtccacatgttgcaccatttgttccactaattggagtgttctcatcaacaaagcagctaagaggtctgccagggctagaatattcggatgccggtctattgaaaattaacaaggaaaagatgttatcaatttagatatcaaaagtagagttctctagacaatatatatatactgcagtaacaaccacttatcatgtctgaaaacagaatgactaatacaagtataatgacttcaagaactctgagtaaaagcaaacctgaagtctctaagcaccaaagaaatgcaaatgataagcatgtcatcaactatgtatttaaatgactttaatgacatttgatataaaatccatacgtatctgtggatgtgagactggcttacaaaacactgcttgatctagctatagcctctccctcagacctgacttcccaccattctccctcccactctgcttcagccacactcatattcttcctgttccttgaacttgccaaggtcattccacctgagagcagttgctcttccttccatctggcatattcttttctcctactctccctaggcctggctcttttttgtcattcaaatcagtttattattgcctcctaagaggtccctcagacctcccaatctaaaaaagtcacccagtcatttgacaatacatcacaaaaggaaagaagacagtttgtctctttaaggggcttccagtctactattgcagatctttcaaaataaaaaaataatcaagagttcattcttaaattaacatggcagggtatggtggctcacacctgtaatcccagcactttgggagaccgaagcgagcggatcacttgaggtcaggagtttgagaccagcctggccaacacagcgaaaccccatctctactaaaaatacaaaaattagccgggtgtgggggcgggcgcctgtagtcccagctactcgggaggctgaggtacgagaattgcttgaatccaggaggcagaggttgcagtgggcagaggttgcagtgagccgagatcgtaccactgcactctagcctaggcaatagagcgggactccatctccaaaaaaaaaaaaaaattaacatttaaaacaacaatcatccttttatacatgtagaaattcaagctaattttactggttaaatgagtcagaaggaaattggtgttcaagtgaaaccttgaacactgacacaagtacatattcatttgtgctcagatataataaaaatgggtacttcaataaattccttggcagtttaatactagaaatgcaacttggcaacatgagctaagcttttacctgagaattataatgtaaaagagaaaaccttgtgatccaatgagttaagcaattagttctgtataaataaaagtaggtgcagctaatgaaaagaatttggtattttatgcctagtgccagtcctgctcaagaaggggaaaacaggcaaaacaaaacactgcacaagatggcaaattttgttctcacttaaaagggtgaggagaaggggattcagccacatagactatttgttttcagttacttcaaaagcacctctttgcagttcccaaaatttatcttgcatcccaatgtctttatacagtaagctccatgaagtgaccatacctgacattcttcaagatttagttcagagattcctctgcttatcaatttaattcattcgatttttattttattttattttatttgttttatttttgagactgagtctcgctctatcgcccaggccggagtgcagtggcgcaatctcggctcactgcaacctccacctcctgggttcaagccattctcctgcctcagcctcctgagtagctgggattacaggcacccaccaccacgtccagctaatttttgtatttttagtagagatggggtttctccatgttggtcaggctggtcttgaactcctgacctcaagtgatccgcccaccttggccttccaaagtgttgggcttacagtggtgagccaccatgcttggccaatatttttttttttttggggacagagtctcattctatcacccaggttagagtgcacgggcacgatcttggctcactgcaacctccaccacctatgttcaagcaatcctcccacctccacgtcccaagtagctgggaccacaagcataagtcacatgcccagctaatttttttggtagagacagggtttcatcatgttgcccaggctggtctcaaactcctgaactcaagtgatccacatgccttggcctcccaaagtgcagggattacaggcagcctcgaaaagtgcagggattacaggcatgagccaccacgccctgcctcattcaataaatatttattgagtaccactgcaggccctggagctacaatgacagcatgacctgtcaaacaaactgttgaagatcacttttaaaaaataacaatggcacctgttataagatctactgatctacgacagcaaaaaccaagaaaaaaaatctagtaaagctgacagataaatagaaaaggacttcaggagggtggctggcatagatcatgagaaaatatttgtatgttcttaccgtgttgggcgctcccattgcgtagttcttgttatatggtttagatactggattcttccagaggcggttctcctttcttcccagcttaaataaaaatattgagtgataaggcattaataggaaacttggacacagtgcaacaagcaagccagtaagacatctgctgttacaaatcgggaatgccaacccgaagtatcaattcacagaatatataattttttcaacttattttagaactctgtaatatattttatgggattctgaagcttctaaagtatttatgctgaggtgtaacaaatattttccatcagccaaactctgagaatttttaataatgtcaacaatacacaattaaattcatactaattactccagaatatggaaaatggctatactaagaatatatttaaccataaaatcacgaggtctcttgacttcgtgatccacccgcctcggcctcccaaagtgctgggattacaggtgtgagccaccgcatccggccaaaagcttttcaaagcatttagcctacccaaactaattttttaaaaatgaagactattggctggcacggtgtctcacgtctgtaattccagcattttgggaggctagcattttgggaggccaaggtaggcagatcacctgaggttaggagttcaagaccaggctggccaacatggtgaaaccctgtctctattaaaaatacaaaaattagccgggcgtggtagcatgcgcctgtaatcccagctactcgggaggttgaggcaggagaattgcttgaaccggggaggcggaggttgcagtgaaccaagatcatgccactgcactccagccagggtgacaagagcgaaactccttctcaaaaaaaaaaaaaaaatcgaaacagctactttctttttttttcttttttttttttttttgagacagagtcttgctccttcgccaggctggagtgcagtggcgcgatctcagctcactgcaacctacgcctcccgggttcaagcgattcttctgcctcagcctcctgagtagctgggactacaggtgcacaccaccacgcctggctactttttgtatttttagaagagacgtggtttcaccatgttggccaggatgctcttgatctcttgaccatgtagtcctcccgcctcagcctcccaaagtgctgggattacaggcgtaagccaccatgcctggccaagactgctactttctatcaactctttaccataattaatttaatgaaaaagagccaaatgactacagaaatgtgataatgttaatatttctacaaagatactggcagaggttgaagggctctaaaagacagaaaataaagagatgctagggtattttccctcctgtgattacaattatagtacaataatgtagggcaagtttagaacaataagccttattactgctggcactctctcaatattgattagttatttcatcctaaatttccttttcaaaaataccataatctacctcatatctataaaagagctaacagacatatctagaagctaaagtgacctacgaacagttaattatagtgatttttaacagtttaaaaaatgagtaaataccataacctgggtataaaattttgtataaaaaataattggagttaaaatttaaccatttatatacttcaatggatgcaatttattacatgtaagttatatctcatcgaagttagttaaaaatactttgaatgttaaaaataaaatcagaaaagagttagaactagtatcaaagagaccagtcataaaaatcatgactttagaatcaagacaggtttgtgtgttttggctctgccatttattatgtggccttaggcaaataacttctctcttagtttttgagggtaacaataatagtagcaatagaaataatagtagctaattatttactaagcgcttattttatgcaagacactgtgctaaagtgccttacctgaattatttcatttgatcctctcaacagtttatgagtatgctattatcactcatactcttttgtaaataaatataaaccaaagcatatggaagttaaataaattaaggtcataaagccaatacacagaatagtaaggattagaactcaggtggtctgatttcagaagcatggctatatactgccttccaagatgctatgagaattaaatgatatgtacataaagtgcttataacagtatctgccatatacatgctcaatgaaatcttactatgttattttaattactattacacaaattatccatcccatccctcttaaatatagcaatgtttctaatttagcacttgcatggcctgttttgaataatttaatcaagcaacatttttttaactagataatatttacaagagagttatatttgtcaagaaatttcatttgtctcctagtcaaaactcttaataaccaaatttaacacatctaatttgtggcttattttataaatttgtcgagacaagatcttccattaattttacaattagaaggaaaatctacattcaatatacgataaacaccatttaatatacaataaacacccacttatttctattcttttaaggatattatctatatatttctctaatgatttcagtgatgttagcttacccgtctggtaaatcgttatcaaataaacgactgcagtccacaacttgtcctcctgtgcctattcggtctctggactgaagacttactattaaatgacagaaatattactaagattcatacaactagaaagaactattataatctaaaatttctatcttcagaagacatctgacttagcttattttaatactttagaatgaactctttggtttctactaaaatttataatttcttttcccatagatttttccctttaggagtaatattagaattctaaggttttctacactttattacgttcatggaagaagcctaattcctttttcaccatagtaatggtgcatagcagagtcactactgtacttaattaagaagaggcatagctgggcgcggtggctcatgcctgtaatcccagcactttgggaggccgaggcgggcagatcacaaggtcaggagatcgagaccatcctggctaacacagggtgaaatcccgtctctactaaaaatacaaaaaaattagccaggcgtggtggtgggcacctgtagtcccagcttctcgggaggctgaggcaggagaatcgcttgaacctgggaggcggagcttgcagtgagctgagatcgcgccactgcactccagcctgggcgatacagcgagactccgtctcaaaaaaaaaaaaaaaaaaaaaaaaaggaagaggcataacatattaagggtgtattcatgtacaaagaagtttgaaaagtccatattaatttgactttaatacttgatcatctgaccatctaaaaaatacactgggctgggcgcagtggcttctgcctgtaatcccagcactttgggaggccgaggcaggcagatcatgaggtcaggagatcgagactagcctggcaaacatggtgaaaccccgtctctacaaaatacaaaaaattagccgggtgaggaactatgggcgtggtgcgtgcacctgcagtcccagctactggggaggctgaggcaggggaatcacttgaacctgggaggcagaggttgcagtgagccgtgattgcaccactgcactctagcctggcaacagagtgagactccgtctcaaaaaaataaataaataataaataaataaaaatacactgtattctagcaagagggccatcctggtattccagcaaaagagcaattcttggattgatggagttttaacaggacaccattatccagtgtagtataaaaccaccacaaagaacgaagaaggaagagatgtgaattctagagcaggctctagtaactagtttagcactgtaaccttgaacaaaacacttaatatacttaaggtgtagataatccctgtctgaataatgaaaaagttacgttaaattatatctctgaagtccttctttgccactccagtattgtttaattctagttctggtaactctcccaaaagacagaaggaggtgtagtcaaacttggctataaatccaacttcttaaataataggtcagcacaacaagtattacatctaaggacccttcattcaaagaagggtctcaaaattctgaaatcttccagctctgtaaacattttgaaagatcagttcaacacagagctccttgatattaagtcccatttagaggagagaacactatgaacacctacttggcaaatgtaaacaaaacattatatgaaaactgtactagacaactgtatcaatcagtttttaaatagataaaacaagtgaaatgcgtaccaaaatacaatcatagtagaaacaatgtattttctcattagcattgtttagaataatagtaagattcaaagctaaagaatttcatgggcttcaatttacatctccagaatgctatgttaatagcacagctattaactggttaaatgaattacatacccaccatgggctatcacacattaaaaatgctacagattttgcaagccttaatgcaaagtaggaaaaaaaaaaacaagtaacaatgctatagaaatgtgtttatggtccaaaaaaaaaaaaaaaaaagatgtttatgataaatttaaaccagtttttaaaaattcagtataatctcctctaaaaaaaatcacaaaaaaggtatacattcaagtaataacaataacgatacattagacttcccacgctcaaacaatcctcccacctcagcctcccaatgtagctggggcataacagttttaaacaaggaaaaaagtttgtactccttgaatcaattatctaaatttgggagattcttttctaaaaaagaatacagcaaagtgtacaaaaatatttgcaagtttcaatgttataatagcaaaaaaattttttaattattaagttatgatatatctatatacttcatcctttaaaaataattaattacaaagattataaatactaaaaatgattatggttaagtgaaagaaagcaaagtaaaaagttaatgttcactggaattaaagacatatacattttatatacatatttatgtatataaaaatactagaggggaatacagttttttttgtttgttttttgtttttttgtttttttgagatggagtctcactctgttgcccaggctggagtgcagtggtgagatcttggctcaccacagcctccacctcctaggttaaagcgattctcctgccttagcctcctgagtagctgggactacaggcacacaccaccatgccacaccagctaatttttgtattttttagtaaagacagggtttcaccatgctggccaggctggtttcgaactcctgacctcgtgatccacccaccttggcctcccaaagtgctgggattacagacgtgagccactgtgcccggcccgggaatacagtttttaaagttagtcttctagtgtccttttctccattttccaaaaagtatatatacctacttacaattatttgttagagggctcattctgaacgaactggaactcattctgtttttgaatgacaaaactaaagaatcataatgtttgagtccagcctgcctctctctttattaatggtcctattatgaacaccagattcacataagagctttaaataaatacatatatacaggcatacacatatttaagagtaaaacatttgttttctatgtggtgtactccagtaggtatacttctaatgtctaacaaagtttgctatttatataaatgcaaattcatacctagtaaaactattgttactactagacagtagttggcaagcattatgtaacataacaaatcaaatacagaaggaacacttacatgtgaaagtgttgtatgactgaatttatttttgagtttttttttttttttgctcccttctcaatctaagaatgacaggaattatcagtaatgatgtagtgtagatcaggaatccccaacccccaggccatggatgggtggggtattggtccagggtctgttaggaacccggccgcacaacaggagtgagtggcaggtgagtgagcattaccacccgagctctgcctcctatcagatcagtggcgacattagattctcataggagcacgaaccctattgtgaaccgcacacacaaggccagctccttatgagactctcatgcctgatgatctgtcactgtctcccatcacccacagatgggaccatctagttgcaggaaaacaagctcagggttcccactgattctacatgatggtgagttgtagaattagttcattatgtattacaatgtaataataataaagtgcacaataaatgtaatgcacttgaatcatcctgaaaccacctccacccccagcctggtctatggaaaaactgtattccatgaaaccggttcctggtaccaaaaatggtggggtgcgctggtatagatacttccctgggataaccacaatagggctttgctatgtggctactctgatggttctctaactatgaacccaattcactgccttgtaaaataaagtaccttcagtaactaaaacctctctgatgggttcataacaaaataatctcactaagttctgttctatcatgaagtgtgacattcctattgaatttttcttttctttttttttttttttgagacagggtcttgctcttgtcacccagctggagtgcaatggtgtgatcatggctcactgcaaccttcgcctcctgggttcaagcgattctcctgcctcagcctcccgagtagctgggattacaggcacctgccaccatgcccagctcattttttgtatttttagtagagatggggtttcaccatgttggccaggctggtctcgaactcctgacttcaggtgatccacccgcctcagcctcccaaagtgctgggattacaggtgttagccactgtgcctggccacatttttcttctttaatttaagaagcctctaagatgaacagtgtccttccatactaggcatcttgatcaaatctctatcaattcttaagaaaggtctcagcaaattttatatcaagcccttccctccaggtcaattcaagacaccctaaataccatataaggctactaagtgcctcatgagtaaggtaacaatttctccctttttccagtgttacactaccattgctcattctgttttttctcaattagcatagattttaaagctgtaaagcattaaacattaaaacaagttcaatagaatgttctcttcttactaaaaaaactagtttgagaattattttcagtaaactttaataacatttataaagtctgaacttagtgctctactatattaggatactttgaaagaattatatcctgaaggatcaacagttcttcacaaaacttttttttttttttacattaaagttttttaaattaagttaacctggatcctggattcactgtaacattttacctggctcatttaattcaggccaacacaatgaagctacagttattatactttgatttaaaaggtattttacactttaggtcagtttgaaaccaaaattcatgtaactttaaattccacacttacctactatctgtcctctaactgtatcattgtcatttggcccgagtttgcataaatccaacctctgatctatttgaagtcaacaaagaaagcaacgaaaaaattagctggtatcagagattctaacatctatagagtgacaataaatttccacaatccattagaaatcaaacctatcatttaaagagttcagatttcaaaaaccaaacactggtgtattacattgccaacatgcagtcactttctctccaaaacttttagaccactttagtctgagtcttaataattgttggtcttaaggaatttatccctaagccttggttttctcacatatgacaatatgtgaatcctcatatttttttgaggattaaatcagataattatgccaaactctcagcatagtgcctggcacataagtggtcaacaaatgttagttgtcattatcattttttaactaaccatttcaaatgacatggacccaaaaaagtattcataagaagccaagaataaactgtaaaatctgggtttgcatcagttctgtcactcattcatttaggagcaaatcatttcttctctcagatgcctcatctgtaaaagagatataacactgacctggccctgaaagttacagtaaggaacaatgtcacctaaagtacgctggttttactttgattacagcacttatagctgaatgcttttacaactgtatgccatctgtctacttatctgtgaattgataaatggaggagaccatatcttagtctttgtattttccactccaatctggtagaacattacatcaggtaggtgctcaataaatatttgataaattcaatattactgcacatcaaaaaagtcaaataaattaatacaatgaagcagtcacaagaaacagaaaaatccatgcccctaaactacagtccctacttatccaaccaaaaatacagacatttttccctttgcaaaataaatgggtgctactaagctggctatacagtggattctgcagagcaactaactcctcctctcctattcagtccttccaatgcggcatgctccctttgccagcaggcctttgcccttccttctcagaggacaggattcatgcctttttctcctttatacagccagggtttagaacagtagcacattaagtcttcaataactgtaaacttattgaactagggataatgtcagacatttgacctataagttttcagtttgctgagtaataaaacagtttacttttatatgcaattcattttttccaatcccagtgtcttttctctactgttggttaccctgtcagcccagaaatacaagaatttcttagatgcctttaaatatcttggactaagaacttctagctcaattttctgcccttttctttttcacaaggtcaatatatacctatgctgtggtatcatactacattaaaagagacaatctcttgatatatttaatagtcaatgctaaatttactcttttttgtttattaatttccttagatcttatgtgagtttgtttagcatatgcatctgggctaaaatcccatgacgatgactaacggtattttttacattatataaaaaagaattctatagaaacaaacacacaaaaaaaacctgttgaaaaaggaattcccatttatgttccaatggaaagacccatccaaaagactcacctggttatgctaagtcaacttataaatccattatgaaaaccacttctaatgtcctgatcttggtctaatcttctaaatcctcaggctgatgataaactcagctacagttaagtagttaatacagctgttgtacactcaaaataacgtttaatctttaacttttaattttgtcacagcagttttatgtattataccattcttaccccttcgtaattgccctttaactgccagcttaaatactccaatcacctaaataaaagcatttcatccacaaatccaccaaaaccagaaaaggatactaagaaattttaaaaggcatatacatcctgatacctttatttttgccattctggatatcaatcatttcttaatacttttaaattagctggaaatgaagcatcagccctgatttggctgtaagtttcacatatttaaaatgtttcttttttttttaagtctacaaaataaatttagatcaggaatttttaccaatgtttcagacatgcacaagaagttgtgtttgaagccctaccaacatactcaaatatatatattatttttaaatatatatttgaggatacatatatagtgcatgtatatatgtatatgcacaaatacatatacacacacacacatatatgttttttaattggaaaagcactcgtatctactcacaaccagtgtctttgaggcggttgatggcattggaaagaagacgaacacaaccgagaaatccagcaccttgtttcttatggatcttcttgtgattccatacactgatcgtaactgaatcagactttccaatatacctaaaaaacaaaacggctgcatgagtaacttggtagttacaggcagttggcgtaaaatttttcttttgttctttttatattctaaagttactaatatgcttcagaatctggctagattatgcaaaatatgtcttgagttaatccacaggattgaatttaaatttttaaaaatcttgaaaattttagtatatttttatcacatctgccactctcaagctgggctataattctagtcagtaaaaaggctattttagtagctaatgtctaataacactaagggagtttattaaataacttctttgcaagaaaaagaatcttaaaaacttttatcacagtcacattttaaatacatgtcgatgacatgacctacttttcaagggatagtgtcaaggctgacagaccaaaaatctgacctacctgttatattttaaaatgctgtagaacaaaagctgtttgtaacgcttttcccctgcttctttcctgtatgcaggccttgagcgagcaggactcttgcagatttcacttcactgcctgcagacaagcagagcagggaaaagcgttactgtacttgtctgtgcatatgcctgtaagtatgtaaaagctctaccacagccaattgttaacatggcatcaacccatgcaaaaagataataaaataacatgtcagtagaatcctagctctatttcaatgacaataagaggtcaaatttttggtccagcaaccttgatcttaaagtatcattcaataaattacaatatcagaaaaattcacctagtatacagaaaagcctaaaccatttaagtaaggactaaagcttttaaataagtgacatggaaggtacacttgagccccgggatccagctgtgcctaaaaaatgcccaccccaggcttttaattatgcaaatcagtacattcccttttaaaaaattaagccaatttgaatttggtctctgttgcttgcaaatgaaaaaatctgaattaaaatattgttcagtatgcatgtaccaattttcgaatacacctaccagttctatcttggcatgtatctactggcatgtaattccagagccagaatcaagtattaagtagctgaattacccaagctgaacattttttaaaaagttacattaggccgggcgcggtggctcacgcctgtaattctagcactttaggaggccgaggcaggcagatcaccagaggacaggagttcgagaccagcctgaccaacatggagaaaccctgtctctactaaaaatacaaaaaaacttagccaggcacggtggcatgcacctgcaatcccagctacttgggaggctgaggcaggagaatcacttgaacccgggaggcggaggttgtggtgagcctagattgcgtcactgcactccagcctgggcaacaagagcaaaactccgtctcaaaaaaagaaaaaaaaaagttacgttaaaccagttgtccaactagtaagcctggtttacaggtatgctgaaatacatatattgattacctcagtcctcagggcaacgcaccactggcttaagcaacttcatctgtgtagtccaatgtgccatattttttatgtgtaccatgatatgaaaaggttgggaagctctacattaaatcataataagaaattgctaattatagaccttctggaagatagcctaactctgaattactaaaaattatgaaatatattgtattacttaagcgtacatgtcacaaacattctgtccaaatattcctgggccagaaatgaatccaaaatattaccttttcttatacatagagaagtacatgctctcactttaatgaaacctcatgtaatataacatacatggcaacaaaaacagtaaattccttttgcaattgaaagttaaatagagggctctattagcttctattaaaactttgacttactaacaaatacatgatttataaacaagtttcaggatgttttgttgaaagggagagagggacacctctataggtgaatacaatgttaccatatagaccaaaatatgtactcaggattttgggctaaaatttaattattagattttgtttgtatacttagccaattaaaggcaagggttttgtaaaatgactttggaaacaatcataagagatgcttctgacagccaattaatattaattgtaagataaaacctaataagtacaagaaagatgttcaacatcattagtcatgatgcacctcaaaaccatgaccagatacaacttcatacccactagggtggccacaattttttttaaaagaaaataacagtgacagaggaataaagaaacttccagtggaaaacaacagtcatgaaagatcaaaatcaggatgccatcagcaatactctaaacctacaatttccaaaatggtacccaccaaccacgagacccttgaggacttcaagtgtggctagtccaaattgaggcaagctgcaaaataaaccactgatttttttttttcttaacataaaatgagaaaaccgctgattttttagagacatagtaaatatgtatatatacatatatgtgtaagtagctcaatatttttatactgacatgttgaaagtatttttgatatactgaattaaataaaatatattattatgcttcattttaagaaacagggtctcgttatgttgtagctggattacaggtgcaagccactatgcccagtttattatgcttaatgtcatctgtttctttttacttatcttaacgtggatgctaggaaatttaaaattatagatgagctcccatctgtgccttacattatatttctactcaacagtatggatctaaacctagaagataatggagcaatgtattcaacatttggaggtaaagtgatatttcacctagaagcctatattcaaaccatatcaaaagataagaagtcaaagtatatcttctgataagatctcaactttcttcccatctttgtattatttctcaaaatgacaatggaagataaagttcaccgaaacaggagagtaaacaaaaaaaaaaaaaaaaaaaaaaaaggaagtcactaaacctagaagagacaaaggaaattgccaacataacaataaaggcaagtcccaggacaactgcgcagtgggtcttagagaaccatcacacaagactaaagaaagagaacacagactcccaggagggttatctccaagaagaaaaaaagccaatggaatactgacagaactgaatatatggagaaaagatctttagttctataggagagtctgaggattatgacatataacttctcatttctatctaggagataaatagataactaaacaaatgggaaaagtagctactaacttcagaaaaaacaaaagttgtcaagaaagaaaatgtaattcttgtacccctgtgacccaactatggatatttacataatcataataatgtaaacatggaacaatggtttaaccaaaaaggttcatataattatattggaagactaaagaaaggaagaggcttgtgtcatgagaatggggatgctgaataccaattttaaaagctgaaccactgggctgggcatcacagcccacgcttgtaatccaaatactttgggaggccaaggagggagaatcttgagcccaggaattcaagaccagactgggcaatatagcaagaccccatctctacaaaaaattaccttaaaaaaaaaattagctgggcatggtggcatgcacctgtagttccagctactgaggagggtgaggtgggaggatcagttgagtccaggagttagaggctacactgagctatgattatgccactgcactctggcctgagcaatagagtgagactgtttctaattttaaaagaatttttaataataaaaaataaagccgaatcatcttctaggtaggaaattcaaaaatacctaaaactaggctgggcgcagtggctcatgtctgtaatcccggcactttgggagaccgaggcaggcggatcacttgaggtcaggagttcgagaccagcctggccaacatggtgaaatcccatctctactaaaaatacaaaaattagctgaatgtggtggtgggcacctgtagtcccagctactcgggaggctgagacaggagaaatgcttgaactcaggagacagagattgcagtgagccgagatggtgccactgcactccaacctgggtgacagagcaagactgtctcaaaaaaaaaaaaaaattacctaaaactaaaaaaagaaaactgtgatgctataaaataaaatacatatctagaaacagatgaaaataccagaataaacagccaaagttattaaagcagttgccttgaggatgggaatcaggaatgagaatggagcagggaacttgctgttttccagtaaaagctttattgtatcatttgcctttttaaaaaggtgcatatactccaatggtttaaaataaaatttaaaagaaagaaaccatccatataaaggcaaaaagaagcctattcagtgcaacccaaatccttatttctggttttataattggtctaaagtggtgaattaatacctttatttaattgaaaaaagaggtgggggattgctctactgtgagccagtttcattttcttcttcatagaattttagagatacctcatctttcaaaacctgtctataagccaaagcacattcccactgggcttttctttaccccttttgtgatgaccaaattataccacagatgaaacccagatcatttcccatgattattttcaaagactatatcaaataatttaatgatatgttccatttcaaactaattgttgaaacctacaggtcataatgctgattccactttggatcaagcgtattcttcacagtatctgtagaatggcattgcccagatccatcaaccaccaccttagcaaatggatcaggaagtcctgtgaaaaaagattttctaaaattaataatttgacatttaagatagaagattaattatacaagcattccatttgctacaaaagattattccattcttttaaaaaagtttaacatttagctataaatgaatagtccattttttaaaaaaaaagactaaagttacttctacattaaataccaaaactatattttttctcgtttctgtctcaaaatagtcccagtttaaactaccaaaatctagaggttacctcataatgtggaagtttttaataggttgttaccagccctctgacccgaggaatggggtcatgaatggttacatgaattcttgtaaccattcatggctttttctttccaaatgtctccctcagtagctcatttaaagaaaaagcttattaaaggtttttatacaggaacacaggctacagagaaatcaaattagcaaatgagttttgctgaataactaccaggaaaaatcagactgaaacaaaagatgtaacactctgccttaaaagagcttactatctaattggaaaaataaaaatactatacatgaaaaacaaaaccaaaaatacctgagaataaacaagtgcttagtgatactgattgtaacgcaaacacttatatcactatgttaggtactattctaaatacatttatccttaatccttacaataaccctacgaggtaaacactgttattatccctattttactgatgaggaaaccaaggcacaagggggtcaattaactagcccaaggtcacagagtagtaaatggcagggccagaatctaaagtgtagattctaaacccatgtctggctctcgacttcatgctcttaaccactatgctgtattttacctcttatttactacgtggtccaacagtgagtacaagtaagagctcagaaaaacaggagaaaaggtttgaatctgaacagtaaagaaagggctttgagggaggagggaactcatctgggctttaaggcaggcgtctccaacctctgcaccatgggccggtacaggttcgtggcctgttacaaccggaccacaaagcaggaagtgagcggtgggagagtaagcattacagcctgagctccgccttctgtcagatcagcggcagcattagatgctcataggagctggaaccctatggtgaactgcgcttgcaagggatctaggttgtgcgctccttatgagaatctaaagtctgatgatctgagatggaacagtttcatcccaacacatcccctgctccccatgtccttggaaaaactgtcttgcatgaaaccggtccctgtgccgaaggttgggggctgctgctttaaagggcatacaggagaaggaggactttcctagcaaaaggaagagcaccaaggagggtatgacaatacaatatttaaaagactttgaagagtctaaccaaagagcttgtgctaaggtgtaaaagtaaatactattggaaatatgactgacccagtaagagaggcttaaaagtcgggcaacagggcttggactgattgaggtagataacagggagccatttcaggttcttgagcatggctgtaactacagtcatatttttctatcagtggtattcagggcccactaggagaaagaaagactagaggcagaccatatatgaagctgttgtaattatccaacagtaggatgaaaagaccctgaatgagggaagtcatgtggaaagggaaaggaaatgacaagagagctattctgaaagatctaatacaaattaataagaaacttgtatcaaagatgacaatacagttttcagcccaaagcaataatgaaaatgattcttttgacaaaaatttaaaaggtggaactaaaaatgttagagagacaaaaatgtcacttcatgtgttagacattgggatagagtagatttcctgtggacagctgaaaatactagaacaaaacagcgttaagtgttggtgactggagaaattttgcatgttggtatcaatgctaatttttttaagatactaatttgccaagtttcaaggacagacaaatcacctatcagttccccaattctatgattctgtgatctatcgcttccaaataataaaggaggaccaaaatttaggcgttaagtttcaaagaaacttggtaagttagggtattaaatctatttgactatattgttcttgaagctgagtgctatgcatagtatttcagtaacacctaaccatttataaatgtgttcaatggaagaatgtttttacctccaccctcaataaatgaagatttcctcctgggaagaattcactctatcttgttattttcactctactatttaaataaataaacatataaatgtgtatttatgagcaaaaacaaaaaaatcacatttctaaactttccctttgggtgttattaaactagttgaagaattaagtctctctggtttcttgcttttttaaaaaaataaaatgaaaaagaattaaggactggccagacacagtagctcacacctgtaatttcagcactttgggaggctgaggcgaaaggatcacttgagcccaggagtttgaaaccagcctgggcaacatagtaagaccaccccccatcccccacaaaataatttaaaagttagccaagcatggtggcatacgtctgtagtctcagctactcaggaggctaaaatgggaggattgcttgagcctgggaggccgaggctgcagtgagccatgatcatgccactgcactccaacctggttgacagagcaagaccctatctcagtggaaaaaaagattaaggattaagaaaaacaacagctgacaaaggactaatatccagaatctataaagtactcaaacaaatcagcaagaaaaaatcaaacaatcccatcaaaaagtgggttaaggacatcaatagacaattctcaaaaaaagatatatcaacaagataggccaataagcataatgaaaaatgctcagcatcactaagtatcagggaaatgcaaatcagaactataatgcgatgccacctcactcctgcaagaatggccataatcaaaaaatttaaaaataacagatgttggcatggatgcagtgaaaagggaacacttttacacggctggtagtaatgtaaactagtacaaccactacggaaaacagtgtggagattccttaaagaactaaaagtagatctactgtttgatctagcaatcccactactaggtattaacccagagggaaagaagtcattatacgaaaaagatacttgcacacgcaggtttgtagcagcacaactcacaattgcaaaaatactgaagcagcccaaacacctatcaatcaacgagtgggtaaagaaatgtggtgtgtgtgtgtgtgtatatgtgtgtgtgtatatatatgtttatattatataattatatatgtatatatttatatataattatatgtgtgtgtatatatatatatacacacctacatatacacacacacacaccacatatacatacatacaccatggaatactactcagccattaaaaagaaataatcacagcaacctggataaaattggagactattattctaagtgaagtaactcaagaatggaaaacctaacatcgtatgttctcagtcacatgtgggagctaagctatgaggatgcaaaggcgtaagaatgatatactggactatggggactgggggaaagggtgggggtaacaggggataaaagactatacactgggtacagtgtacactgcttgggtgatgggtccaccagaatctcagaaatcaccactaaagtacttattcatgtaatcaaacaccatctgttcccccaaaacttattgaaataaaaaaataaaataataaaagaaaaacaattttttccatacaaaatgtggcttccagatccttaattaagtaggaaagtcacagccttttatgttccctttctgttaaataacacagtaaacaaaaacaccagttcaataccttaataaaaaaatacataggtttcaacttaacctgattatattattctccaaaaatttaacttgagagccaagttactcccatgtggtcaaaaactatcaggttttctgaagttagtgagacatctagtggtaaacacaaagtggctagagaactttctgcattttaaaaaatttctcagccaggcacagtggctcacgcctgtaatcccagcactttgggaggccgaagtgggtggatcacgaggtcacgagttcaagaccatcctggctaacacggtgcaaccacatctctactaaaaatacaaaaaattagccgggtgtggtggcacatgcctgtagtcccagctactcaggaggcagaagcagaattgcttgaacctgggaggcggaggttgcagtgagtcgagatcgcgccactgcactccagcccgggtgtcagagacagactttgtctcaagggaaaaaaaaaatttttttttgtctcaattctcccccatcatttctgagacatgtaaaatagctaaagctcaaaaacctccttactacacaaatgcacttgaaaagctgcaaataataataaaataacattttcaactcaaaagtgtgctaccttccaaagaaaacagcttcattttcaattgggccaagaaaaaaaaaaaacatacacaacatttagccaacccatcttggttttaaatgacttcaatttggccccctataaaacaccttattaccttacacagaaatcttttttaaaatgttgcagaagaacaaatctaaatgaaaacattccttttcatataaaaaatacacataaaacagataatgaaggcagggcacagtggctcatgcctgtaatcctagcactttgagaggccgaggcaggcggatcacatgaggtcaggagttcgagaccagcctggccaacatggtgaaaccccgtctctactaaaaatacaaaaattagctgggtgtggtggcacatgcctgtaatcccagctactcgggaggctgaggcaggagaattgcttgaacacgggaggcagaggttgcagtgagccgagatcacgccactgcactctagccgggggacagagcaagactccgtcgggggaaaaaaaaaaaaaaaaacataatgaataaatgggtaaatatgtgataaagttaatggtagaatctagatggtgggtctttactataaaattattttatctgttgctttatgtttgaaatttttcctgctaaaattctgggggaaaggggaagtgacttatttttaaaagccaataagcttgaaaacagttcaaaaacatgagttaaaaaaacttttctcaacaaggatagcgcccaataaacagtattacctcacatacaaattactcttcaaaagacaacacatggcagtgtattttttcctgcgatgaaaaatatatatctatttcatcaccctatagtcgtactttgtattaaaatttgcttttctcattcaatacaattttaactgaatcgcaagcaaaaacttaactatattttactattaataactgcactgatcaataaacacacattcatttatatttaattgaagaatttaggaattactgtctctgaaattaatgtgggcaacccttaacaggtcaaaaatctgtataagtatacatgtaaatctaccacagaatggacctgcgaccttggccagtgtgaacctgggaggtaacttccattcctggctaactcccctctgaagccctaaggattaccattcctgtttctctttccaggccatcaagagtctcccattctaagttttaaagataatcacactgtttcccctaatcttatccctaaagcaagttcacactcttagaatttttatcaatttttactgcctacacccatgaaaaagggaaaagatttccttctttctttcacttacaatttaaggacaaagatcatataagggttaacaatcagctctcaaaggtttataaaacattaatatatgattcctctagatatcctaggaaaaatgaggtaagaatatctggatattttattagagaagctgtgtcttgggactcgagaggaaggaaatttgaaaaggaaagctgggagacaaaactgaagattttatcttcaaaaccagagcagatgtcttggagagtgcagaagcagctgtaagagtgctcctctcagccgggcgcgatggttcatgtctataatcccagcactgtgggaggccaaggcaggaggatcacgaggtcaggcattcgagaccagcctgaccaacatggtgaaactccgtctctactaaaaatacaaaaattaggcaggcgtgttggcgtgcacctgtaatcccagctactcaggaggctgaggcaggagaatcgcttgaacccgagaggtggagtttgcagtgagccgagatcacaccactgcactccagcctgggcaacagagtgagactccgtctaaaaaaaaaaaaaggaaaagtgctccccttacttccctcccttttctccttgtccaaccctatttgccactttgcaagcccactagtataaatcctaccttagatcaaccttatcaaaggttaaaaaaaaaaaagtacacctcagttagtagcaacagggatgaggtaggaagtgagcagcagcctgagacagataacagtgattggaggcaacagggagagatgggaagttctgtggccattgggaccttccactgtgacaagcttctggcgagaaggcacatggtacataaatttaaactgcttataatttgcgtcctatgttccaaattatcctatttgctttctcatataagcagaaagataaccataaacatttataactatatagttttataagatgttattttataaactttaattcaggttctgctctacaaaaactcaaaataataaaatttcaagtggaatgaattaagtataattttaaattatattggccgggcacagtggctcacacctgtaatcccagcactttgggaggctgaggtaggaggatcacttgagaccaggagtttgagaccagcctgggcaacatagcaagatcctgcctctacaaagaatagtaaataaataaataaataaattagctggacgtggtgaagtgtgtctgcagtccacccactcaggagggtgagataggaggatcccttgagcccaggagtttgaggctgcagtgagctatgactgtgccactctactatagcctgggtgacagggcaagatcctgtctctaaaaagaatatatatatatatatatatatatatatatatcttatttcttttaatcaagcccctgaaaatcatctactatcacatgaaatcaaacagcacacatagcccgtgacttgaatttaaaaatttaatgaatcatctctattctaatttcaaatgttttacataaaaaattttgttggctgaagtttttttttttcactaaaaattatatcatttttaaccaataacttaaagctacaacagaataaagattgtaatatacatgctgggtacttcccaatcccctctcataaaacttagtactaaataaagccagaaaaaaaaattacaacagattggtaaatataaggcatatatgggaaccaaacatctgctttggaatctgagaggtaagagcatctaggatcaaatgtggcagagatttctttcccacactctggaaattccaagcaggctcaatgacttttctaccttccaatgaatcttgaatgagtaaagtttcccatgaaattttcaaaaggaagaaagtgttcacaaaataatctcttaaaccttttctagaactctagtagtatgcacaccttcaatatacattacacacatctgcatttacacacctgcatacacactcattctcataaatacgtgggagaggtgaataaaaggaaagggctaagcctaaaaagcacaaaaccttctaaaaaaaaaatgtgatgccaaatggctctgaaccgaagcattcataataaaataacactgacaatacttctgaatagagaaacccctaaaccagagaattctgaaaacgctgttcccaaagatctacatacaatacacaagatttaaagttaatttacttacggaaaaaatcctttttcaccaggttttttgcacagagtactgtaaaaaaaaaaaacaaaaaatacatgggaaaaattaaaatgttaagagtgtactgttacattttaaaacacggaaaacagcagtgaatagttaaaccctaactatagcaaggtatgaaacatgaccacaaactttcgaactagcaaataaaagacagttgaaccagtggttgcaactttcaatgatcaccagtaatagctgagggcaagaaagtttataaatctgatattctaataataaggtagaaattcaattcctatcttccatcaagatctactctctgagaaactcagtggcaataggaaaaatagttcaaaggagatatgtaaagtcaggttgttatatctattttaaggatgaaataattttatactgaagaggatcacaaataaagataaagctttcctgatatagatgagttttttttctttttttttttttttaaataacattctgttctccatctaaatgccacagaaacttcatgggagaaatcaaattaccttctcctaaatcatcagttaaatgacaagatatgtctactatatcttttaagaatttaaagttaatatattaaaactagatatcccaaatccacattttccaagttaatatgcattaaattacttacacggatggatgctcaaccttgtgaacacactaaaaaatattgaattgcccactttaaagaggataaattttggccgggcgcagtggctcacacccgtaatcccagcactttgggaggccgaggcgggcggatcacaatgtcaggagttcgagaccagcctggccaatatggtgacaccccgtctctactaaaaatacaaaaattagctgggcgtggtggcgtgcgcctgtagtcccagctactcagtagactgaggcagaagaatcgcttgaacccgggagagggaggttgcagtgagccaagattgcgccactgcactccagcctgggctacagagcaagactgtctcaaaaaaaaaaaaaaaggattttatagtatatgagttacatatcaattttaaaattactgcttacaggctgggcacagtggctcatgtctgtaatcccagtactttgggaggccaaggtggctggatcgcttgaggtcaggagtttgagaccagcctggctaacatgatgaaactgtgtctctagtaaaaatacaaaaattagctgggtgtagtggcgcacacctgtaatcccagctactcaggaggctgaggtgcgagaatcacttgaacctgggaggtggaggctgcaatgagccaagattgcaccactgtactagtgagccaagattgcaaccactgaactccagcctgggcgacagagcaagactctgtcataaataaataaataaataaataaataaataaataaataaataaataaatctgcttatagagtcataaacttaaaacttctttaactcaaacttgatacaagagaaagaaaaacatcaattttcatatatgtaaattttagttcataaaatacctatgaatgtaatgtttggtatttctatccacttctactaacagtttaaatgaattacagttattggaagtttagtgtataaaagctcatttgacataaacttgggaatgaatctaaataaatataactaatcactctaagggttcacataaaaaaaccttttgaaaacagatgtcatcactaaataaataaaattattaagtaagcacaagatactggtatactaggcagagtcccttaggccatgtcttagagttttgtttttaaaaacataaaaactcaatcaatcatgaaaactagggccataactaagaataagaaatcacaaactagatttagagaactcctccccaaacttttgtcataatataaattgaacagaatactcaggatcaatacacatgtaacacacacaaaaatctaaattacaatcttcagttttaatgaggtaatgatgatttttttaaacaaaccactatcctatgattcatgaagtgaaatgatttcacatccgacttcagagaaagagaaaacatgagatctcctccaactcactgccaccaaacctacatattcattctttttcccttccttccactgacaatgtctactgtcctctctaagactatcctctatctcatatctaaaccaccatgttctcggggatcttcacagctgttatacatatcctctatcttgtccccttttctaatcaccttgtcaacatttaaacatactcaagtcttacccaagcctcccttcagccagccatcatctacctcttccctctcataatgaaacttcttcaaagaaaataaatgtgcaaaaatcacaagcattcctatacaccaataacagacaaacagagccaattgctataaagacaataaaatacctaggaatacaacttacaagggatgtgaaggacctcttcaaagagaactacaaaccactgctcaacgaaataagagaggacacaaataaatggaaaaacattccatgttcatggataggaagaatcaatattgtgaaaatggccatactgcccaaagtaatttatagattcaatgctatccccatcaagctaccattgactctcttcacagaattgaaaaaaactactttaaatttcatatggaaccaaaaaagagcccacatagccaagacaatcctaagcaaaaagaacaaagctggaggcatcacactacctgacttcaaactatactacaaggttacagtaacaaaaacagcacggtactggtaccaaaacaaatatatagaccaatgtaacagaacagaggcctcagaaataacaccacacatctacaaccatctgatctttgacaaacctgacaaaaacaagcaatgggggaaaggattccctatgtaataaatggtgttgggaaaactgactagccatatgcagaaaactgaaactggactccttccttacaccttatacaaaaattaactcgagatacattaaagacttaaacgtaagacttaaaaccataaaaaccctagaagaaaacctaggcaataccattcaggacacaggcacgcacaaagacttcatgactaaaacaccaaacgcaatggcaacaaaagccaaaatagacaaatgggatctaactaaagagcttctgcacacaaaagaaactcatcagagtgaacaggcaccctacagaatgggagaaaaaatttgcaatctatccatctgacaaagggctaatattccaaatctacaaagaatttaaatttacaaaaaaaaaaaccccatcaaaaagtgggcaaaggattatgaacagacacttctcaaaagaagacatttatgcagccaacaaacatatgaaaaaaagctcatcatcactggtcattagagaaatgcaaatcaaaaccacaatgagataccatctcacaccagttagaatggcaatcattaaaaagtcagaaaacaacagatgctggagaggatgtggagaaataggaatgcttttacactgttggtgggcatgtaaattagttcaaccattgtgaaagacagtgtggcaattcctcaaggatctagaaccagaaataccatttgacccagcaattccattactgggtatatacccaaaggattataaatcattctactataaagacatatgcacatgtatgtttattgtggcactatccacaatagcaaagacttggaaccaacccaaatgcccatcaatgatagactggataaagaaaatgtggcacatatacaccatggaatactatgcagccataaaaaaggatgagttcatgtcctttgcagggacatggatgaggccggaaagcatcattctcagcaaactaacacaagaacagaaaaccaaacaccacatgttctcacttataagtgggagttgaacaatgagaacacatggacacatggaggggaacatcacacactggggcctgttggcgggttgggggttagggagggatagcattaggagaaatacctaatgtagatgatgggttgatgggtgcaacaaaccaccatggtacatgtatacctatgtaacaaaactgcacgttctgcacatgtaccccagaacttaaagtataattttaaaacatttttaaaaagaactgcctacactttttgactctacttctttacctcccactaatgccctgatccactgcaatctggcttcctccctcaccattgcctctgaactgctgctacaaagccctggagacctaattaccaagtccatacaatggacatttttcattctttatggcacttgaccccctcatgggcatttgccactgctgactactccctcttctagaaaccctctcttccagttctgtttaacaccacattcacctggttctacacggcataaaactcattctaagttctctttgccagatcttgctgtgctataaaacttgaagttcttcagggttttgccctaggttctcttatttcactctgtaacctgaggatcacagtgtccatttttgtaaatcttgcaattatacgtaaactgttacatatatgtttattttctggggagagaatccacatttttcctgggagagagttcatagcttaatagattgacagaactcttcctctctctcaaaaaataaaatccgaagagccacttttccatatattctctctggtctttaccatttactctatggttatgatgatacctaaattcataaaacccgatccttagttttctcctgaactccaggtccacaaaccaaatatgcgttccccccaaaaatcacgtcttccccgcaaacctgctcctccctccagttgactttcttttcaataaatagccttcctttccactccactacccaagtcagaaatctccatagcaaccttcactgtattccctcctgacatcctgacaattacaattctcagcaattctacctcggaaatatccttcatctgtctacttctctctattaccgatgccaacaccttagtccaccatctactgtctaggtaattacaacattcccctgcctcaaagcctcacttctttccagttctccacgctggacctgaagtgagctaaaaatctaattaagtctttccatccatttccccttctaagatccttaaaacattccaaaggtcttctggcccaaacttatattggcttcaatgcccttcaagccctggctcctgctcacctctctgacctcatttttcatcaccacagctcccttccaggccctcaagtctaagatccagccacactaaccttcactttctcaaatgtatctctctcacccacagccttcacgtgccattctctctgcctgaaacattcttcctaggcttcttcacctactcatctcctggtctcaaaagggaaggatgccttttagaacatgtttctctcaagctttccccgcttgtattttcacagaagctcatacttttataaacacttatcacattttactgttctcgtttaagtttggaatgttgcttataattgcggaggtggtaaactccatacagcacgaatcatgcctgcctcatctcttcctgcaccaagcacacattacgcctggcacttgataggtactcaataaatatctgttgaatgaatgaaatagaccctaaaataatctaaataactttttatactatataacaatggccaatcctcacataatcataattttgatttaagaaatcttattttaggccaggtactgtggctcatgtctgtaattccagcactttgggaggccaaggcgggcagatcacttgaggccaggagtttgagacctgggcaacatggcaaaaccccatctctactaaaaatacaaaaaaaaaaaaaaattagccaggtgtggtggcacacacatgtagtctcagctactcaggaggctgaggcatgagaatcacttgagcctggaaggcagaggttgcagttagctgagatcacaccactgcactccagcctgagcaacagagtgagacactgtccccctccctccacccctcaaaaaaatcttatttttatcatttctctttacttaaaacatacttatccggtcgtgtttaaccaattcttaaaaaaaaatcacagaatgtttaacattcagtttcaaagaacaattgaaaaatcaaaagaacaaagaactttaaaatcaagttcaaagcttatgaggagaaattacattttagtaatcaagagattaaggaaaataacattagtgttctagaagaaacaagattaacttaaaacaaagaaataatatcaagattggtcagaccgctatgcttcatgctggatctaagcagttccagccagctttactaaattactttctgccctggaagcaaaaactctgatttgtaacttttaaaaggaagattgtcaaaacatgacctgagaactggtaatgttatttatctgtaaaaataaattgttttcacatcctggagcctttactgcactgttcttttttcttgggaatgtaccttggggactagaaccacagcccattgctcttttcattctctgttctaatcacagaagattggtaaatgctcaaagaatccatgaatttcaatatgacaaactcctgattatgtcaccacagcaaattctcaactaaggaggtatgtatcagaatcccctggagaatgtatatacaatattataattttatattaggagaaaattaatctatcatcttttgtaatagaaactatggaaagtagaactaagattaggaatcatgggactagggaggggtggcagtgtgggagaagtttcatttctgctttctaaatgtttcttaaagaaaataggtaaaaatgttgagaaatgctgggcagtaagggagtaacaggagagaaatcttgttaggtgggcgaggccagaacaaaggctatggggtacagactttttcctagaccgcagtccccaacctttttggcaccagggattggcttcatggaagacaagttttccacggaccagtgtgtgtgtgtgtgtgtgtgtgtgtgtgtgtgtgtgtgtgtgtgtgtgtgtgtgtgtgtgtgtgtgtgtggagggggggcagaggggagcaggcaagggggttttgggaatgattcaatctcattacatttattgtgcacttatttctattattattacattgtaatatataatagaataattatacaactcaccataatgtagaatcagtgggagccctgagcttgttttcctgcaactagacagtcccatctgggagtgaagaaagacagtgacagatcatcaggcattagattcttataaggaggggcaacctagatccctcgcatgcgcagttcacagtagggttaacactcctatgagaatctattgccgctgctgatctgagaggaggctgagctcaggtggtaatacacgatgggaagtggttgtaaatacagatgatgcttcactggctcatctcctgctgtgcagcccatggcccagggttgaggacccctggcctagacagcaatcagtatttcaatatctttaatgtttagtaagcttatatatatggaattgaaattatatatacagaaaggcacaaaaatctgaagtatctgaattaattcaattaattttcaccaatttttgtgttaaagcaaaacattatactggactacagatatttagtaggcacaagtcaatttttattagtgctaactacaaatgtagcattacaccaccacagtaccatgctgcagaatccaccagggacaatgtctcaaacagcccatatatttgtactagattaagtctgcttatactacttcatcatgttactacccttctcaaattccttcaaagcatttcattcttaagtctacactcccagaacctagcttgttctagctattgtactcactcctttttcagacagatggtttgaaatgattagcagagatgatcaaaatgaactgacatcagccatattggataaagcctctgcatttcacacagatgcaggtgtgatcatcttgagatacttagggagaaaggaatactcctacatcattcactctctcattcaacatttcctgaacactcactttgtgccaagtgctatgacagtttctgcagatacaaagaaaaataagacatagtcctttgctctcagagctcacaggtcaggtataattcaaataccatgtcataaatgccttttattgttgttttctcaagatacggttttaaactttatggaaatcttatacttcatttgaggcagcgattagagaaaaccatttgcagaagtacagatggcagtaaatactaccattttcatttaggtcaataatttatttttctggtaggaaaggagttatctatatgcaacaaaccaggtaatagtatcagagtaaatcgcagctgtagaaagagaatgctatgcttgttcttactgagttgttttcataatgaatggctatctacgcttaatgtgaataaagctcccaactacttagtatatccttgccaaaaattccccttcctcctccagattggagttgcattccaattacactgctgattggaatgagactgcttgagagaaaaaaaaaatactcagacatcccatcttccttcaccccacaaaaagattttataatactgtccctgcaactcaaaagtagcataaatgcttttgaacacagatttctctgcatgtgctttaaacttatgttatcattgtaaaataaaaccgaaattcaggataacattcctatacaaattccagcaggtggcccagtgcttcagaagtatcaactgatgtacaccattcctgaccagtggcacatgacagcaatttacatctttctgctctgagaaacagcctctatctcaacccctaaacatgaaatgaaaatgaaatttaaatgctacagaaaacttctacacaattttttatgtgttttagttattgttgcttgaaacaagagtattacacagattcacattcaaggtgttattacaaaatgttaaaataagcaaatatatcacatataattctatatgcataaaaatgatcagttaagtaaatgatagcaaacagcaagttgaaatattacacagccattaaagattatgtaaatgtatttatttattgatggataagaaaataatttccttttttttttgacagtctcgctctgttgcccaggctggagtgcaatggcgcgatctcagctcactgcaatctctgcctcccaggttcaagtgattctcatgcctcagcctctcgagtagctgggattacaggcatgcgccaccacactcggctaattgctgtatttttagtagagacagggtttccccatgttggccaggctggtctcaaattcctgacctcaagtgatccacctgcctcgacctcccaaagtgctgggattacaggcgtcagccaccacacccggcttagaaaatattttcttaatatgctattaaaagtccttttacatgtagtacatttaataaaatatatttttagtaaagaatataaacatattggataacatttatcaaatatttactatgtgcaagtgtacaccaaccaccctgtgaaataagtagtagtactaccgtcattttagagatgaggaaactgagattcaggcatagagacttaccagtgattttgcttttaagagctagagttggctgggcacggtggctctgcctgcaatcccagcactttgggaggctgaggtgggcggatcatgaggtcaggagtttgagaccagcctggccaacatagtgaaaccctgtctcttctaaaaatacaaaaaatcagccatgtgtggtggcaggtgcctgtatacagtctctgctactcaggaggctaaggcagaaaaatccacttgaacccaggaggcggaggttacagtgagctgagatcgcgccactgtactccagcccagacgacagtgcgagactctgtctcaaaaaaaaaaaaaaaagaactagagctgagattccaactcaagtagattaattctagaacccaaactcaactaccatatagagtgaaacatactctctcaggctagtacttccttttaaagaatcttactctaggctggcacagtggctcatgcctgtaatcccaacagtttgagacgtctaggcgggctgatggtttgagcctaggagttcgagaccagtctgggcaacagggcaaaaccccatctctacaaaaatatacaaaaaaagaaaaaaaaatagcccggcatggtggtgtgtgcctgtagtcccagctactcaggaggctaaggtggaagaatcacctgagcctgcagtaagccatgttcacaccactgcactttagcctgggcaacagaatgagaccttgtctaaaaaaaaaaaaaaaaaaaaaaaaaaaaaatcttagtccagttaaagcaattattggtgacacaggttcacaaaacggttaattgaaaactaggttacagaagggtgctctgcaaaagattcagaattctcctctttcaacagatatagtaatttacctcaacaatcatattagccctgcttttaagtaaatatcttgtcatttaatgaaggaattttaggcaattcatttcattcatgctgcaaaacaaactaggcccttaagtttaacttaatatattcagtacctggcaagtagttaatctaattagtatgtttgatgatgtattaaaagatacaggttctgaggtaattatcctaagaacagtatcagcatttaaacatttcaacaaggcaaaattggttctcagaaaatttattatatttttatttttttgagatgatctcactctgtcacttaggctggaatggagtggcgcaaacacgactcactgcagactccagttaaattttctgggctcaagagatcctcccatctcaacctctgagtacctgggactacaggcgcacaccaccatgccttgctaatgtctaaaatttttttgcagagatggggtcttgccatgttgcccaggctcaagcaatcctcctacctcagtctcccagactgttagaattacaggcatgagccactgcgcccagcctcagttaacaaatttaaaatgacctttctagtccactcatatcaaacaacttttaagtaactacttaaaaattttttttcaacaaagatgaagattttggtaaagttctcacaaacatgcgtactttttacattaataaaacaagatgagactatacaaataagctttctaaacactgagtgcaagtttatcaataatagatctactttgacataataaatgcagattttaaagaaatctagtcagaattatagattttattctagtcacaattataattttttttacttatcgtgatcagaggtaattttaaagtaaagcttatcttaacaagcataataatcaacttctggtgtaagttcacatgttaaaaataaaaaagggctgggtgcggtggcttacgcctataatcctagcactttggaaggctgaggtgagagaatcacttgagcccaagagttagagaccagcctgggcaatatagtgagactccgcctctaaaataaataaataaataaagtaaaagctcagctaaagccaagcagcacattcagtatgagataaatgtaaaacacttggtctaggtatctggtacatagcaggcactctacgaaagctattattttgagaaaccatctgaaaggatttgttatatatcttaaaccagtatttctgtgaattctttattcctatatgaggatgaaaatacacaaaagtaccgttctccattcaaaaattcaccatgacttaaagacctatgctgtgtgcagaccaaacattatcctgtctgctgctgctggagactcaaccaccaccttctctactggactccttcattcaaacagacccactcataactgatggctgttcaagagatgaatattgtatatttaaattaaaccacacaatttactttcttcataaggatgccgagagaaggaaaccttattgtaaagttcaagtatatacttgcaatgaagcctaaacattattttatatgtagaaaaagacttgcatcactttttggccactcccaagtttccttcctttaccttctttttctagagacacttatagaggcagtgtaatatagtgtgttaagctataagcactataaaagagttaaataattagggtcagaatgcatgggtttgaacctggtgctatcccttatgaacttgtgaccctaaaaactacttaacttctctttgcttcagatagctcatctgtaaacatgaggacagaaggatactaagagccacctcatggtgttgttttaaagattaaacaaattgaaacacagagaacatgagaccagtacctggtacacagcaagtgctcaataaacactggctattattattactcaactctaaaatttctcataaaattaacctacgaggttgcaaacacattaaaaaagaacatggccgggcacggtggctcatgcctgtaatactaacactttgggaggccgaggcgggcagatcatgagatcaggagatcgagaccagcctggctaacatggtgaaaccccgtctctactaaaaatacaaaaaatttgccaggcatggtggcatgtgcctgtagtcccagctactctggaggctgaggcaggagaatcgcctgaacccgggaggcagagcctcccgtgagccgagatcataccactgcactcccgcctgggtgacacggcgagactcttgtctcaaaaaaaaaaaaaaaaaaaaaaaaagaagaagaatataatttggcaagacgtttgccttagccaaaacaaataccatagattaggtggcttaaacagcaaacatttgtttttcacaaatcaatggaggctgagaagtccaagatcaaggtgccagcagagtcaatgtctggtgagggccgtcttcctggtttgcatactcccaccttctccctgtatgcttgcatggcccccataatctctcccatgtctcctgttataggggcactaatcctattcatgaaggctccaccctcatgacctcattacctcccaaatgcatcaccttcaaataccatcacattggggattaggcttcaacataggaatattgggggacacattccattcatagcaaagcttatgtacctagcaagctttcagtaaatgctgttaattgagtcccaatctgtttctctagcctcactctcttcccaagctccgaactcatacacccatttagattcctcaccagcacttcaaattatattttttcaaaatggaattcatcagcttccctagtgaacctgctcttctttttgacctccgtagtgctgtgaactgcaccacgtttccagtcatccagaaagcaatgtctttatctctcttcctctccctgaccacctcacatacctaaagcagttgccagattatagccggttatcacatacctctgcttatctccatttccagtgttcacatttaaataatacatctagagtattttacaatgtgccaaaaaacttctacatagattgttttctttaacccctaaagcttgtgagttatctaatatccacagaaaaactgtaagtgaatgttttggctcacccctaactgccacctaggaaaagagtttaggcattgtgaattcaggctccatcctatttttctataaatccttcactcaagcagtgtcaatgattcctgttttctctctcattaacccctagactgacaagctcatcctcttccctcaaataagcccaggacttttctgcctttgcctttattcataatgttcttcccaccttaaatgttattatcccaaccactggccctcaaaatcttatccattcatcaaacttctgtgaagccttttctgactctcctttttcagtctgattttgatctcttccttcccgtgaacctccaacacttggattctacttgttttattatagtgctttctcattttgcttgttaaagttattcatgtgatgtcttacctctgtctcattaagctataaacctcttctacagtttattatataatatcttaaacataatatgcaaatacttgttgaatcaaataaaatcctcagaaaaccactgacgagttataaggatgtgcaaactaaaaggtaaaggatacatgcagctcactccttgtttcccctaacctagtaactctttatgttcaaatcaggatggcttccttaactattcataagtactctgcgtacccattccttagggcccaactacttatctaataacagatctcactgagccttctctctcattcacaatagaaaagtatattgtcccataatgttctaaaattttatttgccttgtttctgtaacattgtaaacaaaggtaaacttccacatcttctgcattcttccagactctgaaaaactgtagtcactcaaatacctgatgatctactaagaaaacaaagtgcaaaggtatttagctttccaaatacgctccatttgaaaacacaggccacaagcacaaataggaaagaagactgcaactataaaaagcactgtaggctgggcgtgctggctcacgcctgtaatcccagcactttgggaggctgaggtgggtggatcacctgaggtcaggagtttgagaccagcctggccgacatggcaaaatcccgtctctactaaaaatacaaaaattagccaggcgtcgtggcgtgtgcctgtagtcccagctactcaggaggctgaggcaggagaatcgcttgaatccagggggcagaggttgctgtgagccgagatcatgccactgcactctagcctgggtgacagagcgagactctgtctcaaaaaataataataggccaggcacggtggttcatgcctgtaatcccagcattttgggaggccgaggtgggtggatcacaatgtcaggagttcaagaccagcctggccaacatggtgaaaccccatctctactaaaaatacaaaaattagctgggcatggtggcacgtgcctgtaattccagctactcaggaggctgaggcaggagaattgcttgaaccgggacccgggaggcggaggtagcagtgagcaagaccacgccactacactcagcctgggttacagagtaagactctctctcaaaataaataaataaataaataaataaataataataataataataataaaaagcactgtagtgagccatcatcgcaataataataataataataataataataataataaaaaaaagcactgtagtgagccatcatcgcaccactgcactccagcctgggtggcagagtgagaccttgtccccaaaataagtgataaataaaataaaaataataaatttaaaaaaataaaaataaaaagcagtataatttataagaaaatacttctatacaactatatatttttgaaataattcctgggttaatagggaattcataaatgtaataaactttttattttagaatagtttcagatttacagaaaagttacaaagttagtacagtgttcccacatatccacactcacttatcctatcatgaacatctaacattaatatgggacatttgtcacaattaatgaaccaatacattattatacattaatattatacattaattaaaattggtgttttattcagatttccttactttttacatactgtagaacaccgtaatacatttagtcatgtctcctaatgctccttgtggctgtaatagtttctctggctttcctattgtttctcagacttgttatttatggccttgatggttttgaggaaaatattggtaaggtattttgtggaatgctcctcaactgggatttgtctaacttctcatgattagacggggtttatgagttgttgggaggaagaccacaaaggtaaaggtaccattctcataacatcatatcaagggtacatactatcaacatgatttatcactgttgatattaaccttgacctagctaaagtagtgtttgtcaagtttttccactgtaaagttcctctttttccccctttctatactgtactctttggaaggatgtcactatacaaaacccacacataaggactagagagttatactatacctccttaagagtgggatatctacataaattgtttggaattattctgcatgggagatttgtctatcccctatctaatcatttatatcagtatggactcacaaacatttgttttgtactttgggttataatccaatactactttattttattgctcaaatttttccagctttggccattgggagctctttccattggttcgtgtgttcctttgacatacttccatcattgaggggaaaggaagagctctttcttactgatggaaaatgctctaggctcatttaagttccctaccctggcctcagaattagtcatttctccaagcaaccctaggaattaccaaatttaaacatccataaagacccaaaattttcaaatataaacagttgagccaatgaacccttcagctcctaaggtctaccttcactagatcattaagttccatgatatcaagaacttaactttgatctccactgtatacccagagtctagaaaaaagtgcacagtaggcattcaataactactataaacaccgaacctctgagactccagaaggtggctccagattgagtcataacataactcatcattccaatggaatctgcctagatttctcatgtttagactcctgttctaacaccactatgtctaattcactgcattgttttacagtaaacaaaaagcttcctttttccactgctcctcccttttattccatcgcaagccagaagttttgttaagtattccccagtaaaatttccagtgcaaaggaatatacatcacatttcctagattctttctataatggcgtattgccatttacatcatccttttccgagttccattgaaattaccatttttaacttgctatgtagagtttaaatgaaaggcataatgccaaatccttatcaacattagcagcagaagaaaaattactgacaaaaatctactgataccaagttggacataatgccctcaaaacacctagttagtatgtatgtaaaagcatctaaaccctaccaatattccttgacaaatctatacgtagacaggaaaaagcttaagttaaacgtaagttgtcttgtctatacatatttgataatgtgaagacatggttccctccatagcttatccatatatatgcaaaataagctaaaattataatggggtggttctactaaacaactttatgatataattacaatattcactaatttgtgatggcttgtttttcagagaaagttaccgcatgcaaaaataaagctacaacaaatgacacactactgactaaaaagcaagtctgataatcctacaatagagtcctccttcaaccttaatacgatatcaaaatgctataaattatactgccttaggtcaggcacagtggccaatgcctgtaatcccaccactttgggaggctgaggcgggaggactgcttgagcccaggagttcaagaccagcctgggcaacatggtgaaacctcatctctataaaaaaaaatttttttttgagatggagtcttgctctgtcatccaaactggagtggactggtgtaatctcggctcactgcagcctccgcctcccaggttccagccattctcctgcctcagcctcccaagtagctgggattacaggcgcacgccaccatgccaggcctctacaaaaaaaaaaaaaaaaaattaaaaaaattaaaaactagcaaggtttggtggcaaatgcctgtagacccagctactcaagaggctgaggctggaggactgcttgagcccaggagttcaagaccagcctgggcaacatggtgagacctcatctctacaaaaaactttttaaaattagcaaggtgtggtggcaaatgcctgtagtcccagccactcaggaggctgaggcaggaggatcgtttgaacacaggaggttgaggctgcattgagctgtgtgttcatgccactgcactccagcctgggcaacagagcaagacaggggaggggagggaaggagaggggagggggaaagaaaatagtattgcctcaataaaatatcatttatagagagtatgagccatagaggataagtgatctgtggccacatttgcagtatgtgatcctgacccactggccactgctaattggataataagcagctaccacatccagtatgagccagtcagatcctctctcttgggaaactagcattcacagccagtgcctctacagagaaggaagcataagcatttagaaagatggttctcctgactctagggggccactggtaataacaatctcagtttctgaggctttccagtttctggatcctgtctctccaaagccaggccacacaccttcccctttgggtgccaaaactatatcctcccaataatttctctttttgcttaagttagtctgaatgggtcgctttcctgttacttgcaaccaaaaatgtctgaagataaagggaatctgcagtgcttaccaaagcactgtcatatgccaaaaagcacacttaagcaaaaatgcaaatgtgttaaatccccaaatcattaacattttacaagttaaaatgttttcaaatgttagtcctaatcttaaatattaacaaaaatgacatgtgttcaaaaaattgctatgcagataagaacacatgaacatgcttctaatatacaattttgtattcaacacagatctctgttttatgacactagcaaattaacatagtgtagattatgagcccacatatgtagaactggtattggttggtgtatgtctactctatcaccttaaagtcatggtcctcatggttctcaaactttagcacgtatcttatctcttcctagagggcctgttaaaatacaccgctgagtcctaactccagagttcctaattcagtaggtctatatggggccccatgactcaattcccagtgatgccaatgttgctggtctcagcaccagactttgaaaaccacggccttaaataatggctctctacttttaggggaatgagatggtgatggtaaagcgctcctttgaaaatttaagaaaaactatgtacttagacaatacacacactttaaagggtttacagaaactcaaaagctcatccacatactcttccaaatgattctacattaagaacctcattaaagaacaacataggggctgggcctggtggcttatgcctataatcccagcaccttgggaagccgaggcaggcggatcacttgaggtcaggagttcgagaccgaaaccccatctctactaaaaatacaaaaaaatgagcaagacatggtggtgtgcacctgtaatcccagctactcgggtggctgaggcatgaggatcacttgaacttgggaggcggaggttgtggtgagccgagatcatgccactacactccaggctgggtgacagagtgagacacggtctcaaaaaaaaaaaaaaaacaaaaaacataggattatacatattcatgaagggtcatacatgtccatgcagggtcatatatagccatgttttccaaatatacttggaacttttacttgtaagttattttacacattcatcttgaattttttaagaagcacaggctatttcattcaagttactaattaacatagagcaggaagattctgttttaaaaacttacctgggccaggcgcagtgcctcacacttgtaatcccagcactttgggaggctgaggcaggcggatcatttgaggtcaggagttcaagaccagcttggccaacatggcaaaatcccatctctactaaaaatacaaaaattagccaggcgtggtggcaggcacctgtagtcccagatactcaggaggctgaggcaagggaatcgcttgaacctaagaggcagaggttgcagtgagccgagattgtgccactgtactccagcctgctcgacagagcaagattccatcaaaaaaacaaaacaaaacaaaacaaaacttacctgaacacaatctcactttgtcattaaaaaattgatgaaattataactataaaatagacaaaatctatatctagatttaacagaaaaacacttaggaataacattaaactatcacatgaaggacatgcacgtattcccctaaaaaaaaaaaacaaacaaaaacctctagattaaagctgatgtacaaatatgataggctccagtctttaagccaccgcaactgatactgagtgaggacaagctgatcctgccaagccctgtacaaattacagattcacaaacaaaataaatgttgttttaagccactaagtttttttccttttttttttttttttttttgagatggagtcttgctcctgttgcccaggctggagtacaatgacacaatcttggctcactgcaacctccacctcccgggttcaagtgattctcctgcctcagcctcccgagtagctgggattacaggcatgtgccaccacgcccagctaatttttgttatttttagtagagatggggtttcgtcttattggccaggctggtctcgaactcctgacctcaagtgatccgcccacctcagcctcccaaagtgctgggattacaggcgttagccactgcatctggccttaagccattaagttttgagacactttgctaaacattgttagataattagaacacctttagatgagttgagaaacagattaaaacccagtcaagctgacagttttctccattagaccacttttcaaagtatatagctactgaactacacgcagacctctcccctaatatccacatcctcatatccaaatgactactaaactctgacaaaccctaatctggacacctagtctgctgcggccaatgcagatgtaagcaggtgacataatcctaactcaggtatatcacatacaaaacagaggcagttagatgttataatttcataccacatgtatgctatagaccatctccagccagttccctgcttaccatccaacaaacccagatatcaccaccaaccaatcaagaacactcaaaaatttggcttttctaatatggaaaaggacagttcatgatcttttggctttaaaggatctccatccctgacagcgcgcttagactttgtgctggattaggcttcctgcttggcaataaagttttttcactcagtacacaatctttggtctccaacagtctttgtactttaacagtttggaagtcccacacagatcatatgactgagccatccgatgaagccaacaagccaccaacacctgagaacatagtaagccctggtttccatcaccttctgatggtgattccgctgactttatgagtttgttctgctgtctcgcaagtttgtttgaagccttctggtttcttgtgggtagacatggagaggaaatttggtctcttctttgagtgatacaaaaagagtgggtctattctgtgtatgttccattgttagtccacctgtgtcctaagagaatactcagaaaactcaaacgtttggaccagattcaaaggctggaggtcctagactactgggtctgcctcaactgactaagtattctatgtatacattttctatcaaatagtgaaataaatctcctttttggtatttgttatgggggtctgttaagtaaaagagtcaaatcctgtcaggactcctgaatcttttatgttattcattatagtccaaattcatatacatgtctaataagtactatggcaaaattataccaagaatagtttctaaattaccgcggccactttggggaacttgcaatttcaacgagggcttacactcccacaatgccttagaaccaaaggaggtaaaacccccaaagcaatagtctacattcttaaactctaacactaagacaaccaatggctcaataactcaaaattaacttccttgaaggattctctaacaagaggtaaagaaagggcagctctttctccgtgacttcctgccttgaaagctcagcctttaactcatctgctagaatcctaatgttctgactcttcagatgaggacctcacactactctcacaattgatcatcacagggctccctcacatcttcctgccttagatatcacagttctatctcctcccctgttactgagcacccatgtagtatgggacagacaaccccacaatttccattaaggacttacccccacccttcaaaagaaagccaggctgttgtttttaaactccagccccaggcaaaatccctaaacccactaaaaagaccaaaagttttctgagtttagaaaacttttacatatctaatactcccatgcccaccagaacctcacaaacttacagactactagtttccctaagaaggtcgaagatggttccaaaaaacaggttggaaccctaatgcagatcaggtatcactaatcagaagaaagtttaagaaaagtgtgtgtacacctataatcccagcactttggtaggtcagggcgggaggatccctttagcccaggagtttgagaccagcttgaacaacatagtgagaccctgtctctataaaaaaaatttttttaattagccaggcatggtggcgcttgcctgtagtcccagctacctggaaggctaaggcaaaaggatagcctgagcccagaagtttgaggctgcagtgagctgtgatcacaccactgcactccaccctggacaacagagagagaccctgtctctaagataaaacaagtagaaggaaaagtatctgcttcacaccatccccgaagtctttcttaccaaagtagattacaccaaaatcctaaattgcaagcagtcatttgtaatcagaagattttagaaacttttaggcaatatttttatagacctagaggcagagctaaatggccttttcagcctcctttaatggattaaaaccagaaatagattagtgggaagaatgtcagtggattggcaaataaattatctacatgaattacaacagaatattgtccaagaactctaaacaaattttttaaaaaccatatgtctcttcaaattaaacaactcattcaaagtctaacaatacctcctatgactggtagaggaaagaactgtcctggggggatgttgaatccataaataattcaggtactagaaaagtaatcatcctttaagaactgagaaaggaggccgggcacagtggctcacgcctgtaatcccaggactttgggaggtcgaggtgggcagatcacaaggtcaggagttcgaaacgagcctggccaacacagtgaaaccctgtctctactaaaaatacaaaaattagccaggcatggtggtgcacgcctgtagtcccagctactcaggaggctgaggcaggagaatcgcttgaacctgggaggcggaggttgtggtgagctgagatcgcaccactgtactccagcctgggcaacagagcaagactccgtctcagaaagaaaaaaaaaaagttaatacaaattaagtggttagcaaaaatcctagaagatatttatttataagaggcttctgatttttaaaagtcttcatgccctcatcaagtaaaaaaccacttcatttgagagattaccagctaactgggaatttctaaaaatataaggtcttactcaaattaaatgccacaaaagaaaaagaacctgttactctgcaagtgtgcagagagctaactggccaaaacacaagaaattagttcctgccatcacacccaaactggcgcaacaggttaggggtaagcagtaaggcagaactataatattgtgaaacctaaaaccttatatttaaaggctctactggggacaactactgggggcaaggggacaaatgacagtccacccagagttgaaacaattttagcagaaaaaggttttataactatccttagaaaattataagaattttgcctctcagaatttgcctctcattagctgaactgataaggataagaacaagttcctatacaaacttcttgaaggctccagctaagggctgtcctttatatcattgcggagaacttaaaacatatccttgaaggccctacttttcaaccagcactcaattatctctagggagtccttgaaaagcaactattagtcaaatgcagtggtaaggtcaagtcagaaaagtctgtttcatcagttagagcactagtatcctccctaagagcagcttcataagagtagtgggcaaaggctgggttagtgcataaatgaaaggtgaaggtcatgtgtagtggctcatgctgtaatcccagcactctgggaggccaacgcaggaggatcacttgagtccaggagtgcaagaccagcctgggcaacatggcaagaccccatctctacaaaaaatttacaaattagccgggtgtggtggcgtgtgcctgtagtcccagctactcaggtcaaaaaaagggagagagggacgggggtgaggtggggtggagagggagggaggaatggaggtgggggggagagagggggggggggagagagagagagagagagagagagagagagagagagagagagagacagagagagagagacagagagatgaaaacaaggatacacatcacaagagcagactactctttgtaaaggtcagacctaaaatgaagaaatgcaggggttgaaggaaatgggctaagaaaggactttaaagatgagagacacatgtggatatttaaattctgaaagaagataaaaagagtacttaataggacaaagttccagagtccagagaggagaattaactaaccttcacaggtgaggaacacaccttgactggtcatctttgaaaaccagcccagctcctaaaatctcctctctcagaacataaaatgcacttaaacaccccctcccaaaaaacaaaacaccatgaaacaaacaaaaaacagaaatttgacatgaccctaattccacctctgccctcattttcacactttttattggatgtaagaaatatttacacaataattaatatgcattgagcatttactacttctcagacatggtgcttatgcacgttatatggattagctcattaaacaccagacaggatcagcaacatggggtcagcaaaactgcactttgctatcatatctgcctctcaacatctattaaccacccaccaccctagtattattctaagactctctttttttgcgggggggggggggggggggtggacagaggcacactcgcccacgctgagtacaatgttgcgatctcggctcactgccaacctctgcctcccgggttcaagcaattctcctgcctcagcctcccaagtagctgggattacaatcgctcactaccacacccagctaatttttgtatttttagtagagacggggtttcactatgttgaccaggctggtctcaaactcctgacctcaaatgatctgcccacctcgacctcccaaagtgctgggattacaggcataagccaccacctctttttaaaaaggggtgggtgggaggaagcaaagctaaattttaatctccagaaattttgacttgccacatcaatcacaaatttatacattagctcagatgtccggagctagactggccaaagtgtcgtgcaatccacaccacatggttaataactgaccatgcccctacacactcctaacatcaaccctcccaggaaatgtgtgtctattaaaccaaatccatttccaattgacttatactcagggcagctgtgggaaagagagatgggcaggaaacaaacaaacaaaaacttctcttaattcaaaacacatagtcagcctatttgacctaaaacctggtcttaaggaagttacaaatgcttcctatattctcttttcagctgaaggggaaaatgagacaagtcttggggaaaaaaactgttcaaaggcctccagacttctgtcaagagacctaaacaatttaggaagacagtgtaacacagagcttagagacaggaataaaacacatctggtttcaaattccagcttcccacgcttaagagaagggctgtgagcccttggacaaatgacttaacctctctgagatcagtgttttctgatgacaatatgatagtatttgtactcgcctacttcagagtattattttgaggattaagtgagatgacttaggtaaagagtttcttaaaactttgcaaatagggatacacagtatttattgttataacagaaggtagaggctgcatgtggtggctcaagtctgtaatctcagcactttgggaggccaaggcagggagatagcttgagcccagaagttcgaggccagcctgggcaacctgaggagaccctgtctctataaaaacacaaaaattagccaggcgtggtggcacgcacctatagtcccagctacttgggaggctgaagtgggaggatggcttgagcccaggaggccgaggctgcagtgagccatgatcatatcactgtactccatcctgggtgacaaagcaagaccctgtttcaaaaacaaaacaaaacaaaaaaacagatctctacctatagattcttctatatccaggtactgggagtcaatcagggtccctcaaaatcaaatagaggaaagaacaacttcaaagagaaagcagagtataaaaacagagaaagaacactccctttccacttaaaccctccatacccacaccggtatcattccatcccaggtgaaaatgtttattagctgggtaaaaataaatacataaatccctttaccatatatttacaatacaatatagtaagaataaccattaaatatgtcatattcactttgttgcaagtttaaattccaggattcaactagcatcattggtttgtttttcacataacatgaattatcttacaacttcagttgattagaggcattagagaatcagtaataattctggtccctacaattctgagccttcaataatatgctgaaaacaccaaacaactttcaattctaaactttagaggtaacttataaacacaggcaactaccaagagattagccccccaccccccaaaaaaatgttgtgaagagttttatactctccatacaaagttactgtaaaaacataaaatttatataggctgagtgtggtggctcatgcctgtcatcccaacactttaggaggccgaggtgggcagatcacctgaggtcaggagcttgagaccagcatggccaacatggcgaaactgtctctactaaaatacaaaaattagccaggtgtggtggtgcgcgcctgtaatcccagctacttgggaggctgaggcacaaaaatagcttgaacccagaagctggaggttgcagtgagccgagatcccaccactgcactccagcctgggcgacagtgagactgtttcaaaacaaaaaacaaaaacaaaaagagaataactggctgctagcattcttggagctaagtaatacaagggggctgggagtttcaccatttaaagatgtggcaaatcccctcattttcagctgggcatttctttaccaccttccacagcaccaggtattcctgggtctataggcagtctggctttctccacaagataaatctttgacttttttgtgaggttgggtaagaacactcatctgcttgcctaggatgaggcatgtatagaactttccactgactttaaaccatttcctgctttcagcttcacatcttgcttgcaccctcagagatacctggcaccttcaattcctgagtcttcctagagataggtgatatgaactggctagaatcatgcaaggaattggtatccgcctctgtagatattttatattccactttctcagctaattaatctactccaaccaccttccatttccctgaagtttttttataccacttatttactgtctcctgttctttctgctcttgcagatttatgctgttttcattctcttactcactgtgaatggggcttggggacagagcagaaataaacatatttgttcaattcaagcttaaaaagaagacacagtccttgaatgatttttatctgatgctaatacatatcctgggtgcattcagatttcatgaagcctggagtttacagagtttggaggctccattttaagagcacagaattgggtattgacagccaatattcaatttagaatgagaaaataaatcataaattttaacaaactggcaaaagccacaaacatcataacctaataataataataataatatttgttatgacaagtttttttcccatttgtttccagataaaagtcacataaggccaggcatggtggctcacacctgtaatctcagcactttgggaggccagggtgagtggatcgcttgaggccagaagttcatgaccagcctggccaacatggtgaaattccatctctattaaaaatacaaaaattagctgggcgtggtggtgcacagctgtaatcccaggtacttgggaggctgaggcacgagaattgcttgaaccagggaggtggaggttgcggtgagccgagatcacaccactgcactctggcctgggcgacagagcgagactaggtctcaaaataaataaataaataataaaagtcacataacatgaaaatcaccaagttaaactgtataattcaataatttttagcatagtcacagtgctgtacaaccatcaccaatatctaattccagaacatttccatcaccccaaaacaacccccatactacctgttagcagtcactccccatcttccctcccccatcccctagcaacctgaaaatctaccttctgtctatggatttgccaagtggaattaaacaatatggctttttgtgtctggcttctttcaatcaacctaattttttgagctcatccatactatagcatacatcatcagcactttattcccttttatggctgaataatattccattgtatagatatgccatattttgtttatccattcagttgacagacatctgagttgtttccacccaactattttggctgttatgaataatgctactatgcacaagattttgtgtgaacatatgttttcagttctcttatgtatgtacctaggaatggaattgctgagtcatgtagtaactatgtttaatttttctgaaaaactgccacaaactgtttagcagagtggttgaactactttacattcccaccaacaatgtatgagggttccaatttctccacatctttgctaacatttgttattttcccattattatagcccttctagtggtcgtgaagtagtatcccattgtggttttcattttcatttccctaatgattcatgatattgggcatcttttcatgtgctttttggccactgatatatcttctctggagaactgtctattcaaaccctttgcccttttttttgaaatgtggtctcactatgctgcccaggctgttctcaggggatcctcccacctcagcctctcaagtagctgagactataggcatgtgccaacacatctggctagctgcccattttttaactggattgtttgtccttttattgttgagttttaagagttccttaaggccgggtgcggtggctcacacctgtaatcccagcactttgggaggctgaggttggtggatcacctgagatcaggagttcaagaccagcctggccaacatggcaaaactccatctctactaaaaatataaacattagctggacgtggtggcacacacctgtaatcccggctacgcgggaggctgaggcaggagaatcgcttgaacccaggaggtggaggttgagtgagacgagattgcatgccactgcactcagcctggacatcagggccagactctgcctcaaaaaaaaaaaaaaaaaaaaaaaaaaattagctgggcatggtggtgtgcacctgtagtcccagctactcaggaggctgaggcagaagaatcacttgaacccaggaggtggaggttgcagtgagctaagatcatgctgctgcactcctgcctaggcgacagagcaagactccgcctcaaaaaaagaaaaaaaaaaaaagagttctttatatattctgtatactagacccttatcaggtataatttataaatattttctctcattctatgagttatcttttagctttcttattagtgtccttttggacacaaacgtttttaattttgatagagtctaggctgggtgcagtggctaatacctgtaatcctgtcactttggcaggccgagacaagaggatctcttgagcccaggagttcgagaccagtctgggcaacagagtgagacctcatctttacaaaaataaataaataagatttttgtttaaattgacagaatccaatccaaagtcttgtgtttctatctaagagatttttttttttttttgagacacagtcttgctctgtcacccaggctggagtgcagtggcacggtctcggctcactacaatctccgcctcccaggttcaagcgattctcttgcctcagcctcccaagtaagtgagattacaggtgcctgccaccattcctggctaatttttgtatttttagtagagacggggtttcatcatgttggccagactggtcccgaactcctggcctcaaacaaccactcgtctcgacctcccaaagtgccaggattacaggtgtgagccaccacacccagccatccatctaagagtcttatggcttgcattgttacatttagtctttaatccactttgagttaatttttatatatggcatgaggtagaggttcaacttcattcttttgcatgtggaaatccagttggtccaacacattattattattattattttcttgagacggagtctcattctgttgcccaggctggagtgtaatagtgcgatcttggctcactgtaactgctgcctcccaggttcaggcgattctcccacctctgcctccccagtagctgagactacagtcgtgtgccaccatgcctggctaatttttgtatttttagtagagacagggtttcaccatgtggaccgtgctggtctcaaactactgacttcaaatgatccacccaccttggccttccaaagtgctgggattacaggtgtgagccacagaacccggtcccaatgccattttttaaaaagactaatctttccccattgaatggttttggcgccctagtcaaaaaaaaaaaaaaaaaaaatcaactgaccacaaatgtataattttctttctggactttctattctattccattgatctatatctcaatccttacaccagtaccacactttcccatgagttttttttttttcctttttcttttttttttttttttttttgacagagtctcactctgttgcccaggctggagtgcagtggcacgatcttggcggctcactgcaacctccacctcctgggttcaagtgattctcctacctcagcctcccaagtagctaggattacaggcatgtgccaccaagcccgactaatttttgtatttctaatagagatggggtttcaccatggtggccaggctggtcttgaactcctgacctcaagtgatccactcacctcagtttctcaaagtgctgggattacaggcatgagccactgcgcctgaccaatttttgtatttttattagagacagtgtttcgtcatgttgggcaggctggtctcaaactcctgacctcaagtgatctgcctgcctcagcctcccaaagtgctgggattacaggcgtaagccaccacgctcagcctgttgttattgatggcttagaaaagttttcttttagcacaggaacatcatcaataaataatgttatatcaacttttaggactatggtcaaacctgggaaaattcttaacaagtctctttcattaaagctacaaaatcttaaagaattttccccagactggcttttgacatcaaaccttgtttttcctctactaaccacacactttgggtgccagatgccataggacacattcatattgctagacaacctctagctatgcacgtttatgtcacaatgccccatgagttagcacaacagacatagagtattcctagaaaccattcccatactgggatggctagtaataccttgactatacacaaagaggctatgaaccatgtaaacatatcctgctaaaatccaactaaatatctctccaagtcaatttccccatagccagaccccaaaagtgcccacagccattccaatgccacccaacataaggaagagtgtaacaaaggggaagtcaggtaaaaagacggcaattttagctgactgtggtttagataacttacatttgcaaattcttcaaagatatgtgaccacatactggcaatgttctgtttcttgatctggatgctagttatatatgtgtgttcagtttgtgaaaaatcttaaactacacacttataatatttatgaattttctcattcatatattatataccaataaaactttttaaaaattaaccaagtgaacacattgctagggtccctcccagaccctcagattgggtcttgaaaattaagcttcaggctgggcgtggtgagtcacacctgtaatcccagcactttgggaggctgaggtgagtggatcacttgaggtcaggagttccagaccggcctgaccaacatgggaaaaccctgtctctactaaaaatacaaaaattagccaagcctggtggtgcacatctgtaatcccagctacttgggaggctgaggcaggagaatcacttgaacccgggaggcggaggttgcagtaaattgagatcgcaccactgcactccagtctgggcgacagagcgagactctgactcaaaaaaaaaagaaaattaaggttcattagtttcaaagagataatagcaactggatatcataagatgtggtgtctaataccagctataccatgaattacccatgggacttggagaagacacatatgcctccctaagcaattttctcacctaaaatggggaagtttaagtcagactataaactctaagacttctttccagtagtcactcaagaaatacttcccaagtacccgttactgtttggcatcacattaggtaaatgaaacacacacacaatccctgccctgtgggtgctccccatctaatagggattaaaaaacaatgagcagcattaggtaaaaactaatcggaataaatatggattttagttaataaaagtgtaccaatattggttcattaattataacaaatataccatactaatgtaagattagtttagttaatagggaaaactggttatggaaatacaggaattctatactatcttcagatttacagatctttagatttacagatttttcttatctttagacttacaggtttttctatacatctaaaagtattctaaaatcaaaagtttatttttaaaaagacagtaaacaggtaaataaatgaatattaaaagaaattgtgttcagttctcagaagttaacaggatattatggaggtagcataatgagagtagagactactttagacagactacttaggaactctttgagataatacaactgacacagaaaaataagaagaaacaagagaaagaaaattccttcaaaagaaagaatatatacaaagactctgaggtggaagagattggccttttcaagaaattaaaagaaaatccacgtgactaaagcataatgagcaaaggaaagcccagtcaacaggggcagattatataaggtcttggataaatagtgtctatttcattcaaagtataatggaaagacactggagggttaaagcaaggaagtaaaatcatccaatttacttttttcttttttaattcatgaagctatactgtggagaatggattatagacgggttaaagaaaaacaatgaggccgggcacagtggctcacacctataatcccagcactttgggaggccaaggcaggcagatcacgaggtcaggagaccaagaccatcctggccaacatggtgaaaccccgtctgtactaaaaatacaaaaattagctgggcatggtggcgggtgcctgtgatcccagctactcagaaggctgaggcaggagaatcatctgaaccagggagtcggagattgcagtaagccgagatcatgccacagcactccagcttggcaacagagtgagactccatctcaaaaaaaaaaaaagaaaaaagaaaaaaaagaaaaacaatgcagaccctatagggaagcactaacatcattttattcttaaccctgaattataatattttttcaatacaaaaatcattccaaaaaaaaacatttcagagaattaaagaattaaattcacatattcatataaattattttattcagatagtatctgcttttttaccaatctgcttctctatgacctttataatcctttatcaaaataatttatggattttatactttaataagctatcataactcttctagaagctgctgaaaatttttatgccatttgttaagtgctctgtaataaaattcctggaaattcaaaggtagaacataaaataaattataaaagctgaaaatttttatctattagattaatatatcaaagaataaatagtccaaccccccaaaaaaaacaaaaagtagcagcacctgctgccactgccaccacctgtgacaattttttaaatggctgcaaattctttgaaacttcttctatcaagatatgggagttcatgttccctctccttgaatctagaatagcctgtaactaacttgttttgtaaccaatagaatgcaggtaggacctcctaggctaagtcagaaaaggagatgtaactttcactttgttccttggacaattcctgctggtgccctgagtcagtcatgttagcagtgtagctgccgtaaagctgccataaaccagcccatgtagacagaccacatggaggctctgacatgacctgaagtgagagatatgcccagccaccccccagcaattccagttccagccaccatctgaataaacacacaatagactctgggccaaaatgacccaattaagccccttgccaaatccctgacccacagaaaccatgagatgataaaactattagtctcactccagctggaatgcaatggcacaatctcggctcactgcaacctccacctcctggattcaagcaattctcctgcctcagcctcccgagtagctggaattacaggtgcatgccgccatgcctgcctaattttttgtattttagtagaaacagggtttcaccatgttgcacaggctggtctcaaactcctgagctcaggcaatctgcccgactcagcctcccgaagtgctgggattacaggcgtgagccatcacgcccggccctagggtcattttttatgcagcaattctaataagccctttctagcaaatatgtgataattcatgtgaataattgggaggaggagaagaatttgtttggctagcaatgcaggtcgattttccagcttccaagtatctaagggatctggaaaagctatgtaatattactgtaactcacagaaagcaaggtacatcctccctaaagtcagcataattggccttataatctctacagattctttacctgcatcatgattcttctatagcaaaagagaatggataaatatacttatcaggccactgagtagtcaactgagagccttgcactatataatcctactaaatgtagtagttatttattatggcctaaattaatccctggcctctcctgaaacaaaaatgagtgagccatttattgcagaagcatcaaaactgccaaacaaagcaaaaattaagtttactcttttgaaccaagaattatcacacattaccactaagaaggacagacagatcttttaaattatgtttatcagccatccctttttaaaactttcattcatttaattaacacatatctattaagcactgtgtgtaggcaaatattagtatgaatgagtctatagctataaagaagttcacagtgctatggagaaaacatcaaccaaccaattttaagttgaattttatttatttatttatttattttttgagacagggtcttcctctgtcgccccagttgcagtgcagtggcacactcatggctcactgcagcttcgacctcccaggctcaagagatcctcccacctcagcctccctggtggctgggactacaggcatgcaccaccacgcctggctaatttttttgtatgttttgtagagacggagtttcaccctgttatccaggcttaagttgaattttaccctttattttttactttgagataggttctcgctctatcacctgggctggagtacagtggcgccatcacggttcactgcagcctcaacttcctgggctccagtgaccctcccatctcagcttcccaagtagctgggatcacaggcacgtcaccatacccagctaatttttgtttttttggtagagtcggagttttgccatgttgtccaggctggtctcgaactcctgagttcaagccacccacctgcgctggcctcccaaagtgctgagattacaggcatgagccactgcacccggcctaaattgaattttaaatcaatatattaatacaatgagaattatgctaaagtagtacaggagaataaataagggtgtgctagatgttttgttttctatttaatcctccagatctattctccatcctttaccctgtgccctaggaggctgccgtcatgtactacataaactgggctctttgttctctggctttaaatcgggttcaataaatgagaagcaacaaccagggtctctctggactcccacaactactctctccctttgcccttgctgggccaaatatggtgcaacttcctatcattgctagtccctaggtgctgcactattccttgctggattcccgtaacccttcccataccattgtaaatacctgcttcattacactctttgacctaattaagagtgttacttgtttcctatcaggatactaatagagagggacacctaactcagtctggggaagcctgggaagaattctcagaggagatgatgcttcagctacgttttttgtttgtttgttttttgagactgagtctcaatctgtggcccaggctggagtgcagtggtgtgatctcggctcactgcagcctctgcctcctgggttcaggcgattctcctgcctcagcctcctaagtagctggattataggtgcgcgccaccaagcctggctaatttttatatttttagtggagatggggtttcaccatatcgcccaggctggtctcaaactcctggagtgcagtggcacaatcttggctcactgcaacctctgcctgctgggctcaaaccatcctcccacctcagcctcccaagtagttgggactacaggtacgcaccacacaccaggctaatttttgcagtttttgtagagacggagtttcaccatgttgctcaggcaatccacctgcctcagccttcaaagcgctgggatttcaggcataagccaccgcgcccagcctcagctatgtcttaaaactggagcaccaagcttggtggctcatgcctgtactcccaacaatttaggaggttaaggcaggaagatctaattgagctcaggagtttgagaccagccttggcaacacatcagaacctcatctctactaaaaatagaaaaaaaaaaaaaaaattagccaagtatggtggcacatacctatagtcccaactactcaggaggctgaggcaggaggaatgcttgagcctgggtggtccaggctgcagtaagccatgatcaaaccactgcactccagcctaggtgacaagagcaagactctgtctcaaaaaaaaaaagaaaaaaaaaaaaatgctgagtagccaggcatggtggctcacgcctgtaatcacagcactttgggaggctgagacgggcggatcacctaagatcaggagtttgagaccagcctggccaacatggcgaaactccaactctaccaaaaagacaaaaattagctgggcatggtggcgtgcctgtgatcccagctacttgggaagctgtctcatggtgaaaccctgtctctactaaaaatatacatatacacaaaaattagccaggcatggtggcaggcgcctgtaattccagctactcaagaggctgaggcaggagccgcttcaacccagaaggcagaggttgcagtgagccgagatcacaccactgcacttcagcctggataacaagagcaagactgtctcaaaaaaaaaaaacaaaacaaagtgctgagtagattcgacaggaagactaggtggggaaggaggaagatgggtaacagcatcatctaaggcaacagcactgtcaaaaacttggagatacaagagattatgaaatttaagaaaagacaaggagttcagagtggtagaacacagtggtatgatgggaaggctagggccaaatgataaagagttttgagatgctgatatatttaataaatctgttttctataataaataaatttgaagaaaaagaaaattcagaggaagaaaagagaaagctatagtttaaacgataattaagagacataccaacccaatacaatgtgtagacctcttccggattctgattaaacaaaccacttactcaaaaagggagaggggtatcaggtacagtggtgtacagctgtagtcccagcttctctggaggttgaggcaggaggataggttgagcccatgagtttaaggctgcagtgtgttatgttcacacctgtgaacactagtacacatcagcctgggcaacacagtgagaacttgtccctaaaaaaataattaagaaaaatagaaaagtggggaggaagacaaggaagagaataattggacatgcatgtctcctttttgtttgtttttaaattcaagacagggtatcgctatgttgccaggctggtctcaaacgcctaggcttaacaaccctcctgcctcagccttatgagtagctgggattacagacatatgccaccacacccaggtggacatgcatctcttaatgagatggatggggttttcttactttcaattacttcatgtgtctattaatgactattacttattgctggaatgagggtacaacataaattctaatcccatttttcattttatacatataaatgctaagaaaacctattcacataaataagtaggtaatgaaagaagttttgttacagcaatgccattaaattctttgagttagatgccaaaaaaaattaccaagatctataattttaaaaaactttctgggaaatggcatttgacttcactatttcttataattttttttttttttgagatggagtcccgctctgttgcctaggctggagtgcagtggtgccatctcagctcactgcaacctccatctccaggttcaagcaattctcatgtctcagcctcccgagtagctgggattataggcgcacaccaccatgcccaactaatttttgtatttttggtagagacagagtttcaccacattggccaggctggtattgaactcctgacctcaagtgatctgcccgcctcagcctcccaaagtgctgggattataggcatgagccactggaatttttctttttttttttctttctttttttttttttttaaattgagacaaggtctggctctatcgcccaggctggagtgcagtggcaccatctcggctcactgcaacctctgcctgctgggctcgagccatcctcccacctcagcctcccaagtagttgggactagaggtatgcaccacacaccaggctaatttttgtagtttttgtagagatggagtttcaccatgttgcccaggctggtctcgaattcatgagctcaagcgatccatcccttcagcctcccaaagtgctgggattacaggcatgagccaccactcctggccctataaaaattatttttaatgaccagctaaaacttgatcaagtccttcaattttgttgaaaactacagagagaaatatgcctgacttatgaaaagatgctacccagtcattgatatcactgccttctcaccaacattctgatttgtctctctggtggtgtggaaggcctctcaccacaatgtactatttgggatgtctggctaatgtgcctttctttgtaaagtggaaggtagaaaatatgaaagatcaatcgtagaatctagaaagcccccttagaaatacctatgggctttcattattttatttcacccttactgcatacaccattaactctagcactgactgtggttatttcatccatcaagtcttatctgtttggttacctgcaagttccctgaaagcaagataaaggtcttaacctcttcttaaaatcctagagcctacatctcagtgttaggtgcatgtaagactcccagcaaatgtttactgaatgaatatgtaaatatgagcatatttcatcattattcttagtcttcttccttgctagaaaaaatacaattaggggttaactaagctggaaatcagaagaaactgaaaaaaaaagaaaaaaaaatcagaagaaactgggaaagagaaaactaaaatatatgaagcttcaaattttatcacaatgaacttttggtacatctatcctcatttctaaagaactggaatagaggccgggtacggtggttcacacccgtaatcccagcactctgggaggctgaagcgggcggacctgaggtcaggagcttgagaccagcctggccaacatggtgaaaccctgtctctactaaaaatacaacaattagccaagcatggtggtggcaggcacctgtaatcccagttactccggaggctgatgaaggcaaatcgcttgaacccaggagggggaggttgcggtgagccgagatcatgccattgcacttcagcccgggtgacagagtaagactctgtctaaaaaaaaaaaaaaaaagatttagggaacaaatttcgtcagataaaaggtgctcatttcactttcactggttcagattacctacaaagacaccttggtagacacagtggctcatgtctgtaattccagctaccagggaggctgaggtgagaggactgcttgaaacccagagttcaagaccatcctgggcaacagtgagacccagtccttaaaaactttttttcttaattagccaggcacagtggtgagcaactattgtcctagctactcaggaggctgaagcaggaagactgcttgagcctaggagttccaggctgtaagtgagctacgatcatgccactgcactccagcctgggcaacacagtgagaccctatctcttaaaaaaaaaaaaaaaaaaaaaaaaaaaaaaaaaacaggatctcaatagtaattaaatgagacaataaatgagaatatcttaaaaccatagaactctaaaaaaaaatgttaaattatcttcctaacattgacagactacttacatgtgacttttcttagatgataatccagcaacagattttattccagtgaatgttagtgatcttcattttgttaagcagcaaaatttgcagtgtggtaaaacagttctatccatcaagtcaaatattaacaaatgaacacttcagtcctatatctttataacttaatgatgttgaaattactaaggtataaatgttagttaattcaataatgacatcacaaagagagatcttatttgtttcaactgaggtccctgagatcacgaaagcctgttttcaatttcatcattctttaattcacaaatggctcacacatgtaactccagcattctgggaggtcaagactggaggactgtttgaagccaggagtttgagaccagcctgggcaacataatgagactccatttctacaaaaaatttaaaaattacaccagcatggtgccacatacctatagtctcagctactcaggaggcagaggcaggaggattacttgagcccaggtggtcaaggctatagtgagccataagcctgagcgacagagtgagaccctgtttcaaacaaaaacaaaaacaaaaaacaaaacacacacacacacacaatttattgaagtactacatatgcagcactatgttagagatggtattttgaatctatcaaatgccgttttacttttccttatagttttttttccatccttctttctctacaaaattccccaagttcaactgtaaaaaatctctatcaaccttatttatggtattagattcatacaattctgaataatcttaccaaccaatcagtgttttcttcttcactggaggaagaaagttacatgtaaagcctgatgacacaaaaatcacaaaaataaaaacagaattactaatgtttgcaactctactatctactcctacaacatgtagcatttaaagagtttacataagaaagctcacactaaagtatgatttttcattacacattggagtcaaattttcagtttctaactcttcaacaccatttattccaagcacactcatttagactttgggtttcagttttacaggtttttacataccctgacatctatcagtgcagaaatacccccatctactggcaagaggtgacgctacaggctacttttgaaagcgccagcatgctacagaggaatttatcaagtcataaagagttcatccaaacagctccccaatctacaatccaactccaaaatcctgagccatcttctacttcttaccaaacattgggggatggaaggaacagagaagtatagttaatcggttaaatggctgccatattaagataaaaatggtttataaaaatatatttttaaatatttaaaatattgaggccgggtgcagtggctcatgcctgtaatcccagcactttgggaggctgcaacgggcgtatcacttaagataaggagtttgagaaacaacctggccaacatggtgaaaccctgtctctactaaaaatacaaaaaattagccaggcatggtggtgcgtgcctgtagtcccagctactgggaaggctgaggtgggagaactgcttaagccagggaggcagaagttgcagtgagctgagattgcaccactgcacaccagcctgagtgacagagcgagacaccatctcaaaaataaaatattgaaaatatttgattaaaatattgaaacataaatacctaattatatttcattatatgaatacttcatgatatgctgatacaagacatttatgccttttttttcttgcctagctaggatttcaatccaaaatgcttactttaaaagacatgtatcatttaaataaatatatattaatcattattaatgtcgtacctgctcttataaaatataatcggttttcaccaatttctttaaaacaaaatccgtggtcaaaaatgacaaagtacgtttacaaaaaactttacaccttgaacagtatctttcatgtacattattccatcatattgctaaaataaataagacttgccttttttttttttttttgagaccatgtctcactatgttgcccaggctggtctcgaactcctgagctcaagcaatcctccagtctcagcctcctagacagcagggattacaggcacacaccatcacacgggttttttgttttttgtttttttttttggtattttcacacctggttttaacgctgtcattttaagcatgcatttataactaaaggcacaagcacagagaaaataagtgatttgcttagatgcacaaagcttatacatggcataactaggatacgaactcacattttctgcctccaattctatactctccacaacattctgactacctctcataaaatgaccaggcacagtggctcatgcctgtaatcccagcactttgggaggccgaggtgggcggatcacttgaggtcaggagttcgtgaccagcctgaccaacatggtgaaacctcatgcctactaaaaatacaaaattagctgggtgtagtggcaggcacctgtaatcccagctactggggaggctgaggcaggagaattgcttgaacctgagaggctgaggttgcagtgagtggagatcgtgcctgggcaatacagtgagactgtgtctcaaaaaaacaaaattaccaagtatatcttacatagaaaatgagatctacattatggatttctgctttgtgacagtgcctaggaatgcacggtggttaaaaaaaaaaaaatctgctggctgggcgcggcggctcacgtctgtaatcccagcactttgggaggccgaggtaggctgatcacctgaggtcaggaattcaagaacagcctggccaacacagcaaaaccctgtctctactaaaaatacatggtggcgggtgcctgtaatcccagctacttgggagggtgaagcaggagaatcacttgaacccaggaggcggaggttgcagtgagctgagatcgcgccattgcactccagcctgggcgacatagcaaggctgtctcagaaatatatatatttttgtgtatatatatatgcttacattttaataaaattaagtttcttcctttcttttgccttggagaaaaaatatacacataaagctgggcgcggtggctcacgcctgtaatcccacactttgggaggctgaggcgggtggatcatttgatgtcaggagttcaagaccagcctggcaacatggtgaaaccctgtctctactaaaaatataaaaattacacgggcatggtggcgcgcgcctgtagtcccagctactccagaggccaaggcagaagaactgcttgaacccaggaggtggaggttgcagtgagccaagatcgtgccactgcattccagcctgggcgacagagcaagaccctacctcagaaaaaaaaaaaaagagaagaaaagaaaagaaaaaatatacacataaaataatgcaagcaaaaacaggccaggcgcagcaatggctcagacctgtaatcccagcactttggaaagccaaggcaggggatcacttgaggccaggagttcaagaccagcctgggtaacacagtgaggccccatgtctacaaaaaataaaaaaattagctgggcacggtgatggatgtttgtaacccagctattcagaaggctgaggcgggaggatcacttgagcccagttcaagatcgcagtgagctctgattgtgccactgcactgcagcctgggtgacagagaccctgtcacaaaaataataatacaagcaaaaacgataaatactcataatccaacccacacttaacacaccaatcacctcctttcttttctatggtcacattttagatatgtttattctttatatcccacctttttccaaaaacatgactgatagctggtaaacagacacttacgttaagtcatggttgttgcaatcctctttcatcacatcagtaagagatgaaaaagactaataattttaaaatgtaaggttcataatagaaattctgaaaggaaaactacagggcccaatctaggcttttcctaatttcttatatctgcatttatggcaccacgtaataaaaataatatctgtcacagatcaaaaatgataaatacttattggctgaacaaattaaacagccgctccaaagcactacaagatcctaaatcaaagactcaatttgtttgaaagctgctttattttaaagctatagtaatcaagacagcatagtgttaaaacaaataaacttaaagggtagaatcataaagaaaacacaggagagtccagaaatagaattctatgtatactgtcaactgatttgtttgtttgtttgttttgagacagaatctcgctctgtcgcccaggctggagtgcagtggcacaatctcagctcactgcaacctccacctcctgggttcaagtgattctcttgcctcagcctcccgagtagctgggatgacaggcacctgccacacacctggctaattttttatttttagtagagacggggttttgccatgttggccaggctggtctagaactcctgacctcatgtgagcctcctgcctcggcctcccaaagaataggcatgagcaaccgcacctggcctgtcaactgattttctaccaaggtgccaagacaattcaatggaggaaacaaaagtattttcaacaaatagggctacaaaaatagaatatccatatgaaaaaaaaatcatgacacttacttctcacagcatattaaaaaattaacttgaaaataagtttaaatgtatgagttaaaattataaataatgcagaagaaaacacagagaaaatctttagaactctgggttagaaaaagacttaggactcaaaaaacatgaaccacaaaagaaaaacactgataaacaggtttcatcagcattcaaaacttcttctctttgggacatcttttggggggcggtgggggagctacagtccgggagaaaatatttgcaaagtatatatctcataaaaggcttatatccagaatacataaagaattctcaaaactcaataagaaaacaatccaattttaaaacatgaacaaaagatttggatattcaccaaagattatatggacaataaataagtccattaaaatgtgcttaaaactgtaggttattaaggaagtaaaaattaaagtaccatgaaatatctgtacctaccaattagaatggctaaaatcaaagacagtatcaagtgctgactaggatgaggaactactgaaactcatacaatgctggtagaaatgcaaaatggtacaactttgaaaaaaaaaaaatttttttttttgagacagagtcacccacactagaatgcagtggtgtgagcacagcaccgcagccttaacttcccaggcccaatcaatcctccatcagcttctcaggtagctgatactacaggcacaggccacacccgaccaatttctgtattttttgtagagacggagttttgccatgttgcccaggctggtctcaaactcctgggctcaagcaatccgcccagcagatttttaaaaagttaaaatgcatactttctgtatgatgcaacaatcccactcatttacccaagggcaagaaaaacatgttcacaaagagccatgtactcaaatgtttattcgtaatggccaaaaactggaaacaacaaatgtctgcagatatttataaatggataaacaaattggtgtacaatgcagtattcctcaggaatgaaaaggaacaaagtactgatacccagcatgaatggatctcaaaagcattacgctaaaagaagcctcacccaaaagactgcagacagtatgattccatttactcaaaatcctagaaaaggcaaaattatagtgaccgaaaacagatcagtggttgacaagttctcggtattgaagaagacaactggctacaaagaggtaagagaaaatgttttgggaagaaactttttgggaagaaatgggaagaacattgcatgattgcaatcatccacgtggtaattcctccctaaaaatgaatcatcgaggtttatttaaaaatttaaactttatgtctgctaccaatttttgtacaaaaccaaaccaaactgccaaacttcagattatctgttgacactttttaatataatatcaaatgtggttttaaaaaaggtagccaatgccatcagaagctattctaaaacagagttggtctgaaactattcttgttcagaagactgctcgtatttaaaaaatttttaatgaaataaaatttctcactttgttcaactacttatatgttggagagaaatccgagagaaaagaaaaattttaagtgttaacattcaactgtaacaagtaccaaacactgacacctagaaaaccagccatcagctgggtgcggtggctcatgcctgtaatcccagcactttgggaggccgaggcaagcggatcacctgaggtcaggagtttgagaccagcctgaccaacatggagaaaccccatctctactaaaaatacagaattagccgggcgcggtggcacatgcctataatcccagctattcaggaggctgaggcaggagaatcgcttgaacccaggaggcagaggttgcagtgagccgagatggcgccatcgcactccagcctgggcaacaagagcaaaactcagtatcaaaaaataataataataaataaataaatatagagatgaggtctcactatgttgcccaggctggtctcgaactcctgggctcaagtgatcctcccatcttggcctcccaaagtgctgggataacaggcgtgagtcaccacacccagccaaaattcttctaatcaagcaaaatacatataactgcattcctaaatacaagcaataactaggattagaaaacacaacgtaaatcacacaaatataaattatctgaaattaaattcaaacacaggaagaaaattataaagctatcctgaacaatatgggccaaagcttaaataaatgtaaaaaacatatcatgttcctgggtgagaaaactaaataaacttagatacttctttttcccaaagtaaagcaattctaatgacaatcccaatgaaatgtcttttttttttttttttttttttttttggagacacagtttcactctgtcgcccaggctggagtgcagtggcatgatctcgcctgcaacctccacctcccaggttcaagcgattcttgtgactcagcctccccagtagctaggattacaagtatgtgccaccacactcaactaatttttgtattattagtagagacagggtttcaccatgttggccaggctggtctcaaactcctgaccttagatgatccaccatcctcagcctccccaaagtccaaggattacaaccgtgagccaccatgcccggccccaatgaaacttcttattaaacttaacaagtttaatatttatgtggaagaaaaaaataagactaccaaaacaaatgaaaagaaattgggaggccaaggtgggcagatcacttgaggtcaggagttcgagaccaatctgaccaacatggtgtaaacccatctccacccaaaaaaaatacaaaaaaaaattagctgggagtggtggcatgcacctgtaatcccagctactagggaggttgaggcaggagaatcacttgaacccaggggtcagaggctccagtgagccaagatcacgccactgtactctagcctgagtgacagagtgagactccgtctctttaaaaaactggcctagtgagaatactaaactaaattataaagctacaataaaaaaaacagtatggcactgaacaagagctatatctgactctataactaatataactgaaaagatactacatcactgtggaaaggaagaattggttaataaataatgacaagatggctaaatagcaattgcaggggaaatagtttattaaaccattttttaaaaacattaaatataatgtacttatttatcaaacttcttggagaataagttcttccaagtatagaataggaaaaacaaaacaaaagttggacagattttgactcctaagataacacatttctacatgtccaaacaatgaacaatattaaaagacaaataattcatcatggaaatgtttgtagcaaatatgacaacaggttaatatatttgtaagtctcaggtagatcaataagaaaaacactaaggctctaacataactaggacaaggccaaacaagtcaatgaaaataaatatcattagtaaacagacaggaaaatattctgcttcacgaatgtttaaatggcacatgccatgaaattagcaaaaaatgtaaaatgcaattagcttatacttataacagaatagtaaaaagggacatctttatttactgctgctctaaataggtccaactcttgtaagaagcagcctaaaggaaaaattactcatgaaaccttaaaaatatccacacacttgaactcagtaacactatttttatggaagcatcctaaaaaaaaagaatccttaaaaaaaaaatcaaagttacctacaccaagatgtttacagcaattatttgtaataaaaaatttggaaataaacattcaaacaaaaaaatctgaacgatggttgctgttgaatctgcttaaccagttatcctaaaaccagtcttcatggttcccattccagtccatcctccatactgctcccagattgtgtctaaacagcaaatatattaaagcttaaaatcctgcaatggttccccccaccttaaaaaaaatgaacatcttggcaaactacagtaaggtccaaactaggttggtccctgtctagagcctcacctcttgccactcatacccaatgcattagccataaagaacacatgcagaactattcggaagtatttatagctctccagcattcattaaataaaatgccaaaaaggtcttaatccatactcacacaaggatgctggcttcatggcacttaaagcataggaacaataaacgcctaccagtgggttaggtctggtactagaagagcttcttagagtcatagaggacagttcaactcaggtcagggaaagttctagggataacagtaatctttgagttgagccttaaaagatgggcaagtattgctaggggcgagggcattcataattatactgagtcatgaataaaacattaagttctactaagtatggtctatttgaaaagaggaggacatattacgtctttaagactctcaccaaaaaaggctcaaataggccaggcatggtggctcacacctgtaatcccagcactttggaaggctgaggcaggaggatctcctgagcacagaagttcaagaccagcctgggcaacctggagaaaccccatctgtactggaaaaaaaaaaaaaaggtaaaaaaatcagccagtcacagtggcatggacctgtagtcccagccagttgggaagccaaggtgggaaaatcacctgagccgggaggtcaaggctgcagtaagccgggattgctcactgcacgctgttgccactgcactccagtgtgggcaacagaatgagattctgcctcaaaaaaaaaaaaggctaaaataaaaatcttgtatgcctaagcatgacccttcatttatctttaaaactgagttatgttaaatgagatgttagtatgttgtgatagtaatagctcaaccaacaagaaaaaagtaaaagtgatgactaaaatacacagactttattacgaataccaaactacaaaaaggaccttggcatgttctactgcctgcctgaagagggtcagactagaagacagaatttaaaagaaaaggaaggagctcaactacactggcttcctcctcagaaaccaagaaaataaaacaaattggggacattcaaatcactaacacctctagtatataaagtcattatgggccgggtgccgtggctcatgcctgtaatcccagcacactggaaggctaaggcgggcggatcacctgaggtccagagtttgagaccagcctggccaacgtggcaaaacccgtctctactaaaaatacaaaaaaaaccagccaggcgtggtggtgggcgcctgtaatcccacctactcgggaggctgaggcaggagaatcacttgaacccgggaggtggaggttgcagtgggccgagatcaagcccttcaactccagtcaagagtgaaactccaactcaaaaaataaataaataaagtcattatgatgtataggcatacttaaaaacctgtgaaatagaattaagctacaatttttaaagccttgaatcgataaaatatgtagtgaaacaagattaagacgctagcatatctaaagggaaatttttaaagttaaacttccttacattatagacaaggttaacctccttattgccaagggctttgaaattaataacatgagaagcagcatacaaaaacattaaatgtataaaaaggtctgaaacaaatgttctggaggagtaatcttattctgcttctccatacctaagaatttaaaatattagaaattacactaaactgctttttccagcctttggttttcagaaacaataatggtataaaaaattatcccaaagtttttactgtaaagaatatttttctatccaaaccattgaaagaaaagcctgtatcagatataagtataatgatatagacattatacattttgtaatcaatgttatagaaacagtagttgaagttgatagtgttaccatacagcccatttcaatgatcatatgttaatgtgtcataaagaacagaagtagcttgatggatgaaatcagattctaacccccaactgcctgaggaatctaaaatttgggatcaaattattaaattagccccaccttcttagcattgacaaataccaaacagttcactgattgtggttttaagaataatatgtggaaaggtttaatatcaattgtgggcagagatctcatggcttaaatatttcctcttcttcagagagagtgtgtatgagtgtgtgagtgtgtgtgtgtgagtgtgtgcatcaccatgtaagaaatgtttatacctttcagcaaaggggcaattccacaataaagttattatcaagtaactaaagtttatacagcatcttgaaatcaaaggtactctataaatttaaaatactaatatggtattaacttaaagcaaagaacaataattttaaaacaccttatagcccaagtgtattgtaaaccaaatataaattcactgtgggatctgtctttttttaagtgattttttttcctctattaggcaacccagatctaaatgaactgttaaacacttagtctaaaggtatgccaaacatttcttaaggtcttcacaaagaatcaactttttttttttttttttttttaaacaaaatgaggcctaggttaaatattttatttggcttctcaagatggactgagaagttgggcaccagctccagaccaattcctggacgcacatcaaacacagccctgtcatttatccagtcagtcaaaacaatcttttccatctaaccctttaatgtttatgtcctaaaaagctgctaattgaatccagctcttgagatctatttgctaaaatctataccatctaatttataaatgatgaacaaaaatggaagaaaaaatatgttaactttcctggcaaaacagaagagactccactgtaaccaaagaaggaaggacaatgtttttaatatttgtcaaattttaagagaaaactattcagagacaaatagttgtaagaaactcagagtacctcaaactgtttttactattaagaggacacagggtatttaaaattcctcagaaaaacctgaaacaaaatcactataaatgtagttcaatattcccccttcccctaaaatataagcataatctttcctcttaataaactttaattataaattcttataatgtatcataggcagtacggaaaccacagataaacactttaagatctattaagtcatactaaaaacctcaactaaccttatctgcagaaaatcaaaaacccaattttttccctcattttctctacatagcccagaggagggtaaatggaaacagcctatttctgatgctttctgcacacctgggatcacatgttctttccacgatcactgactacagacagcaacagcaacagataaactctaaagcaacaaagatcccctataaaggtttccactgactcctcccaatgtaaggacactgaatgaggggggagggggtggaatacaagtatcctccaatccaggttttccattaagaatcactcagttaatgattccctgcaattttccctagggaaaggaaaactgccatgaaagtaatatattatttaaattgcagccaacatacattcaagctaaattctcaaataccaaattcactgcaagttttcatccagcaagttcagccagtggactgggatgtgacacacaggcatttaactacaaaattagtccaaataaatctcaaagtctagtgtgggcaaacataattacagtttatccgtacacgtgcacgcacacacaaatcctctacggaaaattatctttctcaccactcacccgaatacaaacgtggacaatttatcaggggtaaatggtgaaggtaggataacgccgtgattccaattcctttacaaaccaaataaaagttctcctaaaacgggggtggcatgtccatgtaagaataccaaaaatggcactgtaagcaaaacgtacctgtaatgttaaagatttcatgcacctggaatcataaacactttgtaagtgtagtcttctatctggcaacccctccggacattcttttccatttcgaaaaaggaatggggagggtggggagagtaacagaaagtttgctcgaaagtttgtatgagcacatacttagcaatgcaccccccccaaaaaagtgtgtttttaaagcaggtctggcgttagaagttagacacaagttctgcggcctaaaaggaacaaccccaaacatgccaccctacaatcagacacttccaaaacacagtgtacaatgagcccaagccgtcggatcagacaggcacaccggaaaagtcaacctgtctcctcacctcagagacatgagtttaaggtgtgtggcccgggcagcggtggccggcggcggggagtaaaggtttttcatgcgggcataactgggtgtgtgcaaggtaacaacccgggaacacacacgcacaccctcccgttaagcgctccatctttaaggagtgtttactgcgcgcagtcagcaaccggattcaataatcctcgccacgggagctcttcatccccttcacgatctcacctgggcggtagcccaggggctgttccccgagccccgggaggcagcgtctggctccttgaccaagactttccgacctgaaatccgcctgcgatgcgaaccggtgtattctcccctccacaaaacaccaccccccgccccgagtcatcctcggctttttaaacaatgtccaaaccagagcaagtggttttccaattactctccctgaactaggccttcccattcctccgacccccaactcatcattgatcgcgaccctggcccttcccaaggccacaggcaccccccgccagctcgcccaccccgcggctgcccagcccggcccgccgccccccctcacctgtcaggcgcagcttgacgggcccgttcctccggcctccggggttagacatgtccccggcggcgggggcggcgggggcggcgggcggcacgggggcgacggcgaggcgcggcggagtcaccacagcggccggggctggggcccgagcagccggcgcctcggccgccacggccggagggtcccggatgtgccgagagtcgtcgccatgagccgcggagggagcgggacgccgagctcccccctcctcccacttctccttcctcggcccgggccgcacaacaaagcggcagccgcggccgcccgcgccgcctccgcccgcgcccccgccgcctcctcgcggccgccgaggcctttccctcctctcgtctcggcgaggcccagtagccgacggggctggtcggctgaagcgggcggtgctcgggggcgccggagcagaactc

SEQ ID NO: 2774 - DNA, 46670 bp, Homo sapiens
  source 1..46670: mol_type = genomic DNA
gagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcggtaagtgtctgctttttcccgccccagactacggagggggagcgaggggcagccccagcgctgctcaggaggcgagagactccgggggaagtcggcctccgtggccaccggccatcgttaccgagactgagtttctgtggctctttatctcgtcttccatgagaagttttattaaagatgcgctgtgccccttttgagttgtcttccgatttacctgagccaaataagatgtaggcagttgcaggcctgagtcttcgttttgctttcctgagcaagaatttagatgaagctacttccccgaaaatccttttacttgtacgagacttttatttttcctatgtgtttgtagtgcttaacacaatgtcctgcgtgtagtagacgttcaataaacgaatatggaatatcagttgaatgccaatgatgatttaagatagactgatagctctctctgtaccatttgacgctgctgaccatccatttcttgaaactttcccctgctgcctttcttcatgctatcctcacctgattctttcacatgcttaatttaacaaaatatatacttgttcttggctacaaggatacagaaatgaataacactaactctgccattgagaagctaacgcacataaatacacattatatcaagatgggtaatgagaaacactagttgcatataaagagctgtagaaagctgtgggagagctaaagtgctccttaggtgctttgtgaccctgagccagtttctattccaatctagcctcaatttcctcatctacttaataggcttgttttgaggaagaaaggagattaggtaagaggtttggtttggtttagtgcctagaatacagcaatcgtggtgccaaaggggagggaaatatttccctcaaatcgctttttctcagttttttgatatggccaactggtattttctaccttaatatagagtactatgcaaaagcatcttcaagtcttccttccagattactcctctgtccccatctatttggaaattctggacctgccacaggattacagtaagataaccataaatgtagctttttaaaaattgattttctcctatgtgccatggagaaagggaaagggaattagtaaaagctcctatctctttggttattttcagtcttggttaacgccgtccttttagttggccctcagtcattgctataacccaaatggtcttccacaggctctcctcgaggcttctcgcttgcttccatggcattgtccctatatgccaaccatgtccaaaccttattcttttcatttccaaaccttgttcttttccaaaccttatttgctctgtcgcccagactggagtaccgaggcaccatctcggctcactgcaacctccgcctcccaggttcaagcaattctcctgcctcagccttccgagtagctgggattacaggtgcctgccaccacgcccagctaatttttgtgtttttagtagagatggggttccaccatgttggccaggttggtcttgaactcctgacctgaagtgatccgcctgcttcggcctcccaaagtgctgggattacaggtgtgagccaccatgccctgcctaaaccttattctttagcctccatctcatgagttgatagttctgtactttcccctaaaacttgcaaactcattaggtccaaaaccaaatgcactgtcttcaccttccttttttttttttttttcactatgacatatgtcatgcatacgaaagtgtataaaagcagtgattgtcagtgcgtttttgagttttgacctctggttgaattttgtgatacaagtaggttaaatttttaaaaggattataagggctgtgagcaatggctcacgcctgtaatcccaatactttgggaggctgaggctggcagattgctttagctcaagagttcgagaccagcttgggtaacatggcgaaactccctgtctcaacaaaagagacaaaaattagccaggcttagtggcgccgcctgtagtcccagctagttggagggataatgaaatgaacatctatgtacacatccttcataaaaagtgaaacattaaaaataatacattaagtccctttgacctcttctctattaactcctctgactttcaaaccaccttccctttttgccttccattcattggttaatggcatcactagccatctggttataaaaactagagatattggaatcatttttgcctcttttttccttcacttgccataaccatttggtcattagattctgcttcatgaattagcccttaaccctagtttctttttctctagttcaaggccacatcttgtctcaactagccttatggagtatgggtagtgcatgtagtgtcctggctcttcagttttttccctccaatgtatttgttacactgtatctaaagatgtttctaaggtatagaacagatttctcattctgttgttttctttgggacatgttattaaatacttaatatagtgattatgaacccttgctgcacatcaatatagctagtgaaagttttcaaaacataaatgtcttgttttgcactccagattaagaatttagatgaagctactccccctaaaacttttttaccttactatctctggagagtctgattgagcatttaatttttactgataggcattatctaaatgtcattgaaataacgcattgcttgagcatatgcctcttatccctccttttccttttttatttttcacttttcctttttcttttcaatgttaaggccaactttccaaggaattcttttgattttcgttttaattttcttcttggtagcattttatgtaaagattctttttatggttgacctcatagccagaaagtatcgtaaagaaatgattcccagtgttcctgagttattacctcttgttgctaattgactttttttttggtataccttttttgctgcaaaagtacgaattggtgctgtgatattattttacataaaatgagttttaaaatttgaaaaacaattactttaatgaagagaaagttgcttgatacttcttgatataattgaatataatctttggtgctaagttaagacagaggtggtatgatgcataatttatcttttgaagggagtcttgtgttaaactgttatatttgattaggaattagaacttctctcatgctgggacaatttctggagtacatagtaggtgtttaatgaatgagtaaatgaatacaagtggcagctccatcccaacctctagtctgttgactagttgcactctaattctcacaaggaacgctttggaaaataattttcccttgacttaaaaaatagtgttctcagtcattactaaaaaattggaaattagaaaaagatataagaaaataaaaattgctggtcgtggtggctcacgcctgtaatcccagcactttgggaggctgaggcgggtggatcatgatgtcaggagttcaagaccagcctggccaagatagtgaaaacccatctctactacaaatataaaaaattagctgggtgtggtggcaggcacctgtaatcccagctacttgggaggccaaggcaggagaatcgcttgaactcggagggcagaggttgcagtgagccgagattgtgccactgcactccagtgggcacagagtgagactctgtctcaaaaaaaaaaaattgctagttattcatcatccagagataacaaatgttattttaacagtttattaaaatataattcttggctgggtgcggtggcttaagcctgtcccaacactttgggaggccaaggcaggcagatcacaaggtcaggagatccagagcatcctggctaacaaggtgaaaccccatctctactaaaaatacaaaaaattagccgagcatggtggcactccatgtagtcccagctacacgggaggctgaggcaggagaatcgcttgaatccagaaggcagatattgcagtgagccgagatcttgccactgcactctagcctgggtgacagagagacactacatctgaaaaaaaaaaaaaaaaatatatatatatatgtgtgtgtgtgtgtgtatatatatatacacacacacacacacataattcttagttcacctaaagtgtacaattgaaaggattatagtgtatttacaaagttacgcaactatcaccataatcaattttcgtacatttttattatcccatgaagaaaccccatacctattagcaatcattccctattttactccatctcctgagccctaagcaactattaatccactttctgtctctgtagatttatgtattctgaacaattcatgtggaaccataatatgtgatcttttgtgactgggttttttcacttatgtttcgaagattaatccatgttgtggcatatgttcagtacttcatttctttttattgcctagtgatatacctttgtattttattctacattttacttatccgttcataagttgaaggatatttgggttgtttctactttttggctattatgaataatgctgctctgaccattcatgtacaagtatttggatgatatcttattaagattttgatttacaattccctgatggctaatattttttaatacttgtttttagactgtgtttaacaaaatatggattatactacatatgcagttttgtagtctgccttttgcatttaagcctgtttttagcattagcaagcatattttacaaaagaattttcctaatttttgctcccctctttactccccgccaaaaccataaattcttgggaaaccttgcttaaattaatatacctagaaaatacaatccatattaatatataccagattattattggttgttaccatggtatgggagtgggtagaattaggggaattatattttctaccttaaatatttctgtaatgttttaacttttacagtgaagatacatcattttgtaatcacagaacataaaggtgaattatttccttggggaataagtagattcagcatgaaaaacagttcctaaatttgaaagtcataattaacattgtaaaattagtcattaaaatatatttcactaagctgggtgcggtggttcacgcctgtaatcctagcactttgggaggctgaggtgggtggatcacgaggtcaagaggtcgagaccatcctggccaacatggtgaaaccccgtctctactaaaaatacaaaaattaggtgggtgtggtggcatgcgcctgtagtcccagctactcagaaagctgaggcaggagaatctcttgaacccaggaggtggaggttgcagtgagctgagatcacaccactgcactccagcctggcgacagagtgagactccatctcaaaaaaaaaaaaaaaaaaatatatatatatatataacatatatatatataatgtatatattttactaaatacaatacctataggccattttgttaactaaatttacttttctgtggtcctagactgtgaacacatatgctgtgcagaattaagaaaaatatttagtattaaagtcagaaaagcaaatactggttattagcctttgactgctttatagaaaagtatacagttgtctcttgctatctgggggggattgattccaggaccaaaatcagaggatgctcaagtccctgatgtaaaatggtgtagtatttgcatatgacctatgcacatccttccatgtactttaaagcatctctagatcaatacctaatacaaaatgtaaatagttgttataccatatttatatccttaagaaaatacttgttatactgtattgtttagggaataatgacaagaaaagtctgtacatgttcactagagacacaattttttttctgaatgttttgatttgtagttggttgaatccatggttgtgaagccccagatacagaaggctgactgtactatgtagaagtaatttttctaagtatatttagttcttgaggctaatattgattcaaaaagtcattgacaaggacttagaagaaaggacttttggccaggtgcagtggctcatgcctgtctataatccgagcactttgggaggccacggtgggtggatcacctgaggtcaggagttcaagaccagcctgaccaacatggtgaaaccctgtctctactaaaaatacaaaaaattacctgggcgtggtggtgggcacctgtaatcctagctgctcgggaggttgcagtgagctgagattgccccattgcactccagcctgggcaacaagagcaaaactctgtctcaaaaaaaaaaagaacttttttgtagggattatgttgtaataggatttgacatagctaatcattagactctgtttatataatctcagatcaggcaaatctggcaggaatatttataattgtttatgtagagaaaggtgggtttttggacactgcagcttctgttgaataataatctggcagttgtaattgccactaaattttaaagattccaggagtggttcctgaatgatgggacagacacttctgtaagattgttcagaaaatttccagcttacttacactccatataatacagagagagatagttggtatcattaaaaaaagaaaggaagttaatagttaatatgctaggtttttgaagacagctttatatgtattgtctcatttaatcctcacaacagcccttcagggtaactaccttggtaatggtatcttcattttgcaagtgaggaaagtgaggctcagagagattaagtaacttgcccaaagtaacacagccagtatgtaacagagctaggatttgaatctaagtctgtcagactccaaaatctatgctctttccagtacttcacactgcagcaagtaagtgtgatacttggccctgtgattgccttacttagggcacccaaaacttcagcctgtttctattgcttactatccaaatcctagtcagaccccagttagaagaccctgtgactcgagccaggatcagtccttgtatgtactggtctgattgcagtgatagttatcatttctttctgaacgttgcaattactcctccacaaagaggaatatacatctttaaatatgattaaaatgtgatttcttctattatagcatagcagcaaaatttgtccttgcagtttccagcaggtgtattcaaccctataatttaaagcttcattcatactctagccaaaggactatgggaagtcattttgcttttttttggcagggaacggctgttctattccctatcctgcttatatcataaaattgttgtaagagtgaaatgagataatagatgttcaactgtaagaaagtactgtgtggtaatctcttacctttctaaaagccccatctaagtagagattcttcctttgtgaaattctagcatatacagatttatttctataaatcgttttagttaggcaagagaatcttgagagtgtacttgaattgtagattactccaacctgagatttaggcttagctattaacatacaaaaggtatttttcactttagtgtacatattagaacaaggtgaggttaatttttaagtatcttgttggaaatgcatggcagggaaattctgaagaagaattataagtaatgacaaataaatatatttaatgtacagtacaaattacccaagttattgtttttcttttgattcatcatattatcttcattgatttattttagtggcttttaaagatatttgcagtgcctttcatgactttagttctctggtctcgctttttccctaaggccttaaatacatcatttcattcattcataatgttcatttttattaaggatttactgtataaggctgaggatagataaagcagtgagctcacaggagaaagcaaaagaggcaaaaatccctgcccttgtgcaggttaaatttcttttcttttttttttttttttttttgttgttgttgttgttgttgagatggagttttgctctttcacccaggctggagtgcagtggcacgatctgggctcactgtaacctccacctcctgggttcaagcgattctcatgcctcagccttctgagtacctgggattacaggcatctgccaccgcgcctggctaatttttgtattttcagtagagatggggtttcaccatgttggccaggctggtctcgaactcctgacctcaggcaatccactcacctcggcctcccaaagtgctgggattacaggcatgagccaccacacctggccacagcttacatttcaatagtgagattataggtgacaaataatataaataagccatatgtcagttgataatagaacaataggaaaaaataaagggaagagggttgcagttttaaataagtgattagggaagacctcattgagaaatggcatctggacaaatctgaaggaaatgagggagggagttatgttgtcaagcagaggaagagcatgctggctagtaccgagacactgaggtggaaatgtgtagcagcaatagcaaggaggtcagtatgattaaaatcagtcatgcgtgtgtgttgggggtggggggtggagggggccttacagtccattctgaggactttacatctgtgtgcaatggaagtcattgagattttaagcaaaattctaacacggagttttcaggaacacatcatccttggacattgtagaggaaacactgtaagttaaaggtattattagatgttcttactcctctactgaaatgcaggattttattttgtttttgtgttttgtgttttaagacggagttttgctcttgtcatccaggctggagtgcagtggcaccatctcggctcactgcaacctccgcctcctggttcaagcaattctcctgcctcagtctccagagtagctgggattacaggcatctgccaccaagcctggctaatttttgtgtttttagtagagatggggtttcgccatgttgaccaggctggccttgaactcctgacttcaggtgatccacccgccttggcctcccaaagtgctgggattacaggcgtgagccactgggcccggacagattttgttattttatatattaaaactatatgtattcatgtattatataataaaatatattttttaaatttaaggcaaaaatgttttaaaatacacactgccagtaactacttgcagaaggaaaagtatattggaaaacctcacagaagtttttaaaatttttaaatttaaaacaaccagttaacatggaaagttagatttatatttaagaatttactaggcagccataaaaagaatgaaatcatgtcctttgcagcaacatggatggagcaggaggccattatcctaagagaactaattcagaaacagaaaatcaagtatctcatgttctcacttataagtgagagctaaacataggtacccatggacataaagacgaaagtagtagacacagaccattccaaaatggaagagtttgggagaagactgaggattgaaaaagtacctcttgggttcaaggttcaatatttgggtcatgtgtgtataagtccagtccccaccattacacagtataccagtgtaacaaacatacacatgtaccctctgaatctaaaataaattaattaaaaaaattaaagacacttcctaaagtttgcccccccaaaaagttaactagtatggcttatttatttatttatttatttatttatttggagatggagtctcactccatctcatcacagtgatgtgatctcggctcattgcaacctccacctcctgggttcaagtgattctcctgcctcacactcctgagtagctgggactaccggagtgcaccaccatacccggccaagttttgtatattttgtagagatggggtttcaccatgttggctagactggtcttgaactcccaacctcaagcaatctgcctgccttggcctcccagagtgctgggattataggcgtaaaccaccatgcctggcttagtatagctttttaaaatgaaagatgatctgtttatgacatgacctctaaaaaagttaattgtggtgtcataaataggattctatcactcccagtaccaccatggtgaaggatataaactgaaacatctgaatcttatttcttaaatgaagaatattaatttaaggatcaataattattttgtataatgggtatggcataagaaataaaaagtcctggatcttttccatgaggtggttggctctcaggttaagtaacaatgtaattgtaaaaaaatcttatggtaagcaatttttttttcaatttcatcaagtattggtagtaagttttttttaagttctaaattaccaaattgtacttgagtgaaagtgtagtgtttaatttgtagctcagcctgggatatctgtttgccagtgataggtcctcaaatgcattttcccttcctgcctttttatgattcctctcacctctttactttctctatggtgaatgagtcagctatttcatcttcctgtttgtcttaaaattaattaattaatttatttatttattgagatggagtttcactcttgttgcccaggctggagtgcaatggcatgatctccagctcaccgcaatctccacctcccgggttcaagcgattcacctgtctcagcctcccaagtagctggcattacaggcatgtgccaccatacctggctaattttgtatttttagtagagacggggtttctccattttggtcagggtggtctcgaactcccaacctcaggtgatccgcctgcctcggcctcccaaagtgctgagattacaggcatgagccaccgcacctggcccaaaatttattttttttaatacggactttctctcttgttgcccaggctgagtgcagtggcgcgatctcagctcactgtaacctctgcctcccatcttcaagcgattctcctgcctcagccttctgagtagctggaattaaaggtgcctgccaccatgcccagctaattttttttttgtatttttagtagagatagggttttgccatgttggccaggctggtctcgaactcctgacctcagatgatccacccacctcggcctcccaaagtgctgggattacaggcgtgagccaccacgcctggtgctgtttctcttatttttaatctcctgtgtattctgtagaagggatctagtctggataatcttggttgactaaattagactacattagtttggaagggttaccaaaacagttgttttgaagagttaccttttctgctaatattgttcatattggaaaattgatattccccagaccgtgtttttagagccctttgaaatctctgtttccttctaactgtatacacctctgtcctaagcagaatgttttgtttcctgtcccctaaataatgctcagtgatccataagtacagtgcatatataaggcataagtatgtcccagacttacctctctctccatttctgcttatgctatttcatcttcctcaaattcccttttgtcttctccacttactcaaattctactcttatttcaggaccaaattcatactcagtctttccaataaagcctatactctctgccttagtctaaaattcttccttttctgttttctttttttgtggagacagagtctcactctgtcacccaggctggatggagtgcagtggtgtgatcatgacctccttggctcaagcaatcctcccctcaccctcccgagtagctgggactacaggcacatgccgccatgcctggctactttttttttttttttttttttttttttaagagttgaagtcctgcctgctatgttgcccaggctggtttccaactcctgagcccaagtgatcctccttccttggcctcccaaagtgctgggattacagacatgagccactgtacctggccttttttttcctttttttttttttcttgttccagagaagcagaatcaataaagggtgtgtgtgtgtgtgtgtgtgtgtgtgtgtgtgtgtgtgtgtgtgtgtgtgtgtagagagagagagggagaaatggatataaagatatgtatttattataaggaattggctcaggccgttatggagacttaagtttcaagatctgtaggatgagttggcaagctggagacccaggagagcccatggtgtagatccagtctgaatctgaaggcctgagaactcagagagccattgatgtagttttaatccaaaggcttgagacccacaaagaaccagtgtttcagtttgaaggcaagaaaagctgatgtccctgttagcagtcagacaggaggaattctctcttagtgtttattttagtgttcatttgtgtgccttgtcttaccagctagtaggtaagcatcttgagggcagggactacaaatcatatttgcttgtttatcatccataagcccttgcatccttacaagtagtaagtacatctaatatgtaatacttttataaaacagtaagattttagagctggaaagggtttttgactcttagttaactgaaacagaaagtctgttgcatgtgactattttttggaagaaccaggatcagaattttattttcggttcctcatcaagggctttttctaataattcttattaataataaatgataacttaaatcattatcctattttagagttttcctggaatcagaaacaggtttaaaatgggaagagaaccagccttggcaacataacatagtgagaccccgtctctacagataataaaaattagctgggcatggtggcatgcacctgtggtcccagctacttggggggctaaggcaggaggatttcctgcgcccaggaagttgaggctgcagtcagctgtgatcacaccactgcactccagcttgggtgacagagtgagaccctgtctcaaaaaaaaaaaaaaaagagtaaaataatatacctctttcctttgtggttagaagaataaaatgaaataatgtatgtggaatcacttagtatagcgcttcgatatagctgatagctgaacagttgctttttttgtactagaaaagttattaaaaccttttttcttttttttgcttaggagcaagaatcaaaatagtttgcagagtcctttaatgtgggaaattaggcagtattcctggagatttcacctttttctcctcttttaatttaaaaatgtgcatgatacataattcagttattcataagtattgtgccaaaaaaagaacatatttaatgtgagattatgtcattatttcctcaaagtatggtatttgacatgttaaatttgctgattcatatacaagattccaattaagtattcaaatataaggcatcataaccaagtagcagttttatctttatgacatgactgtatttaagcacaggttgaggctatggaaggtgatcttacagtatctaaacactagagtaatttgaacttaaatactctttagaactcttcagtcatgggaagtgaaattgattattctcacttaattttttttctgctgtagagttcttcgtaagtacatcttaaagctgtcaagatggttctagcagaccttggaagaaaaataacatcagcattacgctcgttgagcaatgccaccattatcaatgaagaggtatgtaaaatattgtatgaaatatatatgattgtatattgtcactagcattgggaagatggcttattcataatccctgtatttatatgtattttgatgtagacttaatacttgtagataaaagcctaaaagtggatacagtaagtagtgttttattgagaaattaactacaacttcaaatttacttcaactttctataaagaattttccaaaaaaaaatcgaaaaaaacctgaccttaacttacatgtaaaaataacatattttatcttttgaaagtggcttaaatctggaactgtacttttgttttctttattgatatagacctaaaatttcattactctgcttctttcttcttggctaggcctgtgcttatctgtccttttctttgtgacttttatttagcatttttataaaaggctagcatttccatcttgtctgttttgattcattttctttgaaatcttcagttttttggagattttgtaagccactccttagatgatattaaaatacttttcttcccggctatattattttaagatatttctttgttccatttgtcccccacagattgtatcttagtggtttattaattgaaaaagttgactgtggttcacaagtatactttatattttgtatcaacaatggaaaagtactgaatttggtgttagaagacattggttagtcccactgtagctatttagcagctgtacgatgtaaattggggcaactaaaccttagattccttagtgtataaaataggaaaaatagcatttaccatagaaaatggttttaagtttcaaataaactttctaacttggaggttagaaaacttacgtagaattcttacatggaatttgatctcaatactaagctaacggaattaaataattttgagaccatcttagagatcatttagttcagcctcttatttaacagaaccaaagtcagtttcatgtgattatttatttggaagaaccaggattagaacctttttttcctagttcctcatacagggctttttctaatactgcttattaaaaaataaatcataacttaaatcattgtttggtcttgtaattccaaatatataaaacgactttccaaacagttttccctgttgtgtagcccttatgttctttgtgtttatagtagaaaggaaaggaaaccaggggaggagttcttggtgggaggtagagtaacagctgttgcttaaattggcagcttctctgttcttgatactgtgctgctagctaattaacaaggagaaagccctctagtgaaagatcagttcgaattttagcagacccgtttaatgagggatagagaaaactggtaagcctctctctgtagggcatatgaagtgagttgaaggagagagaacattcaagaaatatttgagggcctatgtttttgcagacatttttgctggcaccagagatacagcggtgaacaaaatagactaaaattcctaacctcatagagtttacattctagtgtgtgagcactttatatacatgagtggctaaagcctcatcttttcttaagacttttaattttatgaccttttaactacagtgccttgcaattcaacaaacatatgatgataataagttattaatggagagtagcctcctttccacctgtattctgctgctctaataaaaatgacaagactgggtaacttccttctgtcacatttacttccataattgtccagtttttaagaaaagcaatattaagccgggtgtggtagctcacacctgtaatcccagcactctgggaggctgaggcgggcggatcacctgaggtcaggagtttgagaccagcctggccaacatagtgaaactccatctctactaacaatacaaaaaattagctgggcgtggtggcaggcgcctgtaatcccagctactagggaggctgagacaggagaatctcttgaatctgggaggcggaggttgcagtgagccgagatcacgccattgcactccagcctgggcaacaagagcgaaactctgaaactctgttccaaaaaaaaaaaagaaaagcaaatattgtaactatataccactacataatagtgacaggagctcttcaataaagtagaaaacatcaaaggcaacatctatttgtagtaactttttttggcttgaatattgtctttattattactttgtgtgtatgtgtgtgtgtgtgtgtgtgtgtgtgtgtgtgtgtgtgtggttttttttttttttttttgagacaaagtctcactctgtcacccaggctggagtgcagtggcactatcttggctcactgcagcctccgcctcccgagttcaagtgattctcctgcctcagcctcctgagtagctgggatcacaggcacgtgccaccatgcccagctcatttttgtatttttagtagagatgaggtttcgccatgttggccaggctgttcttgaactcctgacctcaagtggtctgcccacctcggcctcccaaagtgttgggattacaggcgtgagccaccatgccgggcctataattacttttatataggaataaaattgtggcaattaatacttgggtgtaaaactaaatggggtctcttattttgacaaaatgactaaacatttaataaaattatctctccaagaactaactgaaaaacccagtagtgtggtattactaagctgtggttatgtaagtgatcaacaattgtttttatggaactgaaatgaaacattgggtgctttaaatttcatttatttctttattttcaggtattgaatgctatgctaaaagaagtctgtaccgctttgttggaagcagatgttaatattaaactagtgaagcaactaagagaaaatgttaagtaagttaaatcaatcaggtaaaacacaggcacagtttagtttagtttactggaaagaggtgctaactggaagtgtttgctgtatcaggaatcatttctgctctgcaccactggaaaagtgctgtgttggagctcatatgttgggcgagagcatgtgtagtacgtttccataatgatggttcaaagaataaactacatgtgattttcatttaattacatatttttttctattttactagtcttttatttgaatggatttgattaaatactgtatagtattttaatatataaagccttttaacaattcaggctcttcatagaaaagtactgccattttattctttttaggcttaagatgatcttaatcaaccttcattattggaggactgtattctcttttgttctccttttggtttctctgtttcatatttgaatgaagaattaatgtgtttggtctcagttatcatattcattgggagaggcactgagttggtaggacacacagagcaatacaggtagctcagttaactgcttgagtcttatctcttaccatgctttagacatctctccttgtattgttagactgagattagttgtgggactaccagcatttaagcatttagacatagaggaagtagccgggcgcagtagctcacgcctgtaatcccagcactttgggaggctgaggtgggtggatcacgaggtcaggagatcgagaccagcctggccaacatggtgaaaccctgtttctactaaaaatacaaaaaattagccgggcatggtggcacacgcctgtaatcccagctactcaggaggctgaggcaggagaattgcttgagcctgggagacagaggttgcagtgagccgagatcatgccactgcactccatcctggctgatagtgagactgtctcaaaaaaaaaaaaagaaaaaagaaagaaaagaaatagagaaagtagtcctgatttctgttgtaaagatatataaaatatataagctgcaagaaaagtaaataaaactagttctttgtggtaatattaggacaaatttatatttatactttcaagtgtaatccttgaaaaccaaagtcttgcatctaatacttcatgggaaaactctttatgatatagacttacgagtctgtagtaattacatgcatgttaattggaagactattaatatgaatgactgaatgttgtacattctttggagcagaagcttctttttcttagagtttcttaactgattttctcctccccaccccaatcaccaaccaccatcataaaggtctgctattgatcttgaagagatggcatctggtcttaacaaaagaaaaatgattcagcatgctgtatttaaagaacttgtgaaggtaaaagtatatgaagattatgctgtgattctatactcagtggataaaaaagcgttagcactacaaatatttcagaatttttaaatatgttttttatggaatattcatctgtattaaaatattaatgaaaggattattgagttttcttagggacctttttttttttttttttgagaaggagtttcactcttgttgcccaggctggagtgcaacctccgcctcccgggttcaagcaattctcctgcctcagcctcccgagtagctgggattacagacgtgcaccaccatgcccggctaattctgtatttttagtagagacggggtttctctatgtgggtcaggctggtcttgaactcctgacctcaggcgatccgcccgcttcggcctcccaaagtgctgggattataggtgtgaaccactgcacctggccaggacctatttttattgtagactttactgaatatacataattctgagtgcagatatgaaagctagtactattcctgcaaaaaatgccaaagccaagatgcgatgagtgaaatttcactacagatttgttgatggaagggcctaagtttttcctcgttcactatcatgttttgcctagtgatggtcctgcttttgtatggcaaagtcacatatagcaagtattcttttctacactgttcgttgtgtaaggaattccctttgcaaagaccatgtatcccaattcttgcctagattatgagcaattttgaattagtgaaagttttattttcaaatagtaaatatagccagttgccctgcctcaccttattgctgatcatgcaaattatggtgaaaatcttagagcttaaaaaatatatatgggctcagttgtagaaaaaaaaagaaaggagctgttaaaaaaattattttagtccaggcatggtggctcatgcctgtaatcacagtgctttgggaggcggaggtgggaggattgcttgaggccaggagtttgagaccaaccagggcaacatagtgagaaccagtctctataaaaaaaaaaaaaattgataaaaatagctggtgcaggccgggtgcagtggctcacatctgtaatcccagcactgtgggaggctgagatgggtaaccacctgaggtcaggcgttcgagaccagcctggccaacatggtgtaaccccatctctgctaaaaatacaaaaattagccgggcatggtggtgcacatctgtagttccagctactccggagggtgaggcaggagtattgcttgagcccaggagttcgggggtgcagtgagccgtgattgtgccactgcactcccgactgggggagagggtgagaccctgtctttaaaaaaaaacaaacaaaaaaaattttttagagcattagatgcccactagttctacaatcatttttcccccacattgtttgaatattttctttttttttttttgactctccctctgtcactcaggctgaagtgcaatggcatgatctctgctcactgcaacctctgcctgccaggttcaagcaattctcctgcctcagcctcccaagtagctgggattacaggtgtgtgccaccacgcccagctaatttttttttgtatttttagttgagatggggtttcaccatgttggccaggatggtctctatctcttgacctagtgatctgcctgccttagcctcccaaagtgctgggactacaaccatgagtcactgtgcctggcctccttttttttttttttttttttttttaagagacagtctgactctgttacccaggctggagtgtagtggtgcaatcatggctcactgtagcctcaacctcctgggctcaaacaatcctcctgcctcagtgccccccaagtagctggggctacaggtacatgccaccacgcccagctagtttttgcattttttgtagagacaaggttttgccatgttgccctagctggtcttgaactcctgacctcaagtgatccacctgccttggcctcccaaagtgttaggattacacatgtcagccactttgcctggccagaaatttttattgttaggggctcgtaactgtaggcaattctggagcatcaagtgctttattaagaagcatttattgagtacctactttatttcaggaagtatgccaaatgctgctgatagcagaaataaatgagactggttcttatactcagatgcttatggtctagaggaatggtgtacaaagcaaggtcaaaattattttcataatactaagacattatttgacttttgtactatgttgacatttgcactgaaaacaatggtaggtaaaactccctggtatgaatcaaggcagtggcaccagatgatactagtagtttctggactctctatttatttatttatttttgaagacagagtccctgtcattcaaactagagtgcagtggcgtgatcagagctcactgcggcctcaaattcctgggctcgagcgatcttctctcctcagcctccagagaagctaggactacaggcatgcaccaccatgttttttgtttgtttgttttttgtttttttggtttttttggttttttttttttttgagacagggtcttactctgttgcccaggctggagtgcagtggtgtgatcatggcttgctgcagcctcatcctccctgggctcaggtgatccctacacctgagcctcctagtagctgggactactactctttgagcccaggagtttgagaccagcctgagcaacatggtgaaaccccatcactacaaaaaatacaaaaattagctgggaacgatggcttacacctgtaaaccgagttactcgggagggtaaggtgggagaatcgcttgaatccgggaggtggaggttgcagtgagccgagaccacgccactgcactccagcctgggtgacagagcgagacctgtctcaaaataaataaataaataaataaataaagcttccaggcatggtggcgcatgcctgtaatcccagtactttggcaggccaaggcaggtggatcacctgaggtcaggagtttgagaccagcctgaccaacatggtgaaactccgtctctactaaataaaaaaaaaaaaaattagccatgtctagtggcacatgcctgtaatcccagctacttgggaggctgaggcaggagaatggcttgaacctgggaggcagaggttgcagtgagctgagatgacaccattgcacccagcctaggccacgagagcgaaactccatctaaaataaaaataaaaaggacttgtatctatcatctgtctctatcatgagtttgacagtatcccagtacttagttttctgatgagggtcagtattgatattaatgaataaagttttttgattatgtatagtgaaatatgtcaatgacgagagatctgcctaactcagtgaaccaatgttttgtgaatagctagtgcgtgatgttacaagatcatttaccagtataagattcatttaaaatgcaagatggaatcacagattttaatgtaacgagtataaaagtttatatggtttcagattctacattgcagctaacctttacaaactaccatgattataaagaagccctgagaccaagaagttgaaaactgctgttcttgatggtgggaggaagagaagacaaatttataaaattatttactaaaacatatatgttccaaataatgggtccatagagagctgggagtttttgccatgacatgtagaaaatggagatgaatgtggagcagcatcagtgtactgaaaggatctatgaggaagggaagtggatttatgtttaagacagattttgcctatttcaaaagtttgcctaagggtaggttgatgcctaggaaaggtataagaaaatgtattttcctctcttctctacctcatggctttccttgaaattcaagtataatatagatgatgtaatttttatggatggcttggcagactttctctcaaaggtttagactttgtggaccacgtgatttctattgcaactactcagctctgctgttgtggcacaaaagcagtaaatgggtcaggcacagtggcttatacctgtaatctcagcacttcaggaggccaaggctggaggattacttgaggccaagagttcaaaaccagtctgggcaacatagcaatactccatctctacaaacaaatactaaagttagccagacatcatggcatatgcctgtagttccagctactcaggaggctgagatggtaggatcgcttgagtccaagagttcgagactgcagtaagccatgattgattgtaccagtgcattctagcctgggtaacagagtaagaccctgtctcaaaaaaacaaaaaaagtggtaaatgaatgggcatgactgtattagattgaaatttttttcaatgtaataactagaaatgtaataactttacagcctgttgcccaggccggagtacagtggcctgatgatagctcattgcagtctcaaactcctgggctcaagcaatcttactgcctcagcctccttgattagctgggaccacaggtgcgtgccaccacacctggccaattctttaaattagtagagacaagatcttgctatgctgcccaagctggtctcaaactcctggtctcaatgaatcctcctcctttgtccccccgctgaaagggccgggattataggcatgagccaccacacccagcctccattgaaactttatttgcacatagtttaccaacccctgatctaggacattaactattatagatttattattttatcatacatttcaagctccaaacaactgacccccaagtgaattattttttaaatgtcccatgcttttttttgtttttgtttttgagatggagtctcgctctgtcacccaggctggagtgcggtggcgcgatctcggctcactgcaagctccgccacccgggttcatgccattctcctgcctcagccttcagagtagctgggactacaggcgcctgccaccacgcccggctaattttttgtatttttagcagagatggggtttcaccgtgttagccaggatggtctcaatctcctgaccttgtgatccacctgcctctgcctcccaaagtgctgggattacaggcatgagccaccgcgcccggccctaaatgtcccatgcttttttaatttggagactgtccctatatgaacctcagttttccactgactgattttaaagttgattattattttttactagccctctaaatgtagtaactttacagtaaatatttggcattggagaatttacagtttgacctggaaaatctttcacatataatctgtaattttgttaagtaaatatttgtcaaattgaatatggacattagcactctcgagtatggcatccactagccacatgtggttattgagcatttgtaatgtggctagtccaaactgagatgtgttttacatataaaatacacaccaggttttcagacttggtatgggaaaagaaatgtaaaatatctcattaattttttatatagattacatatgaaaatgataattttttagatgtattggggtagatactaaaattagtatcacctgtttttactttttaaatgtcagtactggaaattttaaaattcatgtgtagccttcatatacatttttgtattacatttctgtagtgctgatgtagattcctcctgtggcttaaatttggtttcacattttatactccagcttgttctaaaaaatgctgtgagatctttacctctgaattggtttggagtatagacttgattatgacttcttaaatttatgttcttaaattttactctgtctttacaaaggggaataattgtattataatagcttatggtagcttttacatgaaaatgtccttatttatataatttaaaagttgtggcagcacagtggctcacgcctgaaatcccagcactttgaggctgagacagaaggattgcttgaacccagaagttggaaaccagcctgggcaacatggcaagaccctgtctctacaaaaaaaaatttttttagttaactaggtgtggtggcgtgtgcctgtagtcccagttacttgggaggctgaagtgggagcatcatttgagcccaggaggttgaggctgcagtgagctctgattatgccactgcactccagcctgggtgacaagagtgtgaccctgtctcaaaaaaggaaaaaaaagttgtggggaaggggttttgaatttatatgtatgttaacctgattttatttttaatttatttttggtatttagcttgtagaccctggagttaaggcatggacacccactaaaggaaaacaaaatgtgattatgtttgttggattgcaagggagtggtaaaacaacaacatgttcaaaggtaaattgaacttaatttaaaaagaagtcatatggaagataggtttgtataaatcaagttttgtatttaatataaaaatgtaaagcctggctttataatgttgaaatatatattttattaattataattattagaatgcatttatatattataaataatgttattttatataaaatatatttacataaaatatatttatattataataaaatatatttacataaaatatattttattaaaatatatttatattataataaaatatatttacataaaatagattttattaaaatatatttacataaaatagattttattaaaatatatttacataaaatagattttattaaaatatatttacataaaatagattttattaaaatatatttacattaaaatatattaataacatattaagatataaagccaggctttataatattgttgctttataattttgtgttacttgatgtatgtttttaaatagttttttttaggataagaggagaggtcctcatagtttcttatgattttttttttgtaagaaggtagacatctgtaactatgctatttcttttattaaaaaaagaccattcctatcctttcaggaagtgagtgtgtgatttttggagaagagaacatggagtttactttatcctctatggctcaggactcctttttcaggttcccacccagcatactatagatcttcattttgtgtatccttatgccatatttttttagacagagtcttacttttattgcccaagcttgagtgcagtggcacgcaaacatagcttactgtagccttgaccgctttatgctaatttttaattcagtttaccactcctttctcccaaattgcatgtctcaacaatattacaagatttttccacaagcttcacgtatgttacagtttgagagggaaaaagagaaaaggatgatttttagatcgttttgttgttgtttgtttttaattaacattaatagtagttaacattttttgctatgatcatttgctacttgatcattttatatttgaatgctactgcatgacaattagaatataaaactttgtaggaaatttgccacattcaaaaatctttaataatattttcaggagaattataagcagttttattttactccttaggtaaataataaggaaaaacagaaaaaattatatgtatagtttgttatattttatgatattatatttttaaatcttttctcacccagctagcatattattaccagaggaaaggttggaagacctgtttaatatgtgcagacacattcagagcaggtaatgtcttgaaatttgaaaattgttttatataatttttattttcaagtttgaggattcatgaactctttatcttccaggggcttttgaccaactaaaacagaatgctaccaaagcaagaattccattttatggaaggtaggttactgttttttattttaacacttatatccctcttcttgtctgtcagcttttttttttttttttttttgagacggagtctccctctgtcacccaggctggggtgcaatggtgcgatcttggctcactgcaaccaccacctcctgggttcaagtgattctcctgtctcagcttcctgagtaactgggattacaggtgcccaccaccatgcccatctaaatttttgtatttttagtagagacagggttttaccatgttggccaggctggtctcgaactcctgacctcaggtgatccacctgcctcagcctcccaaagtgctggaattacaggcatgagccaccatgcctgaccatgccctgctaatttttttaaaaactttttgtaaagaccctgtcttataaaatatcctttgttgcccaggctggtcccaagctcctgggctcaaatgatcctcccacctcagcctcccgaagggctgggattacaggcttgagccactgtatgcagccacacacatgttcttattaagtgtatttctatctgagtttttggtggtggttcttaatttaggggaaaaactttttttgtaacattatgtgtctttatttgataatagtgatctgcatataaaaagttgccactaatcagaagagtgcaaattaaaatatctcatttcttgattttcaagttgacaaagattgtattggggattgtgaaaatgtagtgaaatagggatgagattaaacttttatggaagagatttgcctcataaaagcaaaaagccttaaatggtcataccatttgttccaaattcagcttataagaggtgtcataacatagtgtcaaagaagaaacatttatgtaccaattatattggcggtatttttaatatcaggaaattggaaacactgccatgcacagtggctcatatctgtaatcccagcacttcgggaggctgaggtgggaggattgcttgagcccagaagttggacaccagcctgggcaatatagcaagacctcatctctacaaaaaataaatttaaaaaattttcaggctgggcgcaccacgttgggaggctgaggcgggcggattatgaggtcaggagttcgagaccagcctggccaacacagtgaaaccctgtctctactaaaaatacagaaattagctgggcgtggtagtgggtgcctgtaatcctagctacttgggaggctgaggcagaagaatcgcttgaatctgggaggcgaaggttgcattgagccgagatcgtgccactacccttcagcctgggtgacagagctagacaccgtttaaaaaaaaaaatttttttaggccgggcacagtggctcacacctgtaatccccgtactttgggaggcttaggcgggtggatcacctgaggtcgggagttcaagaccagcctgaccaacatggagaaagcccgtttctactaaaaatacaaaataactggacgtggtggcgtgtgcctgtaatcccagctactcaggaggctgaggcaagagaattgcttgaacccgggaggcagaggttgcggtgagctgagatggcatcattgcactccaccatgggcaacaagagcaaaactgtgcctcaaaataaataaataaataaatttaaaaaagaaattggaggccaggcatgatggctcatgcatgtgatcccagcattttgggaggccaaggcgggcatatcatgaggtcagaagtttgagaccatcctgaccaacatggtgaaaccccgtctttactgaaaatacaaaaattagccaggcctggtggcaggcgcctgtaatcctagccacttgggaggctgaggcacgagaatcccttgaacccaggaggcagaagtggcagtgagccgagatcgcaccactgcactccagcctgggcaacagagtgaaactttgtctcaaaaataaataaataaatacataaaaattaaaaaaaaaattggaaaaacgtcaaatgtctaatagtagggcgttatttaataaatgatacagccatctgatagaatgctgtataacctcaaggttatgtgttacagaaatattttttcttttttcacccgtgttaatttttaaagagacatgccatggtcttgctctgttgcccaagttggagtgcagttgcatgatcataagctcactgcagtgtcgaactcatggactcaagtggtcctcctgcctcagtctcccaagtggctgggactataggcatattccactatgccagctagttttttttttttgtagagatggaatctcactatattgctcaggcttgttacaagaatatctactggttttataaaatgcttccaaatggatgttaaatggaaaaatgtgtgaaacactgtgagcatgagttcaattattaaagaagatataaaaaataaatttgaaggagacacaattcattcaaaaaagacatgcagtagaatcatactgggttttggaattggaaaattggataatgcttcatgcttttttagaagtagattctgtatttaatactttatagattttcctcttctaaattgaaattggggtcattttggctttttcaaaatagattataggtaaattaactttccgaattagtagtatttggaagttttgtcgttttgttaaatcatttgtccatgttatatagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatagtaagtagctttcaatgtaacactattattaggactttggttaatttaattataaaaccaggttgagtatatgaccaatataaattattctttgcctgtgaggcagatccccagtaatttatttttgttttgggcacctatatctatgtggtagggacttaatttcattatttttgttctccattaaatataaaattttcataagtatgaaaaagtaatttcctttctcagtcatcctattagtatgcataagaaaacatttaaaaattagtaattaggccgggtatggtggctcacatctataatcccagcactttgggaggccagggcggatggatcacaaggtcaggagttcaagatcagcctggccaacatggtgaaactccgtctctactaaaaatacaaaaattatctgggcatggtggtgggtgcctgtaatcccagctacctgggagctgaggcaggagaatagcttgaacccgggaggcagaggttgcagtgagccaagatcacgccattgcactccagcctgggcaacaagagcaaaactccatctccaaaaaaaaaaaaaaaaaaaattagtaattagcctttagtttctgttgaatttcctttttaaaaattcagttggaaatacttagatttttaaatactttaaaaaatattaattatcattttgtgtctctttaaaagtgtgatggaaacaatttgggggaggagaagcagtttatagatatctgcagcatatattattaggaacccacgtcttgacattggagtgttagcagtaattctttggtttgtggttaatgctaataagtttcttttcagttatgttgttattttgaccaagttgagcagatctaagggaagtagcctcaagtatattttatccgttttcagtatacactcttctactttgatttgcctttgtactttttttgcctagattgccattctttcaaatctttgcatataaccttttcctctttattcaggcctcagctcaaacattaggtccagagaggccttccctgactaccttactagaaaatgcctcccatacttcaaaactgatactctgtatcccattttcgttgttatacatctgaaatgtttatctatttattatatatgtcctctgactagaatgcaagtttcttaggacaaatattttctcatttacctttttgttctcatgacctagatggtacctgataatacatagtacttcaacaaatatttatggattgaataattatttatagtgtaaatgttgtagtttttttttttttttttttgagatggagtttcactcttgtcgcccaggctggagtgcagtggcatgatctcagctgactgcaacctctgcctcccgggttcaagtgattctcctgcctgagcctctcaagtagctgggattacaggcactcgccaccatgcctggctaatttttgtatgctaatttttgtatttttagtagagacggggttttcaccatgttggccaggctggtcttgaactatctcaggtgatccacctggctcggcctcccaaagtgctgggattacaggcatgagccactgcacctggctctaaatattgttttatagcttctaatgatgacatttgcttaggatcaataaaaatcttttctaaagtatcttttctatttaaactttctagcaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcgtaagtatcattgatactgttgtcctctgtcttgggattatatggggaaggatatgtgtttatagctttcatattgatcatttaaaatatgtttcaatagtgagcctaatatggtttataaagaaagtttaaatagaaacaattttggagcctgtctgatataggtctattataacttgtgaaatgaaacttgagttttgtacctttgtctaattagctttggaggcggattcacttcgaatttcagatctgctggaaatttgtggggttcttttgaggttattttatattttctttttttttccagagtcgctgccacaaaaagtccgattattttcattggtacaggggaacatatagatgactttgaacctttcaaaacacagccttttattagcaaacttcttggtatgtacagtggtggggatatagaaaaatctccaagaaatacgatgtatctttaggacaaaataggattttaattctgtcctcactaatttaagcacatcatttctttctgtgacttagtttccttacctgtaaaatagagataatggttatctgccctctgtggtgaaagtggtaaaatgaggtatctagtagaaagttctttggaaaagttttagagcacagtacaaaaacaagtggttttaataatagtggatgtaagggcagtaatactttggcaatgtctcaaggtggtatagttagagagcatggaatttggagttaaaccctgggctgcagtccttgctttgccacttgtttgttgccacttaactttttttttttttttttttgagacggagtttcgctcttgtcacccaggctggagtgcaatggcgggatctcagttcactgcaccttcagcctcccgggttcaagcgattttcctgccttagcctcccaggtagctgggattacaggcgtgcaccaccaggtccagctaatttttttttatttttagtagagacggggtttcaccatgttggccaggctagtctcaaactcctgacctcaggtgatccacccaccttggcctcccaaagtgctgggattacaggcatgagccaccgctcctggccatgccacttaactttcttagctttggttttctcatttgtgtagtgtagtaagaatacctaacctattataacctcacaaggttattatgtatgtgaatgtgttttgtataatgtgaagcagggtatagtattagttgttaatttttcttttttgtatcttataggtatgggcgacattgaaggactgatagataaagtcaacgagttgaagttggatgacaatgaagcacttatagagaagttgaaacatggtatatgagtgacaaaaaagcacttcatctcagatttcttccattgattttttttataaagttactattaagttatttgaaatgtaatatctgttagagtcagatcttccactgcttattattttagatgatttatatgcaaatcatttaaaatctcaggtacctgagcagttacagaattcagtgtttttattttctttattgtaataaaattaagattaaaataaggctttcactaggttccttgaagtttttctgttttttaagacagagtctcactctgttacccaggctggagtgcagtggtgcaatcttggctcaccgcaaactccacctcctgggttcaagtgattctcctgcctcagcctcctgagtagctgggattacgggcacgtaccaccaggcccggctaatttttgtatttttagtagagatgggttttgccatgttggccaggctggtcttgaactgctgacctcaggtgatccacccacctcagcctcccaaagtgctgagattacaggtgtgaaccactgtgcttggccggttccttgaagttaaacaggttaaaagtaagttagaacacaaggatgaaattaaatataccacattttctttaccccacatgaaagaccactcctgtagagaaggatattattctgattaggagctcaggttcttaaatataacatacctgtttttgtatctctgatctattttttagctttataactttttaaattacttagcctcaattttgtcatctataaaacgtacataatactaactacttcatatggttgtgaagattgcattcgctgatgcatgtacaatgtctggcacatcataaacactcaatgtatattattctcaaccattccagttgttctaaaaataatctttaattaccgtagcaactattctgcctctttgcttcttctcactcatcttaccagataattgtgcctttacttttctcttaaatgctggtgtttctcagggatcattcgaagttatctttctcaggagcttcagactcatgtatctgtgtttactagaccattcttggatgtttcatagacatctcaaattcagcatatccttattcccatcccaacctctcacctcgttgtcttatcaatgaatattaatatcatttatattgttgccagagtcagaaacttgggtgtcattattatttcttcctcactctgcccactcctttctccatcagttaactagtccaagtgtttccacctcctaaatatctccattccatccccttctctgtagctgcccttcaactatgctagttcatctctttcctagatcttcttattgtaagtctttcaacagatcttccatcttcctgtactcttcccctttgatgtattttttcatactacagcccagaataatctttcaaaactgcaaatctgatcccattactgcttttcttaaaattctttagtggctttctcttgcccttttaaagtttttaactgattttactgtctagctcacatcttccatgttgtgttttagcattgttgttcttagtattctgtgtgccagctatgctggacttcttttagtttctcaaatgtacattcctgtctctcacatctgggctgttgcctttgccagtccctctatctctcttcttacctctgccatcatctcctctggccaagatggctaactgctacttgcacttcagatttctccttaaatgtccttcttcagggacatttcacctgaaccctagactgagttggaaccttctgacagatgtttctatcacttcctacaattaatttttatattattcagcacaattatttgatgtctgtttttcctgcttgaaggtgaaggtagaggtcatagctgggttactcattttttatgttcacagtacctagcacagtgtctggcacatagtaggccttcagcaactattgaatgaatgaatttatcctttgttgcctgtctctttgccccttttttttcttttctttttttttttttttcttctttttttgagacagagtttcactcttgttgcccaggctggagtgcattggcacaatctcagctcagtgcaacctccgcctcccagtttgaagcagttctcctgcctcagcctccccattagctgggactacaggcatgcactgccacgcccggctaatttttgcatttttagtagaaatggggtttcaccatggtggccaggctgatctcgaactcctggcctcaggtgatctgcctgcctcggcctcccaaagtgctgagattacaggcatgagccaccttgcctggccgctccttcctttttctatcttggataatcctaccactgtttctgctaccactatgaagctgggtgtatattcctactctgtttcctttctgactcctgactctccttaagtctctacatttttgtttctatttctaatattctactcattctgagatctccaagggtctcctaatttccacatgtagtgacctttcttgttttccttggttcctaatatttaagtgttttctgccttttctgttttcagactctaagttctatgtctgtggatttcttatattattctagctttaattatcacttctgtataaatggccaaatatgtatttcaaccttaatcctctcttccactgtttaattctgcgtttctagttgactgctataacatttcttttaagatactgtactgccacttcacattcagaatgcctgaaccaaataccttttctctttttatctttaggacataaatagaaaatactttctcttttggcttgttccatccctgtttttaaaccttaggttagtatacatacaatgaaatgctcaaatcctaaggatacctttctttttttgacaaatgcacagtaacccacacccaatcaagaaacagaacatttccattactctaaaaggtttgcttgtgccctttcccggtaatacttcatattatagaagtcctgggctgtgcatggtggctcacactgtaatcctagtgctttaggaggccaaggtgggaggatcatttgaggtcaggagtttgagaccagcctgggcaatgtagtgagacccatatctcttagaaaaatccagtggcatgcatccatagtcataactactctggagactgaggcaggcggtcacttgagctcaagagtttgaggctaccagtgtgtgatgactgtaccacttcaatccagtctcagtgatagagcacaaccctcttaaaaaaataaagaaattctgagtatatcgtttttcttccaatctgttttctttgactaagcatattttgatattaattcatgtagttgtacttatctatagtttgttctttttattgctgaataatattttttccacagtgtatccattttcctgttcatagatacctaagctatttaagaaactccaaacaatcttctaaagtgtcttgctattctatattctcaccaatatatgggagttctttgtggtccacatccactttaacttttgatattgtcaacctttaaaattttactcatcctagtaggtgtagtttatgtgccttgttttcaggtttcttgtgtgtttgtatatgtgtcttctcagatagaatgtaagcttctctatgataggacctgtctttgtctatgtattctccccagcattcatcctgtcatcttgcacatggtaactgcttggtgaatatttattgatgtatattttataaatatgcttcaagatgaattcatgattaaggaataaattagttttgttgaatggaaatgtacatactttaatatatccgaattatttacattgtatttcaggtcagtttacgttgcgagacatgtatgagcaatttcaaaatatcatgaaaatgggccccttcagtcagatcttggttagttatccttaaaactttataccttcttttgttttcattaaattttctaaaatagatacacttgctttaattatttttacattcgggtaaaaatatatctaagacttagtgtcaatattaaacctaatagttaaatgtggacattttgaaccattaatcttaagctactattgactttatgtttaaatctgttgtaggggatgatccctggttttgggacagattttatgagcaaaggaaatgaacaggagtcaatggcaaggctaaagaaattaatgacaataatggatagtatgaatgatcaaggtaagatggcagattattttcctcaggcaaaaatgttctgagtatcagtaagatgagagtttcactgtattcttgtggacaagatggggagaaatttagcctgaaagattatttttaggtagatttgtaatagcttgaaagctcttactcaaagggttatgattattggattgccttcatcgttgagagaaatgtctagtataatacttctccaaatgagttacaaggaaagaacactagttcttcatgatgttcatagagttaacttaaaaggagaactctgagtcaaatgtggtggaatgctagtttttaaagagttaaatttggctgggtgaggtggctcacacctgtaatcctagcactttggcaggccaaggtgggaagattacttgaggccaggagtttaagaccaacctggccaaacgtagcaagaccctgcctctatgaaaaaaaattatttactgaaagtctcttcacggagctttaatattgctaacatacattgggaaactaagaaatggatagcttaagcaatgcttagaaaattctttctgtctgaaacataagaattcagttttctcagtatactgctctgttcccctgaccctataaaggcatgcctcagagatactgtgggtttggttctagaccactgcagtaaaggaaatatcatgcaataaagtcagtcatacagattgttttggttttccagtgtatataaaagttatgtttacaaatacatatactgtagtctattaagtgtgcaagagcattatatctaaaaaacaatgtatataccttaatttaaaaatagttgattgttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggcgacagagtgagactctgtctcaaaagaaaaaaataaaaaaatatagtttattgctaaaaatgctaatgatcatctaagccttcagtgcattataatctttttgctggtggagggccttagcttgatgttgatgactgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtcttccaaaattggagtcagttctgtcaaaccctgctgctgctgctttatcaactaagtttatgtaatattctaacaatttgaacaatttttcatatctgtgctttatctactatctgatttattgttatttttttgtagtctctttttcctgagctccaggttttcatagtagcccaaataagactgtctttttcttttaaggttgttttttttcctcactgtctttaacactgcaaaaatgtttgcatgtagaattcataattgcagcatatctaaagtatccattctgtgccaggcactgtcctgagcactttaaatatattaattcattttatcatcataacaactcctatggcatattcagttattatctgcctttttcaaattaggaaactgggatacagggaagttgagtaatttgcccagtatagaacctttcctgacttccttccttctttgaattaacgccccttcctctatttgcttaactctgtcgtattacttgccacgatgtgctgctattagtttatcttctttcatttgatttgagctgttggaaggaatataatatatatgtttcataaatcttttataaggaagatgtggcttaaaagctgcatttatgaaatggatttggaggttttgatcgtgactttattttgagatattgtatctttgttagtattgcattgataattagacttcacctggatttcagttcacttctggacaatatacttagagggtatgtatagacaaattaaaagatgtaggaaatcaggatgataaatggggttctaaaccatgttagaagagtcagaggtggatatttgtcatccagcgaaaattcacaggagacatggtagctcttatgcatttgaaagctggccaggtgcggtggctctcaactgtaatcccagcattttgggaggctgaggtcggtggatcacttgaggtcaggagttcgagaccagcctgggcaacatggtgaaaccctgtctttactaaaagtacaaaaaaaattagctggctgtggtggcgtgtgcctatagttccagctactcaggagcctgaggtgggagaatcgcttgaaccctggaggtggtggttgcagtgagcgaagcttgcaccactgcactccagcctgagggacagagcaacactctgtctcaaaaaaaaaaaagattttgaaagccttattttttatgcgtagcaaggagacatatacatgaataggaatggaagtgccacgtaaatggatttcaatttaatatgtgtaaagaaaagatttttccctaagtataacagaatggcatagacagccttacattagatagcaggtcatctctcctggggatattaagaccaaggctagataaccatttatttgggggatattgcagagggaatgcagacataatggacattttgactaaagtccatcccattcctgagattgcatgcaactgaagctagaagaaatgcacctgatattctaagagtgatcaaacaactgcgggaattaattcactatatgctactgagagaattaaaatactagtagtagtaattacttgattataggaaataatttttctgttgattatggatagaacgtacctctttctgcttgcttatatagtctacattatgaatttatgattaatatttagggtagagctaaagtgagcatttgtgttcattttttaaatataccatatacctctgatgtttggagggcctggagagggtagacatatgaagtatggaaatgttggacatggggtctcgaaacattctattaatagtttacttaaactgtagggaaagtacatgtttgtttcattgtttttatagcttatgaatactataaatgttcttttgaatatattccgtattttctttttttttttgagatggagtctcgctctgtcgcccaggctggagtgcaatggcgcaatcttggctcactgcaacctctgcctcccaggttcaagcgattcttctgcctcagcctcccgagtagctgggactacaggcacatgccaccatgcccagctaatttttgtattattagtaaagacagggtttcaccatattggccaggctggtgtcgaactcctgacctcatgagctgcctgcctcggcctcacaaagtgttgtgattacaggcatgagccaccacgcctggcctccatgtttaatttttaaaactcaaaagcaaacatagcgaatgttaacatttgttaaatctgggtggtagtttgactatgtattatgtctgtttttctgtatgtaagatattttgtaatataaaaagaaaaatgagatagttatcactttaaaaacatctgctaagctctttgaagttatatattgcccatttgcacataactgctttgatggtgaatgataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtaagaaaaataagcttgttattagttaacagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcacgatggctcatgcctgtcatcctagcactttgggaggctgaggcgggcggatcacttgaggtcaggagttcaagaccagcctggccagcatggtgaaaccctgcctctacttaaaatacaaaaaatatccgggtgtcgtggggtgtacctgttatcccagctactcgggaggctgaggcaggagaatcacttgaacccaggaggcggagcttgcagtgagccgagattgtaccactgtactccagcctgggcagcagagtgagactccggtccccaaacacacacacacacacacacacacacacacacacacttcttctgagtaatactgtttaagttatgcatgtatctttgtctaatgtagtgccacttttttggacagtaaggctgattcattcacttctatatcagatcagtttttgtgcagttccatgagaccagggatttttgcctgttttgatcagaaacatagtagaagctaaaaaaattttgtagtaatataatttccattatatttctttatttatattattttgagacagagtctctctctgtcacccagactggagtgcagtggcacaatctcggctcactgcagcctctgcttcccaggctcaaacaattctcctgcctcagcctcccgagtaactgggattaaaggcatgcaccactaccgcctggctaatttttgtatttttagtagagacggggtttcactatgttggccaggctggtcttgaactcctgacctcaaatgatgtgcccgcctcggactcccaaagtgctgggattacaggcttgagccaccacgtccggcctcacttccattttaatggttgaatattttctcaatatgtgtttttacattattaagtttaacatttctttgtacatttactggtttgaatttactttgtgaatcacctcttcatgttccctgtccagttcttccatttttcccccttatatctttgtaatagctccttaaaatctttggtttatgtcttcaaatattttcccccagtttttcatttaccttttatttttatttatattttataatgaacagtagttgccctttttaatgtagccagcctatctttttttatttcttttatgctcataaacagcttccccttgtttattttttccttttttttttttctttacagaggtaatcaagttaaccttctccatgttgataccacagttgtcaccattttcttctttttttgagacagagtcttgctctgtcgcccaggctggagtgcactggcatgatctcagctcactgcaacctccgcctcctgggttcaagctattctcctgcctcagtctcccgagtagctgggatttcaagcacgtgccaccatgcccaactaatttttgtatttttagtagagactgggtttcaccatctttactggccaggctggtctcaaactcccaacctcaagtgattcgcccgccttagcttcctaaaatgctctgggattacaggcatgagccacaacacctggcttctacttgtttttgtttttattttgtgtttgactttttaatctcaattgaatttattttgctgtgtattatgtatcgtaaaaagataaggttttccaaagacttccaactgttccagtcctctttttgatttttttctataatgtaaacaactaattcagagtctgtgaaaatttgccttgaaacccattaaaatgaatttattgtttccaaaaatattaattagacaagctctgaatatgaacaataccattgaatagcttctaaaagaatgagtatttccagatgttttaaattaccttttgtctttgaagctttccttattttccttgcgatatcctattttctcttttgtgacaaaaaaattagacaaacatgttgaaaattggttataattcctaccatcacatgctatttcagatagtgactaataaacacattacatcactgtaatgtctttcccatgtagtcctgactgttcttgatagaacagattcaccatccagatcttatctatgcattgatccctcaataaaggaataacccaagatgaagttggcagtgggtatacacacagctatgtcacaccaaacttgaaatactttttagaagttttaaatgctgataaacaaactcttaggacaaatcactaatgagcatggaattcccatcttcttcagatttattcatcataaatggttttcacagattttatcataaaaacataatcttctctttcattcatagtttataattcacatgatttattcacattaaccagctgtgattggagaatcaggaggagctttgagtcccatattttataaatgcttctgagaagtaccatagttaatgcccctttcaaataaataattttggatggttgtggtggctcatacttgtaatcccagcactttgagaggccaaggcaggaggatcccatgagcccaggagggcaaggctgcagtgagccatgatcagagcactgcattccagcctgggcgacagagcaagagcctgtctcaaaaaaaaaaaaaaaaaaattgttgaagcagttctattcattgttgtagtgatgatctcttgctttcttttatgagtacagctgttgtctaaagggtgtttttatctattctgttgttgtttttttatttattgttgttgtttattttttgttgttttttgtttgtttgttttgttttgttttgagacagggtctcgctgtgtcacccaggctgggggctgaagtgcaatggcatgatcatggctcactgcagccttgacctcccaagctcaagcgatcctccaatctgaggcccccaagtagctgagactacagacgcatgctatcacactgagctaatgcttttttttgttttttttgtagagacagggtttccccatgttgcccaggctgatcttgaactcctgggctcaagtaatcagcctaccttcgccacctgaagtgctgggattacaaatgtgacccacctcacccaggctgcatctctttcattgactgccctttttactatggtgttttgacatagtgtagaaattccttgacaagtgaagttgcattatttgtctttgtattctctgaaggttttcattacttaaagaaaacttctggccaggcgctgtggcctacgcctgtaatcccagcactttgggaggccaaggcgggcagatcatgaggtcaagagatcgaaaccatcctggccaaaatggtgaaaccctgtctctactaaaaatacaaaaattagctgggtgtggtggctcatgcctgtaatcccagctactcgggaggctgagacaggagaatggtgtgaacccgggaggcgggggttgcagtgggctgagttcgtgccattgcactccagcctgggtgacagagctagactccatctcaaaaacaaaacaaaacaaaaaaaacttcttagatacatacacatcttcacgttctctcagactcatactttactttctactttcttttttttttttttttcttctgagacagagtcttgctctgtcgcccaggctggagtacagtggtgcgatcttgattcactgcaacctccgcctcccggattcaagcaattctgcctcagtctcctgagtagctgggactacaggcgtgtgccaccatgtctgactaatttattttgtattgttagtggagacggggtttcaccacgttggctaggctggtctcgaactcctgacctcaagtgatctgccagcctcggcctcccagagtgctaggattatagttgtgagccaccacagccagcccaacagactcatactttcatattcatctaccagccatccagtctctttgctaattaacccatgtctataaactcagctttttgtccagcattcccctgtatcactattaagccgttgttatagcttactattaaaaactgctggctgaccaggtacggtgtctcacacctgtaatcccagcactctgggaggctgaggtgagtgggtcacgaggtcaggtgtttgagaccagcctggccaagatggtgaaaccctgtctctactaaaaatacaaaaattagctgggtgtggtggcgggcacctgtaatcccagctacttgggaggctgaggcaggagaattacttgaacctgggaggtggaggttgcagtgagccgagatcacgccactgcactctagcctgggtgacagagcaagactccatctcaaaataaataaaaaataaaacactgggtacaattttgctaatagtggcttattcacagatataaataaagtattagcataaatcgtagccttaaaaaagccttttatatgtccttttatatagaattttacatggtcttcaaaaaatagtatgtaattgagaaaaagattagaagggaatatgtagaaatagaaagaattatgttagagtgataggattatgtaattttttcttagtattttctcagttcatcaaactttctattataccctgattatactgattatattacctcctacgctgactcaaaatctttttttttttcccctcaggtggcgacatgtctaagaatgtgagccagtcacagatggcaaaattgaaccaacaaatggccaaaatgatggatcctagggttcttcatcacatgggtaaataccaagttgttggcagttgctaatgcagtttaatttataagggttgagttttaatgataagccttttattgtaatattatgaaaatatgttcaaaaggtgtgtgatttcagggaaatggtcatctgaatcctaagttgaattcaattgtaatagggcttattagctgaggtcttattcactcctctgctgccatctgtgtgatgtttgagcaagctatttaatcatcttttgtttgttctggtgactttttcccttattttagaacctggatatttttacttatatgactgaggatttttaacctgagttctactttgactatataacctttacaaagttccttaaactttctgaacctcactttccccttcggtaaaatcacagatcatatctcatcaagaaattgtgacaattaaatgagataatatatatgaagacattcagtacaattctgggcatatagtagatgttcaataaatgaattattttctttttgtaagtcctatgaaataatcccctattgattattttttatgtaacttagagtaagacccttttggatttataagaaaaaaattttttgtttagatttattgactatgtgaccggtagtatcctaagatctttttatgtatcacctcatttattcctcgcaataactccgtaagataggctattcattctcttttattgatgaagataactggtgataatacaaatttttaggtggtacgttctttaaggctgatgactaaattgcaatcagaattcagtatttttagaagtacttattaggcaaaagtaataaatgtttccagttctgcttaataattctctgtttttaactctacttccctacttttgctctaggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaa

SEQ ID NO: 2775 - DNA, 46670 bp, Homo sapiens; identical to SEQ ID NO: 2774
  source 1..46670: mol_type = genomic DNA

SEQ ID NO: 2776 - DNA, 40728 bp, Homo sapiens
  source 1..40728: mol_type = genomic DNA
ttgctgtactgtgatttacctattcaggtttatttaataaatacagtagaggttaacagatgatagtgcaagttcaatagaagtagggtgatttaaaaacattctggattacaatgaaaactcacttatgtgggagtttgagctcacatttacagcctccaccagcagaaatcatgcaaataagaaccactgcagagttctttgtccacagacaccatctcccttcaggatggtcctgcttttcccccagcacctgtgcaggcatctctggcgagccttatcacagtctttctgagtttgcctgtatgcttcacataaatgtagtaaaaaaacaatgagacgcttctttggggcaactgctgtagaggccactaatgagaaagtgtagatgtttccatcatggaaaattacaagtttacttggtttcagtccttggcactaagtcttaggttccttgtcactgaacagccttctttccacttggcttctcttggccagcatcctggcacaccatcagaggagaaaataatgagaaagaagtgtcttacagggatggggagcactggtggcttaccatatgggcataatcatggctcttcaaacaaatccttgaccagacagtagcactatttgtcttcttgcctacacaagctacatgtggggttcacacctcctgaaacatgtgcacactaagagaactggagaatgtttgctcagtttccctccttttcaggggaaccctctggctggtcttcagtacatgagcagtgacccagctgtggttagctccagagagttttctaagagtccctcatgttcttagagttctgatgttgcttagaagacagaggcctacctcattcttggtttactcatgcttcaggttacatgaatgtggggtggggagtgggaaatagctttataatttttgtagaaattatataaggagtcaggagtttgagactgcccgggccgagtctggcttacacaccggttgaattcttgtccagcgcccaagaagaatgagaatgtactgacagtggaagagtgagcacttgctaattataaaaatgccaaaggatagctatgtggggtaaaaagcacctgagatctcaccatgcagaggtaacatgtgcatccctttggtgagaatttctagtaatctgtctgatgtgtataattattcatccagcatttcccaaatatatttgtgaacatagtgttagtttgtgttcatccaggagccaatcctgagacagagaccggaaagcaagaaatgcatctgggaggtcagcatgtggtaaaggggagcggggaagtaaggcagggagggtgaggctggtggttatcaggttagctgctcctgtgggtggctgggtggtgctcagtcccacggaggaactgtggaaaagagtatggaacgtgtgcctcagcaatgcttacctgagggcgagggagctggggcatttacagccaaggtgctgttggctgaggctgctccctgggggtgtgacttctgagcacttccagcctgcacagcctactaagacatgtgagaaagcacccccgcaaccactgcccctaggaaagaggcagacactggcagccggaaggcagccagacacatacttattggtcgtattgcttaggagatgcgtcaggcactgttctaggtgctggggacatggaaggaaacaaaacagagaattctgccatcatggaacattctgtctattgggggaaaataataaacagggcaagtaagaaaccatggagtgtgttaggcagtatcaagtactgtgaagaaaaacgaagtaggaaagggagttctgggaagggggacaggagatgggttgcaaacagcgaaagaggaatgagggcaggcctcactgagaaggtgacactcaagtaaaggctggaaagagggcagagggaggcacttcacatggttacctgggaagaggaaatagcaggagcaccagccctaaggcaggaatatgccgaggcatgtgtgcaaggcccgtgcggctgggctgggagggcagggtaagcggggccgtgctgacctctgtgcagcctcaggctcctacctggggcaagaccgaaggctgtaggagagtgggagcattaacagggtggcaacagctgctgtgctgtgaacagcccaagaggggccagggcggaagcagagaggactgaggaggccggggaggagggtgaagcagttaagattctggagatattctgaaggtagagccaaaagacttgcagacagattggatgtgaggtatgatagaaagaaagaagccaatggatttggtttgagcaactggatggagctacctcttcctgaatcagggacattttccaaaggagtggcacaggatttttttctcggtcactttgcaagccagggacctctggctggtgacggcccacctgggcctcgcttgaccatgctacctgctgcaggagacggcccgcccacttcacccgcctgggccaagtatggcttccacactggttgagttcttgcccagcaccaaagaagaatgagaatgtgctgacagtggaagagtgagcaaagctgggagttttattgagtgatgaaacagttttcaacagagaggagacgtgggggtggtccccctacccaaaggcaggaaagtccccttaatatgggggagtctgggtctttttatgggctcagaatggggggaggggcaggctgtaggtattactggaaaaggcaacattcgattggttaaggcgttattcagaaagaacaattgggaaagggtgggcaaacaggaacagaagttcccactctgcgtggtgggtttcatccaggaccagcaatctggtcttttagccttcaggctgatctttgcttgaacgtggggtttcatttgggaccctcccctctctgcctaggcatttggctgcctcatgtcactatcaggagcaagcctggggtcaggagtaattgggagcctggctttgggcctgtgaaatctgagatgtccattagagacctaagtggagatgtcagtagcaaactgaatataggggtctgcagttcagggaagaggcccattctgggtttaaactgaggtgttagacagcatgtagatggtataatccatgtggctgctggagacaccccagtgagcaagccagatagaaaagaggtctgggactgagtcctcagggaggcagagcactgaacaaaggaacctgagaaggagcaaccagagagcttggtgtcctgaaagccaaacgcggaaagtacttccaggagaagggagtggtcgactgtgtgtgtgtatatatatatatatgtacatgtgctacatttataaagacctccatgcagaaatatacactctctctacggatatatacatacacacagggagctgtagataatggtgttatactatagaaacagatctataactctatctacttcccactaaatctactagggacagtgtgccatggcaacactgtctgtctgctttcatcatttttttcatagctgcatagtatttcattgtgcccaagaaccgtaattaactttttccctataggtattttccccaatatagaattctagattatacagcaatgaacaccttgtgcaaccatcctttcacacttgtgtagccatctccttgagataaacccctaagagcagagttgctataggcaagggtatgccctttttaccttctgattctgaactccttcctgggcagccccactaatcagatgcattcaacgtggaacagctgctgacctcaaggaagaactgcccaggacatcattccaggcagactctatgctagggacccttctgtacacagagaagatgcagggcagccactacataatcactgttagaaatcagcaaaggtttgcatcattacaaaagtctatgacaggaggcaatctactggttctagctctcagcctgacgtatcgagctgcagcggacttctgcgtataaagactgtcctgtttccacggagagaggagcaactctccaggcctaaaggatctccagctgagccacgaagagcttatcacatcaagagcaaatgcagcagacgaaggcagtgccttctgtgaaatgactgtaattaactccaaatctttctccacactttatttttgctggctggatttgtcattttgctgtcagaacaggcctacaacatacctcagatgtttttcctttaccttgtcattctgagcaaaagcatgactccatcacctgtctgggcacataccgagtctttgtctggatggtgtcagcacatcctgcacactcagcggcaaccctgaaaataacatctaccacctgccaggcaattggctgactgcctccgtgatcttcaggggcatcgagggacaatgtatttagtcatgcacctctgtaagtgcagggaaatgtactgggacacctttcgattcccaaggaaataaaaggaaaatgacaaacacatagtcacgctgtggatccctgtttattcccatctctgggcaggcctgtaaagagcatcgacccaggtctcaaccccactgctggtaactgagccacagaaactgtaagcactcatccagggagaactactcccctaaaccggttcttagccagcaagagaggcccacaggaaggtctctgataacctgaagttttgaaaagcttagaactgtgtgatcaggccatatgcccctcagttcctgaatgttcactaccctgtggtgtccctttgccatggaagagactccaaccacacacatcagttaagctgccaacactgtttcctccccattctgctctgcgaacaacgcacagtccagccaggagctcaacagggagggttttcttgttgtgtcatggctgagatcaaagtcattgtacaccaaggacatagtggacagaagggagccaacaacatttatgccaaatcccattcccaagatgactatattttatagtttattatgaggtaactgcctccagacagataagcccctgcatgatgctgaaagtcagagcctgggggtgaatgccaccttatctttgtcctcctcagctggtctgcgtgtctctgctcagaacgctgtgtagtagtgctccattgtgctgacaatgtcactctggtcctccaggagctccagaacttgctgcagcacagcctcgctcaggcccgggcggatgctcaggcgagcacaggccaagatgtgcaggaagtgacagcccttctccatgtctgcaggaaaaaggtaggtggctgagtgtggacacaactgtcaggccctcctctgtcctctccatacctgacttggcatctgcattctgaccagatccccagatgatctttatgcacattaaagtcagaaatgcatgatctacctgatcacaaaaacaaaacagaaacacctgttctcaggcccctgatgtcaccacggcgacatggagccactgctcagggactctgaacttcaaccttcaaggattcccaatcaaagatttttttatctgtaacctagtggatttttagtgcttgataaacttttttctgtggggtaattacatgtataagtgtaacgtattcagtgccaaacctctagtttctcagggaggagccctcttgaaactcacagcagagctggtttgctgcagcctccgtatgcttccccctaagtcctgatttgatgcggctgcctggtgagaagggattcctacctttggcctgttctcattcctctcttcctggcttccaaaagtcttatctgtgatggttgtattcctagtaacctcttatgctctgccccaaactaagaccatctagtatacaacaatacaaattcagagttagtaacctctttcctagttgaaatcaatgacttaaacgttggtaatgagaaaatgaaataacttttatctgaagaatgcaagtccttttaattatcaggcccagagagacacgaccatgaaacggaaatcacgccctactcctacatattcacctcggaaactgcttgctattggcacaagtagttataaattagcctaataatgccaaattgaacactataatccacaccctatggcttaacaatgtatagccagtcaccaatcaatgttatctataaaccaatgagaattcctgacaaacaactttgtatcagcccactccctgtcctcctttttggcttttaaaaatccacttatgggctaggtgcagtggctcacgcctataatcccagaactttgggaggccgaggtgggcggatcacctgaggttgggagttcgagaccagcctggccaacatggtgaaacctcctctctactaaaaatacaaaaattagccaggtgtggtggcatggacctgtaatcctagctacttgggaggttgaggcaggagaatcacttgaacccaggaagcagaggttgcagtgagccgagattgcgccactgtactccaacctgggtgacagagtgagactccatctcaaaaaaaaaaaaaaaaaaaaaaaaaaaatccacttatcactgctgctaatcagagtgtatattcagagaaacctgaatctgtgctccccagctgcaatcctgaaacttggcccaaatcaactctctgcttgtattaattttgcctcagctccttccttttaggtcgtcggcagtagtcaaactgggggttgtgcctattaggggataacgaaaccaatttttgtaggttgcgatcagcaactttttcttaccaaactcaaagagagcagaaatagaacgttacagaatatcttgcattgtaatttggatacatattaattcatgaaacttaatttcatatacatcttatgcattagaattatataatttattgggtcatgatgtaaaatgtatttctaactttgagtcaaagtcaaacttctttaccaaaagcaaaccctctccagttgtcacagtttaaaactccatggcaggcgcaggcatggtctctctctgccgtatacccagtatctggcacacaaaaggtgctccacaaagtcactgaaagttgtttacagatgaaaaatgctttaggcttcaggaaggtgctcgaagaggtattgcggtgtgaggcaaagcacggttcaaggtttggtgcacttctgtagctttgggcaagccatccctaggcctgagtgttctcagctgtggtgaaaaccacttccaaggccctttccaaccctaaggttcagagactgctcctgggctaacaaaaatttgctaaattctgacctctagtggctgtgtccactcattactccttccaactgggattgctggcatctatacttccaggctgtttcttcaacattcactccatagacttcctgaacacctactatgtgtgcattgctgagcaaggaggagcaagtagagcttggcagacctggagctgccactggagtccaccacaccagaattcaagccctggctctacaactgggacaaagtcactcccgggaacaaaaccacttccttctcagggtggctgtgtggatgagagaccagggggaactactatgatttggttcatcatatccgtaatccaagaagatgaatgtaacttagttcctgctctagaaaagcttcatcccttcccaagaagaaaagcctctcaaggaggaagagctgaccagcaagcaaggataggtttgatgatggagggtgaggggctccaaccacacagacctgcacacggtagggaggagcagagggaatttagtgctgctcagcttttagtttctgcaaggcctggatgcttggacccagggctcaaggtgacttacaggcatccatggggcccaaagcagtgatgctgactgtctcagaggccttcaactatttagtcagaaaggctgttctgctgagggttatctggtgaggctgttcaaaagtgatctccagtcacttcggtaatgtgaacttagactcctctctatttttaatttttattttttgtagagacagggtcttgctatgttgcccaggctggtctcgaactcctggcctaagcaatcctcccaagcattgggattatgggagtgagccactgtgcctggccttagattcttctctaagtgagaaattattataaaacagtaaaagtaggaaaggccagcaaggagctccccaggggttagtacaattacataattcgactcttctggaacaaacccacaagccgaagcagacttttctgaaaagtgtttgcctggcagacatagttatcttatgacggatcactatgagcggtgataactgcgccttatattttcccaagaactttcacatgtagcctgattcatactataccccatcatacctccaccagaaaccacaaaggctaatgttctagagacccaaatgacataaagatacatttcagatataacctactactataactacaaaaggttaaacttctttaagtcttttttaaaagtttgtcttaagtttaaaaaaaaaatcctccagtataagtagtgttatatggtactcagtttctaccaaaagcagcagttctctccagctctgggatagtaaaaaatgaacctgagctaaatacatgggagatttttgaaaagctaatggtataaagtaacatttagtgaaaggctgccattttggaactcatcaaatgttaattttcttcggtgtgaaatgatttggtgatcaaataggagaatttctgcatgcttagcaaatacaaactgaagtttttagtcaatctaggtgaagggtatatcggtgtttattgtaccagtcttttaatttttttttttttgataaattggaatattttcagagtaaaaagttagagataaaaagacatgttcaacatagagctcttttggataatttgccattgttgtacccatactgaaagccaaaatccagattttgtcaactttactccaacaataatacagcaaaatccacatacagattctatctgaaactgcctccttccagatcaatattaaaccaagtagagggtgagccttcaggcctgcaggctagagaattaggggttaccacttgtgccattaggaaagagaacttcatttttatttaatactttttggatcataattatgcactgagtactcttctaactttctaaatgccaattcatttacttcttataaaaacccatcttgtaggtactattattatccccactttgcatttaaagaacccaaggcacttgcccaacattacacagctagcaagtggcaaagccgggattcaaacctaggcaaggtggctccagagcacagctcctcacaatgccgccacattgcccatcttcagagaacaagtatcaatccttcagggacctaagacaggcttgatgttcatagtcctttcattattgaagggttagcctttgtgagacactcataaatgacttcaagtccttctaccaatcatcctgacaaggaaaaactccaggctatattctgtttgaaaggctagaaaggaactaaaggcccagtaggtatggttagactgagggtcggatatttacctatacatgtaacagcatgctgtccagctaatgaaaagacgtaggcactttcatgtgtactgttgacctctagaaggcaatgttagatctaaaatacaaggtgtaggacaatgtatatcgtcggctaaacttcacttgtgttttctgtcaaggataaataatatgatatgtttgtaagtgcatatctgtatagtttatccctgatagaaaacacatatccaacaggatatgcaagtaactaataacaaccactgcctttggagaggggaacacagaagctggggctcagtgctgggagggagtctggctttttggagtggatttttgcactgcttggcttttcatgaggggcatacgttactattctgaattgctatgttataacattatgaagcggggtggtcacagcaggttccaacacagtccttataacatcttttatcagcattctcagtagctcaggcttcagaattcagctcctgggagtgtagtagtgccaggtgattggctagtggcttttagaggctcccattcacagactgagtggcagggcctgtccacttgatgagctgtgggtagatgtagatgttaaacctgctactttcaggacacttcagagagccaagtccaaatgaaatgtgaattcttttcatgtgctttactagccctagggttcaatccattctattcctaatgcagatgaaaataagaacctggccaggaggcctgcgaatagggtgactgcagagatgttatcttgggagcatcttctcatcccttcttggctgaggaatcccacattgcactgctctcaaaagctccttcaattgtggacagatgggcttttccctcaactaaaggatatttgcttttattgttctgaatgaagtgaacaaagtccattcacttgcactgaaataatatattgctttgagtttattttaagagctgctgtcacaccactctgggatccgacctcatggtttcttaaaggctaactagggctgtctaccataaacaccagtgctggaaacctggcccagcttcacccactgactcaacctggcacaggtccaggccccagggatgtatgggccgaaggactggaggtggagttcactggcagatcagggacctggggtcattaacaaacttttccaacacttcttattatagtatgtgtttgcaaaagctagactttgaaaagtcgcctttaagaccggtcagtttacataggatttaaagatagactaatgcttccttctctaactagtgtggaaatggtattgttccttgtcagagtagctacagtttcagtgtctaaccactaggggctgaactaactctaccaaaactattttctaaaccatgtcttttgcaaattaacagtttccaagatgactgaattacaccgttcataaacagtcatgtctagaaccatcccttccaacactgaaaggctttgatgttagaatagagggaaatgtcaggtttgtgttcaaagaaggggggcaagcatgaaataggaaataacacaaatcagagagaacatgagaagcagaatgacatcaaaacgtcctagtgtggtgacctcactgtatcagaattccttgtctagcccccacctcatcctctatggaaacaaaatccccagggtagaatctgggctctgaatgttcagagggctccaaggttgaatcttatgtacagccaagatcacaacaactgtgctagcccaacactcctttagagaggagatggaggctcagggagggcaggtactttgactatcacctttccaagtcactactgggaaaagtcccgggtctcctgactctccatccagtgctccccgggagacagtatccccttccagggcaccagggcatcacttgtacattataccacttacgatttggtttctggcagtcctgctgaatgatccggtggatctttctgtgcaggtctttgtcttctctggttacctaaataggaaaaatagttgagagagagagtgttcttaggtaacacagcagttgtgtcatccagacttccaaattagtattcaggatagtttctaaagattacataataatcatcttccctacaccattaatgtggtgtttgatacttggcctagtgtcaaaccagttctgcccagaggacacgtccttgggagttggttcattggggcaatgaggttaaaacaaaaaaaaagctggaattgcatacttttaagggacaactttcttcttcaacactcataacacatttttgttatttgttgttatagttttgagcgaggcacagtgatcaaggcctccaatctccaccccatgactccttcttctgggccctgacacctgtcttgtgttgcatcagttttcttgcttctcccaaccacaaggaaaaataaaaggagaaaaaaaaaaaaaaaaccctgcaaggacaggctagcatgagagtaaagctagcctatccactgaaacacattctgctctcaaaggtagacataacttagtctttttctttttccttttttttttttttttttttttttgagacggaatctcactcttatcgcccaggctggagtgcagtggcacgatcttagctcactgcaacctccgcctcccaggttcaagtgattctcccgcctcagcctcccgagtagctgggattacaagcgtgcaccaccacgtccagctaatttttgtatttttagtagagatgagggtttcaccatgttgaccaggctggtctcgaatgcctgacctcaagtgattccacccgacttggcctcccaaagtgctgggattataggcgtgagccaccgcacctggccaacttagtcttttttaaccagctcagattaagagggaagcagcacacaacaggtttcaccttcatgttccacagtgaatctagtaacaaaaaaagagagaaagagaaagaaaaaaaagaaacagaaaaagagagaggaagaaaggaagaaagaaaataggcatgcaaacaaatagctgtaagtttcctccttaaagacagcccaagaatgcctgtctgacctgccttactggagggggcatcttgagaacacctgccttctctcagctcacaaggttatgacgaagattaaacaaggtcatgtgtgagagctgctgaacctaggaaagcactaggcaaacagaagtgttgacttattttaaccatttccctgaggcagggcttcaggagaaaggtgactacaaagcagtggagagatgaagtcagagatggcgacaagagatctatttgtgcttgatcacaatgattcacaggaggaagtacccagccccaccacgccttgccctggactgctgctcctcaggaagggctgctctctaaaggcctgggaggaaaggtgtgtcccagagcagggctcaaggtgagctgcccccatagcttctccaacttccaggaagcaaccaactcccacccggccttcccatgccaggactcccatcctgggacggtgtgggaggcactcgcccttatgtagactgggatacctgcttcaaaagttatttaaatggtattgtaatttctaaaatctctctaaagaggggagtcactagggtaaatcaacatcaggaaatgtcatattaagaaaagctccccgtcaggaatcttgcctgtgaatagtgagacttctggaataccacagaatttgatcagtctctgggagagctgcacataacggagtccacacccactgatgtcagtggtcctgagaaggcccatttccaccttagctcctcccaatattaaaggtatgcagcaaaaggtgaacttttaacttgaaagagtgaggcaaacaagcacctacacttctgctgggagtcaactggtacagccttcaggcaggcccatcacactgtgttgaccaaaagcttaaatggccatgccctctgctccagcagctcttcttttaagagtcaatcttacagaaatactgacatgagttcacaaatatagttgtgcaaaaatagccacagcaacaccatttgtgacagcaaaagttagaaataccctaagtacccatcaaaaaggaatgtctaaaaaatacacaacaggtacccatagtatggaataccctgaggatgttaaaaagaacgaggtagatttataactactaatgtggaaaggtgcctgtcatgtgttatcttggtaccaaaaaaggtacagagcattatttagagtagcaagtctcaatggtcccaggagatacccggcaatgtccagggacatttttggttgccacagttggggtgttgctcctggtctctagtaggtgaaggtcaggcatgctgctaaatatcctgcaatgcacaggatagttcccatggcaatcgatcacctaccccaaatagtgttcagattgagaagtgtcaatttagaagatgatcacattttttataaagcaaaaaggttcttgcataagtcagggattggaaacaatgaaaaagccacaggagcacatttgtatatgtatgcatctgtaaatgtacagataaatgtctagaaggatatacagttatctctcggtatactcagtggatcagttccaggaccctcaggtataccaaaatccacacacactcaagtcctgaagttggctctgtgaaacctgcatgtacaaaaagttagccctcatatgtgggtttcacatctgcaaatactgtactttccatctgcatttggttgaaaaagtctgcatataagtagacccatgcaattcaaacttgtgtggttcatgggtcaactgtattattaaaagagatacctcggggaaggataagggccaactttcacttctgattttatgtacctccttaatgatttttaagaataattaagtggttattcataagtaataaatatatttgtaattgaagctacaaagaaaaaaagttaagttgcaagtgtcttacatagtataggttatcaaaaccatcatctttctggaaaacaagtcctttttcctgcagcagttgtatagcattcttaaatatactatgaattgccttggaagtggtgtccttcttaaaattcacctgtaaagagaggaaaaagaaaaaagaaaagaaataagtctcaccttacggcacctgagaacaactcctagaccaactggttcatgaatttgtccaacaggccttttaactgctgagtcaaaaagatcctggtatgtaccggcctagcaggatggtatttaaggaggactgagaagtgtgccccggcaggtcacctttcataactgttccctaccttagttgtgatttttttttttttaatgaactcaacactccatagtgcagaataaaaaaagctaccctcactgttggacaatctttgacttattttttatacaaaaccaaaacactgtatatatatattagcccccttttccattaaaattgaggctgtatacaatctcttcctagggacttcaaagattttttgtatgttggaataatttggggattccagcatgaagtattaaatagcctcattattttaaatggaggacaacagaggctgtgcagagatccaccaaggggagtccacaaggctgaaggtagacagcagtcctggtgaagcacagtccccacctagaagggacctctgctgctgtcagctctccccctcactttcagtgtctcttcacttctctggagacacgtttgcctggggagggtcatccaggtcatcctgcttcttatccccgaggaagctaggctatcagctatgtccccccatgcttgaccagatgggatgcttcttgagtcagggactttgtttcatcttggccacctcctccctagcacacgttaggtgactgataaagtatctgtgagatgaatggaaacaaatacacattagagtgtgtgtattcttcttattattccattggggattttccactccttcctaaaacaaagaaaagggcgaacaacaattgctcttcaaagtacagatcctttttttttttgagacagagtctctgtcgcccaggctggagtgcagtggcgcgatctcagctcactgcaagctccacctcctggattcatgccattctcctgcctcagcctcccgagtagctgggactacaggcgcctgccaccatgcccagctaattttttgtatttttagtagagacagggtttcaccatgttagccaggatggtctcgatctcccgacctcgtgatccacccgcctcggcctctcaaagtgctgggattacaggtgtgagccaccgtgcccagcctacagatccattttcaatgtgacagaaatttgtcaagatattgaaaagatcagagttccaaacaaatgtggcaaagcttccagaaaagcatttgaaggccaagtcctacctctattgaaaggtacttacaaagcctatgtggggcagcacccagaggtgctgaaaaagagtggctgagatttgctaatgacatttcctcaaggggagaggaaagagcctccacagggtctcaagtgttcacaagtccgtcccaaagtaaccttctctttctagaagagacctcccaaacaggctttctgttactctaatagatcctggtgatgtttcacaaatgtgttctcctgggctaacaataacagcctaacacactaattgaattatcagtctaagtttttccttaaaagaacaagctggagaaccttgtcattagagcccccaaaccgacaaacattccaggttatgacagcttccattcagaagggagaataaggctgagaaatatttgacaactcccacaggcagaaaacctctctgggtgtgtttagaataaacaccacacctagcaatcctcagccacacatctttttattcacgaggcttagggcaaaactgtttttaatttcatacatgagtgctcttaggggatgcaccatcagtgcaacatagactcctttgcaaaccttcataactacttaatctttataattctaaggagatctatcttctttagtcaatttaacataaggatcctaaaggttaggtttattacatctcttagcaagatagaaataaattggaaactaactagagatgagtattacatgattattcctgtctttaaaaatgactcttggttatccccaaaccatataaaaagcctagttccccctcccagatttcagtcagatcaagcagcaggaagagacaatgctaggcctaggagattaaaaacacagtttcagctgtgagcaaggactcaacagaaatggctctctgtaaatataaacaatacttgaagcttcctttccaaaaacatttgcctcagctgaccctgggacatatttccctggcctagttataaagaccatagtctcaagggtaaagccactaatcgtctcttccagccagcagcttttcctggactgggatctgtgtctttcttgtctttttcaaaaaagcaatgacagactcatcagatttaggaaaccgaaattgctcacaggcaaaaaaaaaaaaaaaccaaacaaacaaaaaaaaacagtcactagctaaacgtgctgagctttaccaagcctcgcctcatctcaggtcaggaactgggtggatccctgaaatatatatagtcttcattcccaaacaaactcaacattcatccagctgtcaaagaaacaatggttttgcaggccctgcttatcatgtttctggatttgctaagaaggaccactatgaaaaaaaggaggaaacattcaagcctgctctctctctgcctctaaactataacaccatcacaatgattttttctgttaagctttcatctgtatgacaacagaaagtgccaaaggatctagggtttcagtctcattgtaaagcacctttagtctcccaggaatctattaaacagaactcagtttaatcacactgacctccccaaccagagcaatgtgagggactaattcataattgatagaaaaaagagtttccaaagacaaaacaaatatagtgccatattcgattctttttaaacatatagcaccaggcagacacaagtttctgctgtaagcattttcaaaaagatatgccaaaggttccccacagatcattttgaatggaggagtcttttagtcctcaaagagtccttaagtctctctctctacttaattatagctatcacggaagagctggcttcatgtgaaaaatatggtcttcgctaagctttaaagtttctatccaaacatgctgatagaatcatcagaagtcctaggaggtcaatttggctttgagccgcctctaaatgattaagtgggaagaaggtcaatcttgctgtcagccgacagctggagcgctgcaactgtttagaagcaaccttggcaaagaacaaagcagccagtcgtgaccctttccactttggtgttttctgaaacgatatccctcatctcctcgtatgaaaccatgggtcactgggcacatcaggctgttgcccagaagagataattaggagcacaaacaaaactgagaagcagtggtcatgcccaggaagtcaggatgtgactcagtatctgttccaccaaaatcaagaacttatgttacctagcaagggtgttcacagcagccttgttggtgatggcaagagatcagaaaacatctaaacagtccaggaatggacagactggtcatatacatgatggtacatgtgacaaagactgtaggggccaacctatatgtacggctaggaaagaatctgtgagacatacgtcaatgaaaagtgtggtgtctcatagtatactacgccatgctaccatctgtgtgaaacagaaggggctacagtgacttagagtacacacaagcacagactatctccagaatgatattccagacactagtactggtgcttgtctcaggggaaagggagtgagagggaggatgggaaagaaactgacctttacctttacactttgtgggacaatttgaatttttaaaaatcattcattccttcaatcagcaaataatgagtgagaacctgctttatgccagccccgttctaggccctgggtagagagcaaagaataagacagacaagtcctctgctctcacagaacttaaattctgatggaggaataggcaagcaaacaaataaagaccagtgacgtcagatacaaaaacagggtgtaagggtgaggggccacgtggcaatcagagcagctagacggccagggagggcaaggagggacatttaagctgagatcattccctggtgggataaagaaagtaaataaatgagtcacgttacaacaacaacaaacctaagaactgcaatgaaagggaaagcctaaaatcaatgtctcaaataattcttaattccaagcaatacgtcaacaccaagcaacaaaacaagttacccaaataaaactaggggtaaaaacatggagataactttttcttttttttttgttgggacaaggtctcactccgggtgacagtcaggggtcagggtcacccagagtgagaccctgtctaatttttgtatttttagtagagacaagatttcaccattttggctaggctggtcttgaactcctggcctcaagtgatctgcccaccttgacctcccaaaatgctgggattacaggcgtgagccactgcgcctggcccctcgttacttaatcttattatgcttaatatttgagtagaaaaaaataataatagtctaaggtccatagtagtaggttgttagtattcattgagatggatgtttaatctcagcagaagccaagtgacagggaagtagatgagaggaggtaattatccatccaagatgatttattcatcagcaaaatgattcgcgaacttgaaccatggtttttaatgacttgctctgtctttttcagaataagattaacccattgtgttttaggagtttaaataaagaccgagttgtattcagactcatttgtaagtaaaatttcaaggaacacttaagtaattttttattctttaattttttattcctcttagaaaaagttatcttggttagccaggcgtgatggcacatgcctgtggtcccagttacttgtgaggccaaggcaggagaagcaccagcctgggcgacagagtgagactctgtctccgaaaaaaaaaagattaggtaaggaggaagaaggggcaggtccagccttatgcctcatttcaagttcttagtagtcaatgacctttccagaatagaaataatgtgtgacagaaccattccctccgttccctgggtcaactctgtgaatcttcatgccacagtcactttcacccacacctgcagttgcagatctggggcagggaaccagaattctcacatgggcatgctgcactcacttggtcggaggaggcactgtgaatcacaggctgattggcaagggacagcaaagactccaccatttccagctcctgctggtaaaagctctgcactctgttctccatgaggaattctttggctttttcactcagcaaactcgtgagactggggaggtccagggcgcctggattgctgcggagggaaagttttaaagagctctgcagaaaaccatcacctttgttcctttttggtgtataaaaaccagaaaattagctagaaaatgcaacactatattggagtttgtttttcatatacagagtaatatatacagggaacatcatgtggttgtttaaaatgatgaggcagaactacaggaactaagatattcatgacagattaggagaaaaaagtcaaactgcagaacagcatgtaaggtatggtcctatttttatataaaaaaaatggaaacccacaaaatctatgggtgaatattcatgcttgtgtaagcacagaagaaactaatttaaaaagacacacattggcttatgaacattggtaatctctggggaatggtcctgaggcaggagacaggaaaatggagaattttcactttttatatgagtctatagttgtgcttttaatatacttttttgaatatataatatattcatgttaaaaaacattaaaggatacacagtaaagtctcctttctgtccccttcctgtcctatcctccggtccccacccccgagggagctgctgttaccggttctctgtgtctcctctcagagttcttttatgcacatattagcaaatatgcacacattctcattcctcctgggttttctcccctataaaaaagtaaaatcatccctggttgagaatgaccggtgcaggtttttttaaaacaggtttttgattatgacgtgctatggtatcatattttgattatgaggtgacttggtgcatttttcttcaggtttcttgccttggggttcattgagcttcctggatctgtgagtttaaagtttttatcaaacttggaaaaatgtcaggcattattatttcttccaagtgtttttctctgctcctgcctccactcctccttcagtgactccaattacacccataatttcctcacgacaaccctaggacatctgtgctattattctcttcatgttacagttgaggaaattgaagcatagagagggttagagggcttgcccagagccccacagtgcataggtggatgattcgggatttgaacctaggccgatcccagcatctgggctcagctgcttcagttttctgccgtggtcacgtgctcagcagtgataagtcaccacttaccttagtgcctcttctttctctagggctgagctgtgaaaaggctggtcataaactttcctgtagatagtgggcagctcaagcatccttgcaatttgaatgttccacactgggtcgtccactttatctaacaagtgaccagaaaaaagatgctacagaaattacaaattacattgagatcaattctttcccaggcccaaactgctgctaagacaacagtaaatgaggtgctgggtgggcctccttccttgtgagtgcccagggatcacagtctagatgcactaaatggctcccagtcatcctgcatgagggaatgcgatgccctaagtgtcatgggcttggccagggccaaggaaccaggaaagcacatcaatgtattgattcgtctgctcctctggtggacagcaggggctgtccttgagatttccaactgaaaaccagccagcacgtgcaaagggaagatgatggggaactgtcatatttctgattagctgttttcatttaaagttaatggacttaatggtattcaagaaatttctggccaggcacagtggcacacggctgtaatcccagcactctgggaggctgaggtgggcggatctcttgagctcagaaatttgagaccagcctggacaacatggcgaaaccccatctctacaaaaaattagctgggtgtggtggcgcatgcctgtagttccagctactcagaaggctgaggtgggagaatctcctgagcccaggaatttgaggctgcattgggctgtgactgtgccactgcattccaccctgggcaacagtgtaagactctgtctcaaaaaaagaaaaaaaataaagaaaaaataaagaaatttccattattttgaagaatattcatattttgccctaatggattgacattctgaacttgaaagtgctttggaaactctactatgtcatccaaataaacttgccaaccatatataaagtaaataattcattttctttcccaacttataattagctgtcttcaaaataaaagtaagaaatgctgattttctaaagaaagcatgttaaacaatgtaattcactcattaaatagagttataccttaactgaactttttgaaagtttgacttccagctgaacaagaggtttactggacgcacatccagaaaaaccaccaatttggtagaaatatcttgtgcttacagtaagtggtggcatgaatctctcgctcttctctgtatgtgcggatactgcctctgactcggatcgtgtccccgatctctatctttgttttctgctcaatggtctcttgtagcttcttaagttgtgaggttaagctgagctctcttgctgcacttggagcagctgtagttgtttagagccagagggaaagagaaaaagttataacacaatcactctaccacatctgtgagacagttttagggtaagaccaacacaatatgcttatttattctacttctgagtaattgttctactgttggaaatccacataaccttttggagtactccactgagaacaaggtataaactgtaattattcaagagcggggtgaaaggaacggagtctagactgaggtccagcgggcaagttccgacaggctccagggccttctttcctgccctgcatcaccagtgcagtcaaagggctctgcatggccttgagacaaattctgtacaatgagttcagctgggcgtggcagcaatagctttaaacaacctttcaaatgtccttgcgaggagacttgtcccatctgagtgctcaacatcccaatttctcacctctcatctctgttgggaaactaggctaatctctctgtctctctctctctctctcacacacacacacacacactctctctctctctcacactttctccactttctctctctcataccacttaaaactataaactcgagcaactttataatgaaaaaaacccaatgtacactcaattctaaataacttctatcactattttacttccaaattgtattagttaagtaagaagaatcgtcacgaatgtctgggtactatagatgctgttctaaggagtttacaatgtattagcacatttagtcctcacaaccactcctgctcattattagtcccattttagagaggaaactgagtcacagagaggtcaagcaacttgcccaaagtagaacagctagttagagacaaggctggagtttgaacccaggcagtctctagctccagagccatcccacttatcctttattctctgctgcctgccccaggaagatactcacatttcccagttacggctggtgggtgtaaaagactatgtattctgttttcctgtctagcataatttcaaatacacatatgtatccaaagaagctacacagccaagcattttatgtttattagagacagggtctcactatgttgcccaggctggaattgaactcctggcctcaagcaatcctcccacctcagtctcttgagtagctgggattataggtacagttttataaatttttactttcgtttttttcactagcactgtatgggggcagtatagctcagccatcggcattttggctactggagtcagaaagacctgacgtgaatctcagtttacctcctactagctgtgtaatcttgggcaggctgcttaacctgcttaacctcactgtgcctgtttcctttctacacttacgcttcggtttcctcaattatgaaatggatataacagtagagtctacctcatacatagagttgttgtgcattatctaattgaacacttacattctgcacttagcacaattccatatttataggaaataataaatgtaagctatttgtgataatgaataattaaaccttccagaaaaagtatcttgttttttgggggtctttctttggagattattactggataaaaaattacaaactggtttacagttcattacatattgtcagaatgcttgccagaaaaaaatgatcaaatctctctgtttttagacaacattgtcagtaatgcatgcaggctcacaactcctacaccagcttcagtcatttggatttttaataccttaaaaaatacataattattccgtacatcttattttgcttttaaattgcaggagaggctgtgtttttacacaagatgatctactctctgtatttctttatagagaaacccttcatcaaaatcaacctaatataattttgacaactgtggctctgtaatgtacagaggcattaattttccttgaacacacctactatacccagggaaacagcaacatagggagcacagagaactctgtgcattcagtgagtccaggtaggaacctggacgcaatcagcattaccgctgctcagagcttactgggtttcttcaaaaaatccccaactgctactttttcaaaagtagcagttcctatccccaggccctcttctacttaggctgaattttaaaggtatttataaatctcattgtcattatgcagacattataggtgataataaatgcttcacatagcaccactgaaatgatcagactgatggttggtctgagaaaaagaggcccacctttcacttaaagggtgagccaagttgccaaaaggaggctcaagctgtgtaattaaatgaatataatgagaagactggagcctgacagaacttcactttcagtgtctattccatcatgaaagataaatcccctttaacattcgaatactcagggccaggaaatcttaactttgctcataagctaagtccaaatggtacattcaatgtgacatttatgaaagctaatattatattcttttactttaactgagtggaacatgattttgactcagactaaattttgtttaaaaaattagtctttgctggccaccttccaatggaaagcttttaaactaagggcaattaaattaaaaggagagaatgggctagttgggaacaatttaaagacgatgagaatcatttttaggttttctccttctactcttaccttctcgttatatttgcaaagcaatcttaaggctacctactgtgattgttcatccattcatctacttattgatattttaaaaatctgactctcagtattaatacccattttgttgatctaaaaaattacgaagtataagaattatatattcctgatgatgctatttctttaaaaagagttaattttgaaaactgaaacaatgactaaaacaggggtctgcaaactatagcccatggaccaaatccatccacagcctgttttttaaaataaagttttattggaacacagccatgcccatttgcttatgtactacctatggttactttctgttataatggcagcgttgaatagttgagacacacagaccatagggtgcacaaacagaaaatatggccctttacagaaaaactttgctgactccccatctagaacaagtacgcatattcaaactacaccttctgactgaagattgtgacaacaaccaaaaatctgcaaatgattttaatactgctacagtttgacaaaaacaagtttcaatgtttttgtcccctcaaaatctcatgtgttagaaatttaacccccaatgcaacagtgttagaagatggggtctaatgggaggtgtttaggttatgagagctccactctcatgaatgaattaaggccactataaaatgggtttgcagaagtggttctcattctcacgctcttctgccatgtgaggaacagttctcctcccctctggaggatgaagcattcaaggtgccatcttggaggggaaacccggacctcaccagacaccaaaactttgatcttggaatttctggcctccagaactatgagaaataaatttctttctttataaaattacccagtcttaggtattctgtaacagcagcacaaaacagattaagaaaaacacctcagacatacataaaaatccagatacctgattgtctcataggtttatttcttgcctatgaggtatctgcctaaaaacacgttgtctcccttaaatctatctacaaaccttcctcaccaaagcaatgccattgatttagatgttcccaaattaggaattagaattccaaagttacatgaaactgatggccaaattctaaatgtaaatacatcagaaaattaagcaaatgagcattccattgatcggtatagtcaaagtacaaagttgagattctgacacgtaatggcaaaaaagaagaaacgactctaagcactagatattcttaccatacataatgcaagtagatagatactagatgttagatattagagcaggcagtgtttactgaataaccccactgtgtatggcactatactgtatatgttgtaaaacacaggaaaaacaaggttccagttttcaaagcttctctagaaccaaaaaccatcaccaatattgcacgatattctttcatattatgaacttaaattaaaaaatatctaaaaattaggccgggtgtggtggctcaagcctgtaatcctaacactttgggaggctgaggcaggaggatcacttgtgtccaggagtttgagaccagccctggaaacatagtgagaacctaactttaaaaaaaaaaaaaagtatctaaaaattattaaaatatattcaagcaactccaaatgttgtttcagttatagtcaatgtattcactatacaattttaaagttcttttaatttatattacttaatggataatttccaaaggaatcctatcttaccttctcagtcttagaattcctggtattatttgtttgaacacagagattttagaaaatctggaccatggcagcacagaagttagtggcaaccatgtgagagaaacagtcttcaaaatgttctttggtcaagtgatatggctgggacaaggggattcagacctgacttgcaattaggctaagacaccttgacttatgtaataatgggcatggtaaaaatgaattgctgaaactccctgtaacctattcacattcttgtaggcttaggaagcagtgagcaccaaagagatgggagaaagaaaagcaactggctctcctatggcatcagttttcagagcagccaaagctctgggtatagtgcttcaggtagatcaatgtaactcaccagcagataaatgtgaaaatttagccctatagctgttttgatgaactacattgagtaaaatccattagttaggtgaaaagtaaaggaatgtggcaaataaaattacctgatacagactcagtattcaactttttccagcagatgcagtttataactccagtgctgtcatccactgcaagagaaaagcaaaagggtataagagagatttgggcaaggctggtgaattagcatgctgtcattgcattcagccatactgaaagatgacctctttcaatagcctggagaagcaaatcccttatcaaactctccttccacctttgaaacaacctctcactacatacgagtataaactgcttgtctgcacaagtcaatgtaatacacaagcccagtgggatatggtcagcatttcacttatcctacctcaaggtactaacgattagtaccctcaagggtaccctcatgatgctggtctacacctctctactaaaaatggtggccttgggaagttaagtgcaaaaactgaatgactgctcacatagaaaatcagcctttctctcccaccctgaaacaagagagcatcgtgtggagtgtggttagaggcacaggcacttagggcgcagccttctgtcacagtctctttgctagtgtgctgacttcccaagacaaagtgttccaagtcatctggcctgggtttctctttgtgaaagatcttttgcccagtcctcaccaccgcaggggctgtaaggaaagccaagcacatcacagaagggcaccgttttattttcattatagaaaataattatatcctggccacaaaaacagtactagtctggcttatgttattcctggcttatctcatttttgcaaaaaatcaaacaattcccattgcagttatatttacaactacagaggaatttggagatgtttgctagggaataacaggcattttctctttgcctaatttccgacaaactcagaacagaggttgctaagcatggggtcagtgggtctctaaatttaaaaaaaaatcatcaactagactgttgtaaaagcacacacaatcctgaagaaatctaaggcaaaatttgttactgctggcctaaatctatgctgaagaaaaagccaaaaagagtacttcctatactaaaataaatcctagatgggtttcattttattaaatataaaaaaggtaaacttaagatgagaagaagatatgggtgaatacctttaaccctggacttacagtgggtggggtgagacttctttaagcagaatcttaaaatcagaactcattaaagaaagtctgataagtctaaccacctaaaaactaatactggatagcaatattccaaatgatagggttaatgatttaatatataaagagctcataggctggacatggtggctcatgcctataatcccagcactttgggaagccaaggcaggaggatcacttgagcctaggagtttgagaccagcctgggcaacacagggagaccccgtctctaccaaaaaaaaatttttaaattagccaggcttggtggtatgtgcctgtagtcccagctacttgggaggctgaggtgggagaattgcttgagcccaggagttcaaggctgcagtgagccatgatcatgccactgcactccagcctgggcaacagaatgaaaccttgtttcaaaaaataaaaaataaataaagagctcatataaattaataagaaaaagatcaacatcacaagagaaaaagtggcaaagaaaagaatatgcgattcatggaagatctaaaaatggccaataaaaatacatcagtataagttcactagttaccattaagaaaagcaagtatacataatttatcaacaatgaaattgacaaatattaaaaatactgataccctcatatgtcgatagtgggagtataaattagtaacacatttctaaaatttaaatcttaatgagcaagtttgtaaacaggcatcggattgtgaaatgtaagccaggtgcggtggcacatgcctgctacttggggggctgaggcaggattgcttgagtccaagagtttggggctgcagtgtgctatgattgtgcctgtgatagccactgcactccagcctgggcaacacagtgagaccctgcctcttaaaaaaagttgtttttaaatgtatatatcctttgacttaacaattacttccagataaaacaaaaacaagtacacagatacatacatctatgtaaggctgttcactgtagtattctttataatactgacacttggaaatacctaaatgtttataaatatggaattggttaaaaaaattacaatgacgtagtatatgagaataaaaagatatacatggctcattgtaaaatagaaatatataatccaatttatgtgcaacattaaacagtgtattttgacagaaatgattttaagactttaaatactaagagcagtttctcttggagtgtggggaaggaaccccacattcaatgtatacgttgactgtaagcctaatttcagaaacactgagaaataaatatgcataatagtactaaggaaataggcatttctatatttctttgatactgggaacatgtttagaatgaggaaggatgttcacccaaacactgacattgttttgcctgatttatagtgtttcatatgatttttatatacttcattaaaattatctctagtttgaaattttattttataatgagtaaataccattttaagaatccaaaaaatgaataaggacattttgcgttaaaaaaatgcatggcacttccaggcacaccacttctctgtaggtgaaaagcttgatttatagtataatagaaagttaaaaaaaaaaaaattagcaggccaggagcagtggctcacgcctgtaatctcagcactttgggaggccgaggtgggcagatcacttgaggccaggagttcgagaccagcctggccaacatggtgaaactacaactctactaaaaatacaaaaattagctgggtgtggtggtaagcacctgtagtcccagctactcagaaggctgaggcaggagaatcacttgaacccgggaggcgggggttgcagtgagccaagatcacaccactgcactccagcgtgggccacagagcgagactccatctcaaaaaaaaaaaaaaaattagcacatgaacatttgtcctagagaatgcgaggtcattctggtcttgactgtagccttccaatattctaggtctaagctcgagttgctaccaagtgttctgtgcactctgggcactgtcaccaacccccggacttcccagtttgtgacctctcccagcagaccctgtgccttggtgcccagaggtctggctgctggaatgcccctgaatggaggcacccttgcagtgctgcacaatgtcctcagcagctacacagtaccgcctgggccgctggccttgtttcagctgcgggatgagtcagtgcgagcaggaagcacccccagcacaggcctgcggtgagtcaggggaagcagaacccagaacagcagggagcggccacctggcagatggcccaaaagccatattgtgcctgaggacagcaaggagaggggcagttctccacaagaattaaagttgcaaaagcctctctactctcaataatttcagcagtcagatgctttttattttcccaaagcccacagatgtttcatgctcctcagacactcactcagagggaaatgcttactggagaagaggcaatcatagtgccttaatctttttataatgggaaaagaggttaagtgaagctcctttagacacaggcttaatatctagcctggttctagggccaggattttaaagtcctcaaacagtctcatttatttgatctgaaaaacagaaaactaaaaatcaaatgcagttaatttttttttttttggtgggtgggggatggaagaaaggaggaggagagaaaaatcaaactgagttatatggagaccacagaacacactggagtcagtaaacagaatggacccacaaatctccatcagtggaatcttgagtaagttactaagccttagttttctcatctacaaaatggaaataatacctgtactttctgtttcaaaagactagagggagaataatatgaaattatgcatataaaagtgctttacaaactgaaagacgctattatttcgttgttggcatttggagaggaagcactgtactatataccacagtgtactgcccatagctggatacactgtaggaacttagtaaatatttgttgagttgtctggagaaaaaaaggaccaatatctttggtaaaataaagcagagaagagattcagtatgggaatttctgacaggatgatccttttcagaatcaaaaaaaaaaaatatatatatatatgtatatatatgtatatatgtatatatatgtatatatgtatatatgtatatatatgtatatatatgtatatatgtatatatgtatatatatgtatatatgtatatatatgtgtgtgtgtatatgtatatatgtatatatgtatatatatgtacatatatatgtacatatatatatgctgagaaaaagcagaaaaaataagcttttatttttcacatgttattttattaaaagcacaagataatactcttcaggaaaatgaatacatgtaaagaaatgcaataatattgtatctacaaattatcaatcatgcagggactgccaatgaaacgctcttggtcacaaagttcaactgccttctatctttcctcaagaagagtaagaatacaaatccaaggcacagcacaaaaagtgacaatgtcaatttcagcaaaggtttggaatttaaagttaagtttcccacaaaatatctagcttgggctcttgattatagagaagcttggagttgtacaaggcaatgtattaaatgcttaaaaatcaactcaatgaaaaaagaaagacctattacactaaaatcacatttgagcaattctctggtgtccaaaatatagaaaccctttattaagcttccatcatgagggaaaataaactttctgataatgggtatttacccctttgggtatcaaaaggctttttgttaactgttctggatataaatattttaaaattatttttcacatcttcctgtgttgttaaagaatctactttaacattaatctggtcttcgctttttaaagtgatccacataaccacatattaccacgctttgctatttacagatataccctttggcatcaggtgcccccctgcccgtccatcgatgctcatagggggctgtattttaattcttccacttcttagcacctcagcagctgtcacttcactgaattcatcagtatcattcctacccgttgcctcattttattcttagcccgtgtctggggctataaggggcaccccatagagaaagtacatgcccttagtgagggtccccagctactctaaatggctggggctgctgaaatccaactttcagcccagaagggtcagccttctacatcaacttcatttcagacacaattgttcttacctccataactgtagaaagcatctctttctctcactccaatgacagttcccaagacatctacctgttttattggatgtccattgtacaaaaatacacctaaaatttaaaaaaagcaaagtcgacataatgtatgattacattttctgcttcaataaatcttaacttgtaggggggaagggagtgtaaaaaaatcaatccatgctgtttgctgaaattctagacttaagaatcagtccttgacaaatgacaacgccccaagaaattccaatgtcttttcctcacaggtcctaagtagaaagcttggcattaaagcttgcactagacgggagaaaaccaacgctgtccaactagatttggttaatgcaccctgttctgaatgctcacaaggggcctgaaaacagtcattatactgggggaccaaacacaggactatatttgaagcaactagaaggaaagagagaggaaaccatgagaaaggcttctttggctttttttttttttcaaacaagtgcttttctaagaaaccagtcatgatttctttgaactggcaatagcattttttttaaaaaaaaacagtaagtaggttacaaaacgctaccctttggggccaggttacaaccccaaaacttctctttttaaaactctgttttcaaaacctaggctacagatggtggcaggcaacttcctgccagaggagaaagctgagagggggaacctacccactgatacccagaggcttttttctgacttggggccaggacacagaggggctgctcagagcagggagtccctgatggtcccagggctgtcctggctcctgcaggtcttcccttctgcctgtcccccaataacctaacccgagctccccacttcaccttaagctacacgcactgtgttcctgtcacctgcagctaaagagtcctgcccaatctcttttccagcctcttccccccgcccccatgacggctaaattctttactttcagaaacaggttataaactttcatatggtgatttcctttttcttttttttaaattagacatgggcatctcactttgttgcccaggctggtcttgaactcccggcctcaagcgatcctcccaccttggtgtctcaaagtgctgggagccaccacacccagtcaagtcctttttaaaataaatatacgaattctaaattaagaaacaatgatcacctcaggcatttggccattcttcccctcacatcaagcatagtcacagcttctattctgtccattcatggggggacctgtggcctgaatcccgacgccccttataacccccagactggcctctgctgatggctctgtttcccttgtagacaaagggactgagaaagagtccaaagaatgaacaaggagcttctaagcctcagttacagagagacaccaagggagtgagacgtggttttaagaaataagaggtggcaaatttagccaaaagcaagaccctctccctccacagaggcacgcttcaagagataacctggtggttggagattgtcctcaggaccaccttgcaggcatgagctgaagatggcaggaacaaggagggaaggagcctgggtcactgtgtcacccccaaaaagagagtcacctccatccaggaaaacttggattgaatggagacaaagtggttccagtctcaactcctggtctcaagcagaagcccaactaatttttaaaatttttcatagagatggggtctctccctgtcgcccatgctggcctcaaactcttggcctcccaaagcactagaattataggtgtgagccactgcacccaggccataaaattttaagatgtagccagttccaactggcttctcccaagttctcacaattgaaacttagtcttttccataacaccattgatgagatcttcagtcccctgcccctgcctgcctgcactgaccaaacgcaaaaggatagggagcctgcagagaagggagatccctgtgtcctgtgtagtcaagggcaggcttccttatggcagaagcaaactttaaactaggaaaatgagcctcacccagggatgccctctactgccgtacaccccaccactcagccttggagtgcctgtgtgcagagcagggctgaggcatggtgctgctttggtggtctaggtttgctgcagggccaggtggcctgagctccaggcaggatctctggctgcactcagccctttctgcctccccaaatgctctatatcactatttgtacactgagcagagtaaagttagagagaactgttttatagaatagggctggcccccgctcccctggcctacgtgatggtccttcctggctgccaggtacttgtttgtattagagacagacactccacagggtctgttgtggcccacagcacataggcaatcagaggcagaaagcagagctgtttggacccacagagggccggctgtctgccactgaaatgtctttccagttggttgagaagcagcaggatgctctgctggtgatgtctgaaagtcccaggattctttgggtctccaaggagatcctagcatataccactgtcgtggttttaataaagagcaaaaacactttcagatggggagaagagtggaacaaaaggtattcttcctgggttgaagtctgggggaaaggcattgagaagactgggctaatggcacaaaccaatgaagtactcaagtcacctgtgatggaggccagtcatccaatggtatcaactttgtatgtggcaacacttaataaaaatctgaacaggtcttcacttgtggacacagtagactttcttgaaaaaggacagaaaagtgagccctgtgaattttcatctcacggactgacaacaatgacttgcctttaaggacagtcactcaagatgaagatgcaacaaaacccttccagttccaagtggctgatgaaaaaaaaaaaatcttaaaagcatcacagaacaacggagaaagagatcagaagactataacagatagtttgaattttaaaactcagagaaaagcaactgaggaggaaatacactgcttagaaagaagaaacttctccaagtatatagaaacgtgaactatacgtatcagatgcacagcatctacaaaaagatggctgaagacatggaaaaaagaattagagagccattttcttgtatcaaagtgatcttctataagaagagagctcaggaaagttggatggctgctctgtcaactgagagaaagcttaatgaactaagaaaagaaaatggtaacaaatactagataacagagctcatgttccagcctttcccaaggcccttgtgttcctgctgttccacatgcagcccacagaggcctaaaagcatcagaggaccccctggatcatcaggcccccaagaaggaggagggtcaagctataagggttcagggatctagggtcacaggcaggttgactcggatttcaagcagccaaccctgaacatccacaaccacagcaagacatttgactgttttctctttttaaaagtacttttgattgctctctttttagtttaactgctgttatttaatcgatgctatgttatttatgtttgacagcattaaaacacctaagataatctttttcaaccagatttaatataattcttatgaatatattatttccacttcattgtacccactagaataataggataagtattatatgctgatttaaataaaagagtcactattatttaacccatcattaaagtttgacatggatagagatatttaaaacaataaatacgacttctgtatgttatgagctattattaaaaatacatatatatatatatatatatatatatatatatatatatattttttttttttttttttgagacagggtcttgctctgttgtccagactggaaggcagtggtacaatcacagcttactgcagccttgaccttccaggctaaagtgattctcccacctcagcctcctgactaactgggaccataggtactgctttttaaaactcagacacggggtctcactttgttgcccaggctggtcttgaactctgggctcaagtgatcctcccgccttggcctcccaaagtgctgggattacaggcatgagccactgtacctgggatactttttttttaatgcaaaaaaaacccaaaaacaaaacaaaacaaaaagaacccacacaaatctaaataccaccacaatcaaatttcacagtatttttcttagttcaactctaaattcaaattttgaggagctgacgttttgcaatcattttgcaatgcaattctgatgctaactactcaaagataggttaaatttcacaggtgaagggcacagtccccaacaatactgccctcatttgagtcatgagtcccaagttttgtgagagtcctcaggccaactgcacttctgaccaactggttataaatttgggggtccccaacactccctcaggtttgataatttgctagaatgactcacaggactcaggaaggtgctatacttatgattatagttttatccatgaaggatccaaatcagggccagccaaatgaagagatgctaaggcagggtctgggagggcacaaacacaaagcttctgtgtccttgacaccttgccccctgacacaccaacacatgattatcaactagggaagctcatctgaccctcagtgtccagagtttttactgaggtctcataaggtaggcacaattaactgaatgattggccacataactgaactcaatctccagccccactcccttcccaaagggtcagactgatatgatctggctcaaaacccccaactctctaattgaacagttggtcttttaggcatagacagccccaccccaaactatctagggatccagcatgaaccacctgattcgcataaattcaagtgtggttcgagagggcaccatgaataatgatgacgctcctatcactcaggaaactataataatttagatgttaccctgcaggaaccaagggcaaaggtcagtgaaattctttatcacacaacacattcatttcatattttatcatttttggggtttgtctttgttattttgtttaagatattctttgctgtttaaacaatcctaaattttatgtagtcaaaagttttgcctttatagtaaatggaaccaaacacaacaacaaaacaaaaacctaggagtggaattccccaccccccagaacactatggtatagtctaaagcagtggtccccaacctttttgacaccggttttgtagaagacaatttttccggggatgggggttgggggaacggtttggggatgaaactgttccacctcagatcatgaggcattagattatcctaaggagtgtgcaactagatccctcacacgtgcagttcacaataaggtttgcgctcctaaaagaatgtaatgccgctgctgatgtgacaggatgtggggctcaggcagtaatgctcactggccaaccactcacttcctgctgtgtggcccagttcctaatggccatgtaccagtagtggtctgtggtcccaggggttgggggccccaggtctaaaagtatccaatctgtcagctgatgtctgctttaaccgtgaggtttcatttttaaaacaccttggaaacattctcaccagtgataaatcaaagatcactggtcctgtttttgttggtttgtttttaacacatcataaagtcttttgcctacaggtagagttaagcccctgtcatgtccttggtacctgttttctcacctgcagaagatcattaagcaaggctagaatttggtgtgaattaatttcttcctgaagagatgagctatgaagaaaaccagactggaaaatggaaaactgtggaggaggttggctgccttccaagggaaaacacagaccatttccaacaataattaggaaataaaggtgtggcgaaaaatctgtacaaaaggcattagcataaggtcatccaaatatatttgtacatttaactggaaacaaacaaaaccttatctcattaaaactgtggatgcttgagattcttgactacttctaactcatagtttgttattcagaaggaccttgactggaaagcttcactcaaaatagcaaagaaagtttaaccaaacttctcaaatagcacagtaaacatgtggctatttgtgaattattacacagctacgtgaattatttaaatccaccccaaactatacttgttatatttttaggtaagataagcctatctctagtagccactattctaatacaaaaaaaaaaaaagaaaatttaaactttacatgtataatgccttgttgcttcaactgctatttctatttgagggcccactatatgccaggcactgttctaagccctgggattacaaaggtgaacaagacagatgatgttcttcctctcagggagtttataatattttgattctgcttaattcaaaagaaaacaaaccccctttacatatcaggaatcaaaagattccattacacagggttaagctccatttttacaaagaaacccagactttgcagaaggtgagtcacatgcccggaccaggtaagtggcacatttaggaaaggagccaggcctaggaatatctggcccagcgatctctccaacaggagcagggccaaagaaaaacaaatgagcatttttaagcatgaaagaccctaaatggaggtaaaaaccccagtacaaaagttactcccccaaacacctactaaaaaaaaaaaaaaaaaaaaaaagatttagactgttttttttaccttgcaaataaatgaactcatgcgaaggtccaggctaggtccctttcaaagcctgcagcagggaaggctctcctaaaagcctctaatcccagctttctgagactttgggaaagggtggcagatgcagcccagggcatcccagggtggctagccacatacctggcacctggcgggactccttcatgtccaggatatccctgatgtagagttttgcaaaggctagaaacacaggatccaaaccccacaagagggaaggggtctcctcttcacaccggctggatccaggctgcatcaagaggcagggctgtggcttccagctaactctgaaaggttctgcatcactgagtcaagcatctagatgggacacagaaatgaggatgcaatgcgtttaacgtgggtcaaagtggcacggccctgacgctgctcccaggtgggcgtccaggactccaggaggggtgaacgcagggatccagggccctgtcaaactccatgccacggggcgtgttaagaggcgttcctcacgtcaggacgcctgcgttccttacggctctcccgctgttctccttcccacaaagcaccaacttcggaacggctaaacatcaactttcactctgggaagatacgtctgtacaggcgtagcagaaaccgcttggggtcccgggaggaacgggcgccctcgcagccctgcacgtgttggggcatagtggatgggtctgactgtcgctctgccctaaactttccgcttttggggatgagccaagaaaaggaggaaaaaagatactaaaaaatggacccacttgtagcccctcccgccgcctgcagctccaggagccctgagacctggcccttccggcgctcggagccgctggcggcgacgaccccgcccggcgcaggagcagttggctgaggtcgtctctggagttccggcctgagcccgccccctgccccgccagggaccaaccccggtctccccgccagcgcattt

SEQ ID NO: 2777 - DNA, 87143 bp, Homo sapiens
  source 1..87143: mol_type = genomic DNA
ttttgccggatgttgttgtatgtccgagagacacgtgaggttctgctacgtcattaccaggcacgcgcaggaaacatggcggcggcgggtgttgtgagcgggaaggtaggtaacggcctccaggaagacctcggcttttctctgggacggggatgcttttgctccctggcagctggttgggggagggacacgagggactttctgtgtccggacaacccgtggcgtctgtaggagaagactgggtggtaccagctggtttcccgagaatgccagttcagccgcggagttatagagccggctactgctccaaggccagctaggcctcggcgctcttctgccccagagcagagaggcttttattcgtattacctttactaagggacaggtggctctctagttccttttttcccccgattcactgtttcttgactctagttctttatgtctactcttctgactccagcgtcttttctctctttgaagcgttaacccgacttgcctctgtcttctttgctacagtttggtgaagatgtttatgcttccttcgggaggagctgaatagatgctaggcagctagctgtgcgcttagaagaaacgagtgtattgggtctgtttttaccaagctgctgagttggttggtggttgtgagcagcaggacgtgtttcctgagagaaatggagatttacaccatcctgtgcttgtctaggaaggcgtccaaatatttatttcctaggcatttcagtaggagtattggtcatgctggtttacggaggtggtcagtgacacgcctaatttcgttggaaactagaattacgtgcggagatttcgtcgaatagtgcctattcgcgttccgagggcacatcttatgcatagttagggctatcagctttatgatatgccaccgatagtatttcccagtgcaggagtatttcataaacagctggaatcaactgaagtgactcatcgaacactaatggttgtttactcattgcagatagcgtcctctgttccttgagtttcactcatgtctccctgttgctttccctaccccattttgaattatttgacagcgtttgtggtttggtgtttggagtattagactaggcggctgaatgacaaatatgggcttggttttgctgttaatctgaagtatgaccttggaaaattgggcaattgtgacttttgtcttttcgcgttctttatctgtagaatggaggagatgccaatcattatttcttgtattggagttgttagggttatataaatttttttttaaaaaaacataaaattacacacttgtacctactggctcttttaaaggataggtgggcatccttttttggattattcgtgctccttggttgtcttgtcagtttttttctttttatattcagggtggatgctgatatactgcttgacttactgcgtatttgaagattatcctgtttgattttccatctaaactgatccaggctgggacttttcaagaggggatcccttccgtttaaacatctccctctttcaggtttggattgattttgaaagaatccttgaggcaatgaagcagagttgtgaaatgaaaaacatttttcactctttgcagccactacctttcatagtctgacttcttaaagtgagacttatatttagtaattctgcttcataacctcatttattctcattcactgcaaattcacatctattgccatcactccactgaaactagttttccatgccaaaagctgctcctctcccaagtaatactatcatgaccaacaaaacccacttgttcttctctcagtaagttcagatctggtttaatggcatcatctttcacctggttgcatgttaaacatacttggaggcattcattcctataacactctctaatcaataaccatgtcctaccagttttaccttaagaggtttcttaaatttactgcatcttctttactatcagcgcatagttcaggcttttagtctgcttctattcttgatttcttggctgattttactccttttctacagtctctgcccttaatcttctctacaccaccactggagttatttttctaatgcgcaaacctgataatctcttgatttaaaaagcaaatgaaaactcttcacttttttatcgtcagcataataataataataatgaaagctggttaatgtaacataaaaagacatgatacctttatgcttccctacttcctaatcttttttctttaggaaaggggatggggagaaaatgtgtgtgtgtgtttatttattcatctcccctctcccttcaagttttagctaagagttctagtttagaaatccaggggagtgaatgttaaccaaggctcacaaaaatcactcgtgatactttttaataaaagtacagatggtgggctaccagctctgttgaattagagtctctcagtgtctccacctaggatgtaacttttcttaaaactctacttgctttgaacttggagtttcggaaagtgatggaggaagttaatctctgtcttgtagggaagcagcaaaaggtaatggttaagagcttggtctctgaaaccaaactagtttcagaaattatctccacacatttacaagcgacttcagtaaaattacttaacctctctgtgcttcagtatcctcatctgtgatatgataacagtacctactttattcttggtatgaggattaatgagtaaatatattagaaactgtagactgaactaatcatcatgaggtcagatcctgaaatgtttcatctgcccctaacatagattctggcacataataggtattcagtgaagaggaagaagcaagaaggtatgagaaaatgaggaaccaggtgccgtggctcaggcctgtaatcccagcactttgggaggctgaggtgggaggatcacttgagctcaggagttcaagaccagcttgggcaacataactagaccctgtctctatgaaaaataaaaaaattagctagttgtggtgacatgtgcctgttgtcccagctacttgggaggctgaggtgggaagattgcctgagcctgggacttggaggctgcagtgagctatgatggtgctactgcactccagcttgggtgacagaccaagaccctgtctcaaaaaaaaaaaaaaaaaaagaaaagaaaaagaaaatgaggagggattagagtgggagaaatgggtccattaatagctcttttgtttcagagttgtaaaatcctattgtagtacacttcattcactctaggttttcctgttagtgtattagaatttctttctattgaaaattactggccgggcacggtggctcatgcttgtaatcatcactttgggaggctgaggtgggtggattacttgaggtcgggagtttgagaccagcctggccagcatggtgaaactctgtctttactaaaaatacaaaagccgggcatggtggtacacgcctgtagtcccaggtactcaggaggctaaggcaggagaatcgcttgaaaccagtgcagtgagctgagattgtgccacttgttcagactgggcgaagggcatactgtgtttcaaaaaatgaaaaagaaaattacttgaaacaatagggaaatcagctgtttttttttcttaattagaatttgtgatgtcatttttagtaacaatttattttgtagcttaaaattggccctaaccaattctttttaaatatgctcatagtcctataaaatttttgtgctttagaaagatgaatattcttagtatctagattttcctggagacttgttttcctagactggatcttttaacatggtagttaactagggtataataggagtatgtcttatttttaaatttttctggcattctttagttcaacaaacgttttagtacctcctatgtgctgagttctttggatacaagggtggttaaacacagacttgtattattattattattattgttaatttatttttgggacagtcttgctctgtcacccaggctggagtgcagtggtgtgatcatggttcattgcagcgctgactgtgtatctcctccaactcttaaattattcacgtctcctatctgacttcgcttggcacaccaatatccttgagaagcaataatagttctgccagttgctcttccttgagagttgtaccattctctatatctcaaaacattcttcacttcagactatctgtgatgtattgcccttacaaccacctgtattgtgcattttttttagttccatagtcattactcattaacacatcccaaataaaactcagctttcttctttctgttctccctctcagtaaataacctcatctacacagttttgtccttgactgttctccccttcacctctcacatctaatcagtcatgaagtcttgtcattttgatcttctaaatatctttctaagccatctgcctttcctcatccccactaccattgccttagttcaagcaaccatgagtctctccctctctggattactgcagctgttcgttcttggccctgcagccactttattggcttagaaaaggcaaatttctagttgcgtttgtctgtcttcaggataaatttcaaactcctaaattctttagcatggcttatgcagccctttatgatctgatctggtctctgtttttgtttctaaactatttagactctactctctggtatttgggtttcaatcatgcagtgaactactgctctgtataaaatatatcctctgctaagaacatatatcctctgcttccctataccctctactaattaaaattgccattatttagatctcagtttatatgtcgctctaagtaagttttcctgattctcactctgcctgagcctcctaaatctaggtaagatagcatttattagggcttgctgtggcagcctgttggtacaattacatgttgtaattgtctgttttcttgtcatcccattagattgtaactgctgtggaggcagtgactgaatcttacttatttacacctagtagcttgctctgtacctggcacatggtaggcgtttactgtatatttattgaagaagtaactgaaaatggtacctcattcaggattctctgcattcctctattacactctactatatacattgatttactggcttacataatactgctagtttagtcagacacttttccttgtgtgtgtttttgccactgacaccttttatttccagcatgtggttggtgctcataaatgtgctgaatgcatgagtaaagaaacttctaaatcagattaagtggaatggagagtagttcaaagaatttgggcaggctattgcttatgttcttttctgaaggatttagtagaagttatttgcagagagaaaggataaaagggtgttccaggtagatggaacagaatacacctgaaaaaaggtacaaagcttttgggtaacagagttcacaatggcccaaggcagaaatgttttatgtgttggggagtatcaggaagtatagcctcactgtagaggtaaagggtgaagtcagaagatttttaagcccctgtgtggtataaccagatggacattttgtaaaggttagtttgggcagtggttatacattatgcaccttaggcagattattggaaggtgactagatcagaagaagagagatcagaatgttattttagtgacttaggctagaaatgataaggggccagtgtcagaggagaaggttcgagggacttaggttatagggtctggatggtgaaagaagcatttagaataagtgggtggatgagatatctttgacagaattgggaatatagaagaagagcaggtttagatagaacacatgagattaagatgccttattgaaatggagataccaagtaggtgcttagatatttgggtgtggagcccattaggatgctcagtctcgcatttcctggggatgctttctggaaccatatgctcaaattatcatctgtatgccaaatagttttgaaagaaactgaacttttgtaccttttttggttgttatattagcctgtaagttcacataattgctaaagttaagaatgcatgttgtgtatgataggtgatgggtttccaagtttggagaatgatttagggcaataattttaccctgaacttactgctacatttaaaatatttgggttgaatttttcctttatcttccatttttggaaataaataaaaattataataatcataatataagtaaaaattcagtattaagtgtagggacagtataaaaaattactactgtattgtgaaacttccttattttttccagctctttgtgtcaggaaggatgttcttgagttggattgtgcaaaagttcattctgtctaaaagttgaatttatctgtttttctgcctcatttttgctttttaattaaaacttttgctaaattagaggtgagaaaatttattctaaaatgtttgctgtggtcaccagaactcttttaataaggtatatctgacatagctcctttgctagaggagaaaaacaaaatacagtttctgttgctttcagcaggccatcattggaagttttataaatgtacttatctgcttgggcatcttagcaaatatttaagaataaataagagcctggagggcatgagacatttttatcccaaaaggaaaactttcctccttttttttgtagtatttttacacttagaatattccttctttaccttttcaataattttgccaggtacagacaagcaaggaactctaataccttttaatttctctgttctttatgatgtctggcacataattgcttcataaaagtttgttgaattgaattttatacagtcagtttagcaccaccaagtggcaagtctttgaatgctcttgatatattttgcttcctatgaacacctgattcccagctaagtgagggtatgattgttaatttttttttgaggcaggactaatttctttctttttagtgagaatgtcctcatgtatgtatgtatttatttttaattaggtttttactgtttacaacaatggactttctatgtaaattattttttatacagctttttttttttttttttttgccctgagacatggccttggtccgtggcccaggctagagtgtagtgtgtgatctcggcttactgcagcctccgcctcctgggctctagtgatcctcccacttcagcctcctgagtagctgggactaaaggcatgcaccatcacacccagctagtttttgtattttttgtagagatggagtgttgccgtgttgctccgtctgcttagaactcttggcctcaagtgatccgctcaccttggcctcctaaagttctgggattacaggtgaggcactgtacctggcctatacagctatttttgagatacaattgatatgatagaccacatgtatttagagtatacaactttgacatttgtgtacaccatgaacccatgaacacaattaagataatgatgttttcaccacctctgttagttttctcgtgactcactgtaccatcactccatgtgtcctcaggcaaccactgagcattttttggtcactataaattagttttaattttctagaactttatataaatggaattatatagtatatactctgtttttgtatggctttctttattcaggataattattttgaaattcatggtgttgtatgtatcattagttttttttttatttccaaataatatccattgggccaggcacggtggctcacgcctgtaatcccagcactttgagaggctgaggcgggtggatcacgaggtaaggagttcgagaccagcctgaccaacatagtgaaaccttgtctctactaaaaatacaaaaattagctgggtgtggtggtatgtgcctgtaattccagctactcgggaggctgaggcaggagaattgcttgaacatgggaggcagaggttgcagtgagccgagattgtgccactgctctccagcctgggtgacagagcgagactgtctcgaaaaaaaaaccccacaaataatattcattgtatgggtataccacattttgtttatctagtcatgtgtttgatagacatttgggttatttccactttgactgttacaaataaagctgctcttaggccaggtgccgtggctcacacctgtaatcccagcactttgggaggccgaggtgggtggatcacctgaggccaggagttcaagaccagcctgaccaacatggagaaaccctgtctctactaaaaatacaaaactagctgggcatggtggtgcatgcctgtaatcccagctactcgggaggctgagacaggagaatcgcttgaattcaggaggcagaggttgcggtgagccaagatcttgccactgcacgccagcctgggcaacaagagcgaaactctgtctcgaaaaaataataaaacaaacaaataaataaaataaattaaagctgctctgagcattggtatatgtgttttatgaaaatatgctttcatttttcttgattggatacctgggaatggggtggctggatcatatatattagttgtgtgtgtagcattttaacacactgccaaattgttttccaaagtaggtgtagtgttttatatttccactggcagtgtatgaaagttccagttgcttcatatttttgcccatatttaatgtcagtcattttaattttagccattctaataggtgtgtaatagtgtttcattatggtttcagtttacatttctgtaatgactaatggtgttgagtatttttccatgtgcttatttgctgtccttgtatcttctttgatgaagtgtctgtttaaatcttctgcttattttttttcaaactgtgtttttttgtcactgagtttttagtgttctttttatgtcctggattttatattctggatacaaatccttttaatacaagttcatttgggtctttttaaaaaaattatttatttttattcatcttatataaaaggggggccaaatctaagaaaataatgttatgtcaaagtttgttttttaaagcataaactttcagagtttgttttaaggttaatacatagagtgctagctttttagtcacctgagaatcaggaaattcacttggacgtaattccctgtggtaacaaagaactatggcttcctatgggtttgtcaagctcctaggcttcattcagcctgaaattatacttttcttgttatgtataaattaaataaaatctatacaactgtctgttcttctgttgcctcacatcatgtctataaaaacagcatttaaagtttgcaggaaatagaattttggcctgttacaaagcaaacactttgtttctttaactcagaattctggaaatgcaatcaagttctagtattgtgactgccaaaatattttgtcatcagatattaatttttttcaagtgtctgactccatacaagaaaataataaaagtatcagaagttaactgtgattataaaaaaaaaaaaaaacaaaaaaaaaacaaaaaacttcagtgtccatagggttgttcctcatggtttgttaggatactcctgcctgatccaagtgcatcaggtctgagactgttctttgttccacgcttctatctgccagaagaatctttttaggtaaggaggctatcataggaggcaatggagcttctagctgttgtccaaggaatgaaagcaggcgcctccagctgagccacttcccatgaacataattcctgtaatcagtcaaaacactccatgggcctcttcaagggaagattccaaactcattccaaaagcaacttccattactccaaagagcgaaagagagaaggttcttatggtcagctgtagattcaacttcattatcacgttacagtggctgtccagattgatgaaaataatactttgtgaatcatcagtcagtaccgtaagctcctaagctgcattggagacatcgtcagctagtcggtagtagttttccatcagcaactctatctcctctgcatggtcagtcccagtactgctcttttcaaagactcgggggtcactccattttgatagagctcttctagcaactctttctcatccaggatctccaaaattgactctgaaaattttaatatctgtttctaactctaatagacttttgccattctgtagtaaaatgtggagtttgcttctgtctatagaagaatgtttggggtccaccaaagcttccagcgtcttgaggatcagtggctggaaaaggctaagtttcccctgaagggtgttgatccagtattgcaggagtgcttctatagctctaaactcaaaaaattaaagggtttctaacaagttgaccctctccagacaattgtgaagagagttcccggaacagccatcgctgtgagtttaaattatgataatctaatatcagaagacactctggagttatctcagctttcaaatactccattctcatgataatcatattatttctggctgtgatactcattacatagtgaaatctcaaatctctggcttgaagacctaactcttggtataactcagttttcttcctttcaaaagaagtaacatttctctgtcaaattttgtcatggtaaatactggggctatactggctagagtggtttgaaagacatcagaagttctaaaccagtgcatttcacctgccatgtggagccggcggggttcgcacagtgggccacccagctccttctgagcaggttggctgcacagccacaggcagtcgcagagtttttgttctgtcgcccaggctgaagtgcagtgatatgatcatagctcactacaaccttgaattcctgggctcaagtgatccttccacctcagcctcccaggtagctaggactacaggcatgtgccaccatgcctggctattttttttgttttgtggacgtggggtctagctgtgttgccgaggctggtcttgaactcctgccctcaaggcgatcctcctacctgggcctctgtattagttttcacattgctataaagaaatagctgaggccgggcgcagtggctcacgcctgtaatcctagcactttgggagaccgaggtgggtggatcgtgaggtcaggagatcgagaccatcttcggcaacatggtgaaaccccgtctctactaaaaatacaaaaattagccaggtgttgtggcgcgcgcctatagtcccaactacttgggaggctaaggcaggagaatcgcttgaacccgggaggcagagcttgtggtgagccaagattgtgccactgcactcagcctggtggcagagcaacactccatctcaaaaaaaaaaaaaaaaaaaaaaaagaaagaaatacctgagacttggtaatttatagataaagaggtttaattggctcatagttttacaggctgtacaggaagcatgatgctggcatctgctcagcttctgggaggcctcaggaaacttacattcatggtggaaggcaaagaacaagccaacacgtcacatagagcaggaggaagggggagggggaggtgctacacacttttaaacaaccagatctcatgagaactcactattgtgatgacagcatcaagagtggatggtgttaaaccgtgagaaaccacccccactattacctccccccaggccccacctccaacgttgggtattgtaattcaacatgagatttaggtggggacacagatccaaaccatatcattcctcttctggcccctcccaaatctccatttccttatcacatttcaaagtagaatcatactttcccagtagtccctcaaagtcttaactcatttccggcattaaatcagaagtccaaagtctcatctgagccaaggctagtcctttccacctgtgaggctgtaaaatgaaaaacaagttagttactcccaagattcaatggggttataggcattgggtaaatactcccattccaaaagggaaaaatcggccaaaagaaaggggctgtaggcacatgcaagcctgaaacccagcagggcagtcattaaatcttaaagctccaaaataatctcttttgacttcatgtcccacacccagggcacactgatgcaaggggtgggcacccaaggccttggacagctctgccctgtggcgttgcagggctcagcccctgtggctgctctcaagggctggtattgtgtgcctgtggcttttccaggctgagagtgcaagctcttggtggatttatcattctggggcctgaaggacagtggccctcttctcacagctccactaggcagtgctcttgtggaggcaccgatactacatttctcctcctcactgccctattagaggttcttcatgaggactctgcccctgcatcagggttctgctttgactaccaggcttttccatacatcctctgaattctaggcagagactctcaagcttcagctgttgcattctgtgcacctgcaggcttaacatcatgtggaaactgctatggcttatagcttgcaccttgtgggcctcaaaagggcccagcagcctgagctttacctgggcccttttgagtcacagctggagctggagtgtctgggatgcagggagcagtgtcctgaggttgtgcagggcagcagggccctaggcctggccaaggaaaccatttttccctcctatgcgttggtcctgtgatgggaatggctgctgcaaaggtctctgaaatgccttcaaggccttttccccattgtcttggctatcagcacttgcctttctggtagttatgcaaatttctgcggtgagtttgaattcctctcctgaaaatgggcttttctttattgccacatggccaggatgcaaattttctaaacttttatgtcctgcttaccttttaaatataagttccagtttcaggtcatttctttgcgtatgcatatgagcataggttgttagaaacagccaggccacatcttgaagactttgctgcttagaaatttcttccactggataccctaaatcatccatctcaagttccaagttccacagatccctagagcaggggcacagtgcagccaggctgtttgctaagacatagcaaaagtgacttttactccacttcccagtagttcctcatttccatctgagacctcctcagcctggccttcactctccgtatcactgccagtattttggtcacaaccgttcaaccagtctctaggaaattccaaactttccctcatcttcctatcttctgagccctccacactcttctgacctctgtctgttacccacttccaaagctgcacccacattttaaggtgtttttatagcaatgcccatttctgataccaattttctgtattagtcaatactcactgctataaagaaatatctgagactgggcaatttatagagaaaagaggtttaattggctcacagttcttcaagttgtaaaggaagtgtggtgctggcatctgctcaggttctagggaggactcaggaaacttacaatcatggcggaaggcaaagagcgagccaacacttcacatagagcaggaggaatagagagaggggaggtgccacatacttttaaacaaaatcagatctcaggagaactcactattgacatgacagcaccaagggagatggtgctaaactgagaaactgcccccataattccattacctcccaccaggccctgcctccaacattggggattacaatttaacatcaaatttgggcagggacacagatccaaaccataccaccctcccagagtgctgggattacaggcgtgagccactgcacctggccgagttgtgactttagtgtcttgaacatatgggatagacttaaaataatactttaatatccttcactactatttgtgttgttttgtggtcaattgtaattgattactttttttgttataggtcatattttcctggctcttagcatgccttagtggtaaattttttactggatgtcagatatgttgaattctctttttgggtgctagatatttttgtgttctgtaaaatactattgagttttgtgttagaaggcacttaagttgcttggagtcagttgggtacttttgggtcttgcttttaaactttgctaaatggtatcagcactgcatttagtatagaactaattttgcctcactgatgaggcaagggagtgctttgtgaattatgagatttcccactctgactggtgcaaacagttatgtgagcctgcagatagtttcttctaatagtttccctctcgccttgaagagtttactgacaaacatgcactgttccatactctgctgaatactcgaggaagactgcagatttcttgagttccctgtgtgttcttctcttttctctggtactttctcctgtgaactctagctgtattggcatcccctatttcccacatctctctcctcactggacaccttctgagttttctctccctttcccatagctgggaacacacaacataaagctagacaattgtattgctcacttcatttggttcctttctctcaatagtcactatccttcattgtttgctggggagtatcatgaaaactattgtttcacagattggtcagtatttttagtttagtttattattattattatttttctggtgggaggttaaatccagcctgtcattccatcttggccagaagtggaagtttttatatagggtttctttttcctttctgtttttggtggaattaatacctatctcttctgtacatcttttttccccttcaatcgtaggctgaatgtttgtgttccaaatttgttctctttgttgttatgaactcttaagatggttttttctcccaagattttaccatttccttcttgttggcctgcattaattctcttttctgttctgtaccttctgacaggcgacattatcagcaagatattcaagaattttaacagatggtatgtatttagagaatgtgccagtagatgtttggatagctgaaggtcatcatcatatacatagagtggttttataccagtttgtaatttgtattaaagtgtcttttttcttccttctcattgatagtctgtataatcttccaaaacaattgcattcctctcccccccaccttcttttgcagattcgcttggtgacaggtggtgctacttcctcaaatctttgatctgttcttccctttctttttctcaaggtatattttttcattgttgaatttgtatcatgttttccatcagacaaaattccttcagtacccttgagatttgatttagatcctatttaagactttacattttgtgtattagtccgttatcacactgctataaagaaatacctgagactaggtattttataaaggaaagaggtttaattgactcacggtttcgcatggctggggaggcctcaggaaacttcatggcagaaggcgaaggggaagcagaagcaaagcatgtcttacatggcggcaggagagagagagtgctcaggggaaactgccacttttaaaccataagaccttgtgagaactccctcactatcctgagaacagcatgggggaaactgtccttatgatccagtcacctcccactgggttcctccctcaacgtggggtttacaatttgagatgagatttgggtggggatacagtcaaaccgtatcattttgtgtttatcaccagtaatttttagcatttttgttgtaaaaattcatatagtgaaaatcatacttaccatatagctgaatgaatcataaggcaaacttgtaatcacagcttaggttaaaaaatagacctttgccaggagattgagaccatcctggctaacacggtgaaaccctgtctctactaaaaatacaaaaaaattagccaggcgtggtggtgtgtgcctgtagtcccagctacttgggaggctgaggcaggagaatggtgtgaacccgggaggcagagcttgcagtgagccaagatcgcaccactgcactccagcctgggtgacagagcgagactccatctcaaaaaaaaaaaaaaaaaaaaaaaaaagacgtttgccaataactccagatgaccttccacgtaccaccccttgtctcctaagaaacagttatcctaacttttatcataatcactttcttgcatttctttattagtagtagtattaaaacatagctattgtgtcttttttaaaaaatggttcttccatatcttctacttagtattactgggtttttaagagttttgtttttcttaatcagttgcaccttttgtcttgttattgtatgtggttttttttgggggggggtatcttgttcaaatttcaatttaaattcatttaatcaaatacattatttcttgattttaaaagattggaccatacagaaattatggttcaccctgcccccatactgccaaaccacccaacttgattttgacactatgtatcctttgagcagttttcgtattcattgttctctgccagatgaactggaagatgaaatgaaaacgtcatttatatccccattagagatgtattttagataagtttttgccatataatttgttcccttgtaaaatatctcaaattagtaagttgttaggcttgggggtcttatatagacttttagtaatatctcagatatggtctgggaaactgattaggctattccgtttttacatattgatgcctctgtatccctaaggtaacagtcatgagaatgtattgcctatacattcttttgctgttttagatgcatggtgctgattctttgtagaatttggcttcttatgggaggagtctccaacatgttgcatgtctctggtagtgtagacttttgtttaagtctttttcttcttttagccttcaatttgccagattcctgattgtaatttccattgacctttaccttcttgggatatatatttttttcttttttttcctgacttattttttttctactgttcctgtgagctcttcattttctctcaaatcttaggtagtagaaaggaagaaagggactgctgatgctctttctttgcttcctgtagtacagaggacctactcatgttcacagcactggtagttggtgaatactacagattgggatgcaaacagcacgtaggatattggaacaattttgtcagtgtccatatatgctgagccttaagttgatagcctttttcattatgtactctttgggcaaataaaacttgtagagtagacctttgagtctcagccccagagcagtggaagaaccttgagcaaatcacttgattttcttgcagttttttcagttacaagatgggaatgataatatctatctaactgaattttgagggtcagatgtgataacatagaaatgttttcgtaaagtaatgcgtaataaaaatattacatagcagataaaagcatttgaagctttcttttaaaattttttaaatttaatttttttaaatttattattttttttcttaagagatgggggtgggggggcatcttgctttactgcccaggatggtcttgaactcctggcctcaagtgatcctcctgccttggcctcccagtgtcctgggattacaggtgtgagacactgcggctgcccagaaccttttaatttttgcgttagagatcatgaataaaactagagtgaagaaattgaaagcttattctactaacaaatgttatgtgagatgaaattattcacatcataattgttccctgtaacaaaataatttttttgtgacaaatatgcatagagataacttttcaaatatcaattattacaattgataaacataagaagcagaatgttctatggcaggatgatactactcaggaatcaattcatgacagagtaattaagaaatatcttcattatatattattgaagttttagttggactttaaaaaatctagattttgcttttatttttaattggcacataataattgtacatatttatggggtacagtgtgataatctgatatatgtatataatgtgtaatcaaatcttagtatatttatcacttagaacatttattctttgtgttagaagcattcatgatctgctcttctatttgaaaatatacaataaattgttaattatatcatgtgatagtgctgtagaacgttagaatttattcttcctgtctagctgtactttagtattcattaaccaacctttgtctattcccctttccacaacccttctctgcctgtggtaactgctgttctactttctacttcgttgaagccaactgttttagcttccacgtaagagaacatgtggtatttatctttctgtggctggtgtattttacttaacatatatcctcaatgctcatccatgttactgcaaacgacaggatttttttcatttttatggcttaatagtataccattgtgcatatatgcaacattttctttctttcttttttttttgagacggagtttcgctcttcttgcccaggctggagtgcagtggcgtgacctcggctcaccgcagcctccatctcctgggttcaagcgattctcctgcctcagcctcctgagtagctggaattactggcatgtaccaccacgcatggcttattttgtatttttagtagagatggggtttctccatgttgatcaggctggtctggaactcccgacctcaagtgatctgcccacctcggcctcccaaagtggtgggattacaggtgtgagccaccatgcccggccaccacattttctttatccagtcatctgttgatggactcttagattgactccgtatcttggctattgtgaatagtgctgcagtaaacttgggagtgcttctttgacatgctgattttctttttttttttttgaaatatagtcaaaagtgggattactggatcatatgctaatttttttttctttttcttttttttttttttttgagatagagtctctttgttgctcaggctggagtgcagtaatgcaatcttgcctcactgcagcctcccagtttctgggttcaggcagttctcctacctcagcctcctgaatagctgggactacaagcatgtgccaccatgcctggctaattatttttatatttttttagagatagggtttcaccatgttgcccaggctggtcttgaactcctgagctcaagccatctgtccgccttggtctcccaaagtgttgggattacaggcttgagccatcatgcctggccactgtttttagttttttgaggaactttcatactgttttcagtagtgcttgtaccaatttacattcccaccagcagtgtataagagttatcttttctccatatcctcaccagcatttttttttttttttgtagttttgatgacaaaaaattagtcatcagttaattagcctttctgggatgagatggtatctcattgagattttgatttgtattttcttgctaattagtgatgttgaacatttttttcatatacctgttagccatttgtatgttttttttgtcatcgtcatttttaaatgtagatacagagtttatttgggccaagattgaggattgcaatccagtagcatagattcaagttgctctgaatataaacttcctgtatgtcttcttttgagagatacctatttagcttatttgcccattttgaaattggagtatttttttttctgttgaggttttcgactttcttgtatcttctggatattaaacccttgttggatgtatagtttgcaggtattttctcccattctataggttgtatcttcattttgttgcttgtttcctatgctatgcagaagttattttgatgtaatcttgtttgtctgtttttgctcttgttgccagtgcttttgcattcttctctgtaaaatctttgtcctgaccagtgccctgaataatttcctctagtagtttttgaaacattttcttgtagtagtttcatagttttggatcttacatttaagcttcaatcctttttgttttttttgagatggagtctcactatgttgcccgggctggagtgtagtggcgtgatctcaactcactgcaccctctgcttcccaggttcaagcgattcttctgcctcagcctcccgagtagttgggattacaggcacctaccaccatgcccagctgatttcttttgtatttttagtagagatggggtttcaccatgttggccaggctggtcttgaactcccagcctcaggtgagctgcctgacttggcctcccaaagtgctaggattacaagcatgagctaccatgcctagcctttcaatccattttgagttgatttttgtatgtggtgagaggtagtgttctagtttcattttttctgcatatacatacctagttttcccagcgccatttgtagaagagactgtttcttcctcaatgaatgttcttggtgactttgtcaaaaatcagttggctctaaatttatttctgggttccttattctctttaattggtctgtgtatgtttttatgtcagccccatgctgttttggttactgtaggtttgtagtacattttgaagtctggtagtgtgaggcgtccagctttgttctttttgttcaggattgctttggctttttgggatcttttgtggttccatatgaattttaggattgtttttcaatttctgggaaggttgtcattggtattttgatagagattgcattgaatgtttagattgcttttggtattgtggtcattttcacaatattaattcttccaatctatgaacatggatgcctttattttatgtcctccttaagttttcatcagtgtttgtagttattcttgtacagatctttcaccttggttaaatttattcctacattatttccttttttgtttgtagctattataaatggaattgctttcttgatttgtttttctgctagttcattgttgctgtatagaaatactactaatttttgttcgttgattttgtgtcctgcaactttatgtaattaatcagtgttaggagttttttggtagagcttttagggttttctatgtgtaggattatatctgcaaacaaggattctttacaatttggatgtcttttctttctttctcttgcctaattgctctggctaggacttccagtacggtgttgactaaaagtggtgaaagtggccatccttgtcttgtaccagatcttagagaaaaactttgaacttttccctgttaagtatgatgttggctgtagagttcattgtgttcaagtatgtttcttctactaacttgctgagagtttttatcatgagggatgtttaatattataaaatgctttttttcctgtctattgagatgatcgtatgatttttatccttcattctaatgatgtgatatatcacatttattgatttgcatatgttgaaccatccatgcatcctgggataaattgtgtttgatcatggtcagtgatctttttaatgtgctgctggattccacttattagtattttgttgagaatttttgcatctgtattcatcagggatattggcctatggtgttctttttttgttgtgtctttgtctagttttggtattagggtaatgctgcccttatacaatgagtttggaaaaattgtttcctcttcagttttctggaagagtttgggaagaattgacatttgttcttctctaaatgtttggtagaattccacagtgaagccattgggttttgggcttttctttaatgggagacttttcattactgattcaaacttactgtactgtaattgtttttttcaggtttttggtttcttcttgattcaatcttgataagtagtatgtgtccaggactttatccatactccagtttgttggagtatggtaggagtatggtaggtagtctctctaatgatcctttgtatttctgtggtatgttttaatgtatagtttttaaatttctgattttatttgggtcttttcactttttttcttggtttgtataagtaatggtttgtcaattttggctgcctttaactaataagtcaactttgttctgtaaattttttttttgtctcaattttatttctgttttgatctttattgtttcttttcttctattcacttgtatttggtttgttattgtttttctagttccttgacatgcattgttcagttgtttatttgaactcttcctgtttttttaatgtaggtgtttattgctataaacttccttcttaatactacttttgctgtatcccatgggttttggtatgttgtgtttctatttttgtttgtttcaagaaatttaaaaaaattacttaatttcttctttggcccattggtcattcagaaacgtttaattttcatgtatttgtacaaatttgcaagttcttgtttctgatttctagttttatttcattagggtcagaaaagatacttcttataatctcagttcttttaaacttgtttagatttgtttgtttagtggtctaacatgttctgtcctagggtattggccatgtgttgatgaaaagagtgtattatgcagctgttggataaaatgttttgtaaatgtctgttagattcatttggtctaaagtgcagcttaaatccattttttttttcttgttgattttctgcctaaatgatctgtccaatgctgagggtggggtgttgaagtccccaactgttactgtattggagtatagctatccctttagagctagtattttgctttatgtatctgggtgctttggtgttgagtgcatatatatttacagttgttatatcctcttgctgaattgatccctttttcattatataataaccttctttgtctctttctacagtttttgatttttaagtctgttttatctgatacatgtaaagctactgctgctctcttggtttcagtctgtaggtgtctttacagatgaagtgagtttctcgttagcagcatatagttgggtcatttaaaaaattccatttatccagtctgtatcttttatgtgggcaatttaatttgtttacattcaagattgttattgataggtgaggatttattcctctcatttcgttaattgtttctggttgttttgtatatcctttgttccttttttgctctcatagtttatcattgaagtttggtggttttctgtaatggtaagattcgattctgtttgctttattctttgtgtatctgctctagcaatgagttttatacttttgtatgttttcatgatagtaattttcatctttttttccttccagatataggactcctttgagcagttcttataaggccagtctagtagtgataaattccctcagttttcacatgtctggaaaagacttttatttctccctgatttgtgaaagatagctttgctagatatagtattcttggctggaagtatttttctttcatcacattgaatatatcatctcatactgtcctggcctataagatttctaaggaaaaatctgcttttaggccgggtgtggtggttcacgcctacaatctcagcactttgggaggctgaggcgagcggatcacgaggtcaggagatcgagaccatcctggctaacatggtgaaaccccgtttctactaaaaatacaaaaaattagccaggtgtggtggcgggcacctgtagtcccagctactcaggaggctgaggcaggagaatggcatgaacctgggggacggagcttgcagtgagccaagattgtgccactgcactccagcctgggcgacagagtgagactctgtctcaaaaaaaagaaaagaaaagaaaagaaatctgcttttaatctaacagggacttccttatatgtgacttgacgtttttttcctgctgtttttagaattctcttttgacagttggactataatgtaccttaaggaagacctttttaggttgaatctatttggggacttgtgagctttctggatctggatgttttttatatctctcttcagacttgggaagttttcagttactgtattaaataggttttctataccttttcttgtctctcatcactttggaagtgccaaaataggaatatatgcttgcttaatggtgtcccataaggcatataggcttttgtcactcttttttttcccctcactgaataggtaatgttagactacttatttttaaattcagagattcttttgctgatcaggtctgctgttgaagctctcttttatttttttattttatcattgaattcctcagctgcagaatttctgcttggctctttttttattatttctatttctttatggaatatctcattcatatcatgaattattttcctgattttattgaattatctgtattttttttgtatttcattgtgtttcctcaaggttattattttgaattccttttgttgatttctttttcactagggtctgctactagagaattgttatgttcccttggtggtgtcctattttcttgctttttttttttgagacggagtttccctcttgttgcccaggctaaagtgcaatggcaccatcttggctcactgcaacctctgcctcctgggttcaagcgattttcctgtctcagcctcctgagtagctgggactacaggcacgtgccaccatgcctagctaatttttgcatttttagtacagatggggtttcaccatgttggccaggatggtcttgatctcttgacctcatgatctgctcacctcagcctcccaaagtgctgggattacaggtgtgagctactgcacccggctgctttttgttttcgtttcatgtgtgcctccattgatgtccttgcatctagtggaacaattccctttctaaactctgtagagtggcttttatagagaatgactttcacctgcagttgagtgttttttttttttgtttgtttgtttgttttgttttgtttgagatggagtctcgctctgttgcccaggcaggagtgcagtggcatgatcttggctgactgtaatctctgcctcctgggttcaagcagttctctgcctcagcctcccgggtagctgggattacaggcgcctgccaccatgcccgcctaatttttgtatttttagtagcgatggggattcactgtcttggccagggtggtcttgaactcctgaccttgtgatccacctgccttggcctcccaaactgctgggattacaggcgtgagccaccgtgcccggcctacctacagttgggttttaatttgttggttgagaagggtgtagtgattgtttccgaataggtgcagtggtatagtatccacgtagcttatttagctgctttcagtatcagcaataattgtgggcacctcagtggcgtaggttgtagaattttgtggcagcagtggtaatgtccttgctgtcaagggcttttggggttctcctagtctcattttcctcacaacaggagacttagctgagggtgtctaagtcctttttggtgtcagatttgttgtggcccataagcagctgcagtggcactgtattctatgtgtaggtgcttggagcagctgtgggtttccatgtccaggctcagcatcttataaacctattttgtcatctgggtcttgggatgcaggtttgcctgctctggctgtgttggatgtaggttgcccacagagccaggatgtatgacactgagtcactctctagcagcttgggcccagggggctgggttgtagctgtgattctcttaactggagggcagggcacaacactggcctgactcctgggaagaaggggtactttgaaggtttgggcctggggagcagggtgtggctacagttcaggaatctgagccagtagggttcagtggtaacgtggatctcaggggatgaggtcctgggtagtagtgactcaagaccttgggatggtggggcttggcagtatccagactctgtgagtcgaggtgcagtagcagcaagtacctcagaatggcagaacacagctgtggtttgggccccaggagagggggtagggaatagcacagtgatgactttattccccagggagaggagtatctcagcagcttagactctggagtgctaatccagctccagggaagcaaggtactagagttgtttggcctgtagtgtgggctatctagctcagcatggctgtgtttctctcggatatggggtactgtgtcagctcagcctggggatgtgtagctgctcagctcaggcagggcaccagtttcccagggagtgatatgccctttcagctttggcctggtggggtgtgactgttctgtgcagctcaggcacatttccctgggacggaaggtgccacttcagcttgggtactggggtgtgttactgctctgggtggccaaggcactgtttcaacttgggaactggggatatgggactgctctgagtggccaaagtcctgttttcccagaaggcaagatgccacttctagctctggcctgagggggtgagggcaagtgtacgtggactgactctgtttccacttggccccacagggaagggtgtaccaacttttcacagctggcttggggatgggccagtgggctggggtggttcggtggttgcttagtctcagtgatgaagggaatctgtggctacttgcccctagagcaatacacattctgccacagttccagttccaagatggcatagtggagtagtcttttgggccacaaggacagatgcggtatcttctcctctcttgggggagcacagctatttagactcgaggcagctccctcagctggggttagtgcctgtgaggactgcagggactggtgaagtctgtaggtgtctaagttgttggtggaggctgctggtattctcttgtttacatccttgctttaggaagaagttcctcctggttcccagatgatctcagctctgggatggagtgatgggatcccaatatttccttgtttctctatgtggccatcctgagtttctgtgtgctcacaagggtttctgttattcctatgatgcactctagtgctctccctcagttattatttttatttttagagacagagtcttgcttatgttgcccaggctagttatgaactcctaggctcaaccagtcctcctgcctcgacctctcaaagtgctgggattacaggcatgagccactgtgcctggcctgtctcctcagttatttttgttaaaatgtagttgtttgttcattgttttggttgcttgttgcgggttggggagagatgagccctagggccttctagacgaccatcttgctgacaccagtctctggacttctgtttttgtattttgggctatttaaaatagttggtatttgagagttgtgatttttgtattttaataaacacatgtgcttagacattagggtgatgaacagatatgtcatatgaataaaacataagatcacacccttaaaaaatagattgaaggactacaatattcaatgaatgatctaaaccaagatgatatgaaaagggttaagcttcttgtgtagaatatttaggagttcagatgagagtaagggtttttgtttaaaggccaaatgctcctgcattggtttataaatgtagacatttaaaaattggtttttagttctgaagcagcattgttttctgcatttaagccatttcaggaactgttgtcctctagggaagccatgtggaaattttctggtagtttctttaggcaataacagttatgatttaatggatgaatgtgtcaggaaatctgtgattggtgactttactgaagaccacatatttatccaaggaaagactggattacagatttcctggcagttctttcctcaatttattcttttcataaaatagagatgtagataacaatactggttttgacttattcagggtggctgtgaggatttaagtgagatcagggtactttggaaacaaggtgctacaggttgattatcccttattcaaaactggggacccaaaagtgttctgaattttggaatatttgcagtatactggtggaggatccccactccaaatacctgaaatccacaaagtgttcattaaaaacaaaaaatcatttatttattctttagagacaggatcttactttgttgcccaggctggtctggaactcctgggctcaagcagtcctctcattttggccttccaaagtgctgggattacaggcgtgagccaccgtacccagccaaggaagtgttccaaggtccatttcctttgagcttgaagctggtgcacaaattttggagcatttcagatttaagatttttggattaaggatgctcaacctatatttaagttaaaacaattatcactaagtgattttatattggaagtaaattatgtaccaatgcaactatttttttcctgtgcccttaagtcttataaaatataagactttgtaagatttagtagctattacaaattaataaatttattaattttatttgccatttctgacagaagtgttactttgtatcagttaacatcacacccttcaaaattagaaagctaaacatgacttctttctgaagacagtataaatgtggtttggaattaggagttttgggatgtataatttgttcctcaaaaagggctgaagagttgaggaacacagaatacagaatgagtgcagctttgacttttttttttttttttttttctcgagacggagtctcgctctgtctcccaggcttgagtgcggtagcacgatctcggctcaccgcaagctctgcatcctgggttcactccattctcctgcctcagcctcccgagtagctgggactacaggcacccgccaccatgcccggataattttttctattttttagtagagacgaggtttcaccgtgttagccaggacggtctcgatctcctgacctcgtgatccacccacctcggcctcccaaagtgctgggattacaggtgtgagccactgtgcccggccagctttgacttttttgtaaggtgtctgtcactttaattcttattatttccccagctaaactacttaggaaactctttcaactttttcttaagtgaaaaaaaataggcaacacttaaccaacaaatgtaagaggaagagttgcttaatgtgcctaaataaggtaaagtgttttatttgattgtatagggttcaccttgttaaagttctagaatctctttagtgttaatggtatcatagaaccttagattgcattgttaatgatagcaagcttttcttgccaaatgagtgtctctttttccactatgagagttaggaagttcccgactattctactagctgagtcttacgtgaaaatatgctgaagtgttatttctgagtatgtctctgatccatttgtcacaaaaacttgagaatattttttctcaatatcttttttaaaataaattttattatgtacatttgaggtttacaacatattatgggatacatacagatagtaaaatggttactgtagtgaattagatgaacatatttgtcatctcacatagttacttttttgtgacaacagcagctaaaatctacttatttaactggaggatagcattatgctatgtgaaataagcagatacggaaggaaaaataattgtgggatttcacctatatgtggaatatgtataattaaaaaaacaactcagggctgggtgctgtggctcatgcctgtaatcccagcactttgagaggccaaggtgggcaggtcacctgaggtcaggagtttgagaccagcgtggccaacgtggtgaaaccccatctctactaaaaacagaaaaattagtcgggcatggtggtgcatgcttgtaatcccagctactcgggaggctgaggcaggagaatcacttgaacctgggaggcagaggttgcagtgagctgaaattgtgccactgcactccagcctgggcaacagagcaaaactgtgtctcaaaaacaaaacaaaacaaaacaaaacaaaactcaagtacagagaattaaacagtggttaccactagtcagggttgctaggaaatggagagatgtaggtcaaaggatagaaaatagatacatatgctgaacaagtctagagatctaatgtacaacatgcagactaaagttaataaaattgtattgcagaaggtggagattttaagggatttcttttccatttttcatatctttttttgtgttcctaggtatgagcatctggttcaccctcctgtttgataaactgaagtctagaaaatttagtttatacttctggactttccttttttcatgttactctttaaaattatttttaaatatatgactatattttcgctttgaaatattcaaataagtcagaggcattaacatagaaagttaacagttcctgtttcaaccttttctcatcctactctcctgaagtagtctttgttaataccttaaagtatcctcccagaatttgttctgtatatttcacacagatagaaacttcataaaagtgtaaatgtcagcatactatatatacatgatgatttttctgtgtgcattgtctgtttccccatccatttaatctgcctcatcctataactccagaatagtatcccccaaagaatggatatcccaggatatatttgataattttcctatttgtgaatatttagatgcataccctccctttcctcctccccttctcctccttctccttcctctaacattataaataatactgctgtgaatattcttatgcatatttttgtacatttatctgtaggctttaaaatttttcatctctgtacaaacagtatagaattatctcccaccctttctcagctcatcctatccccatgtaagcttctgtttatatgctggtctgatgcttaacagctatttcaggaaaggccatcttacttaggtttttgaaatcaaaacttccttggtgatcttaattacttaaaagactgtttcctgacataagtccatatcacagttgattaacataacacatccgagagaggcagtaaaagtaatgtggaacctttataatgtagtggctaagagcgcagttttctgttgtcagactccttgggtttcagtttcatcaccaccggttattatttgcctcatttgggcagttatttcaccactttcagttgtcttattcacacaaatgggcttctcatcccaatgatgtagtagaatgtagttatataatctgtgatttagggtggttgtaaggattaagttacaatataaggagttcctagtgtataagtgttccgtaaatgttagctaaaaacaggaagatacatacctatttacatttatgaatgaaggagtgatagactctgatagtgcttgtcttgcattgctgacccatgatattctgaagactaatattaataaaaggtctacagaaatagaataatatacactattgaccagacttatatatgtgaaaagttcttaggtctagaagtgactgttttttacttattttcataattaaaaaaatttttaaatggtttgaaatgggtctcaagaatggaatctcaatttataacattatgtctatgaaaaatgaggcttaaccttaaatgtttaaacttacttaggagttaacttaagtctcccctatattcccataggaatttattcaaggattatgtctttatcatcttcatgtacttttggtcttttatgtgctttttacatatagaagcactcagttaatattgtgaaattgagttagtgagtcatttctaggagtctccatcactactctgtttatttttgttctcatcactgctctttaaaattcctgtattatttcccgaatttctatgccatggtgtttcaaaaacacgccaaaatgatcttacagtaaaaatgtgctattatgggaatagttagaaaggattgattcctcattgtgtttcatttgttcttattcttagatattttcaagtgcattttcaattcgagctcagtattttccttaatgctcatgaaaaaaaaatacttatttttttgattttttatagagatgagttcttgcagtattgtccaggctggagtgcagtggctattaacaggtgcagtcatagcaccctacaaccttgaactcctgggctcaagcccagcctcccaggtagttgggactactggcatgtgccactgcatctggcaaaaaatataaattttaggtggaatttaaatattgagacttgttgcaattagtctgacatctttgtttaagtagaagatcaagattgtgattatcacgaatctgataaactttcatgcattaacaaagcagaattaattccagtttatgtttgcttgattgaagtgctgttaactctgagaggtatttttttaaataatacatttatatatgaaataatcagaaacttggccaagtatgataagaaaatatatcttaatattttaacatgttaaaatagtactcaatagaaattatgtgactaactttatttttgctgttttagattatatatgaacaagaaggagtatatattcactcatcttgtggaaagaccaatgaccaagacggcttgatttcaggaatattacgtgttttagaaaaggtaagtttctagtaaatgattttatttaataatagtttatggtagtgattcatctttggagaattatcagaaagtttgaatttcatgtgtaagatacaattatgtaattgaacagtaattgtaaatttaacaccgaaatgatgtaatagtcaaacacacgctccttgacttatgatggggttatgtcttgataaacccatcataaattgaagatattgtttatcaaaaatgcatttaatacacctaacttactggacatcatagcttaatttccttaaacgtgcttagaacacttacattagcctacagttgggcaaaattatctaacataaagcctgttttataatcaagtgttgattatctcatgtaatgaattgaatactgtgctgaaagtgaaaaacagtgtttctgtggttacctgaagtatgatttctactgcatgtgcattgcttttacaccatcctattacaaaaaaatcctgagtcaaaccatcatgagtcagggaccgtctgtactttagataaaatgacatggaatattctaaaacttacgtagaagttgtagcaatataaatttttcatgatgaaaagtaggcagaatttgaaaaatctatgtaacatttttgatttacatatgatgttagcatatttaaaatgtagatatttaagaggctgaaattttattttgggttcagggaataaaataattaagaataacatattgctgaatattaaatatagttcataatttctttctctaggatgccgaagtaatagtggactggagaccattggatgatgcattagattcctctagtattctctatgctagaaaggtatttaagaaaaaaatgtgttactaagggaatgccatttaaaaaataacagtattatccatatataattcacataccataaaatgcatccttttaaagcatacaattcagtggtttttagcatatttacagagttgtgcagccatccaccagtatctaattttagaacattttcatcaccctccagaactctgtcagcagttaacccctcatttcacctactttcagtcactggcaatcactaatctactttctgtctctaaggatttgcctgttctagacatttcgtataaatggagtcatgtaataatgtagtgtttttttttgtgactggcttcgttcactttgcataaggttttcaaggttcatctgtgttacatagcatgtatggtccttttgtttttgatgaataatattgtgtataccattgttttgtctaatagtgtatatatcacagttttattcatcaattgatggacatttgggttgttttcactttggggctaatatatataatgctgctgtgagcattcatgtgcaggttttttgtgtgaacatgtttttatttctcttgagtatatacctaggagtagaattactgggttttataattgtgtgtttaacatttgggggaactgccacactttttcagagcagctgcatcattttctaatccagcagtatatgaggattccaatttgtctacatcctcatcaacacttgttattatctttttaattttagtaaacctagtggatatgaagttctatttgtttcctagggctactgtaaacaaatcatcacaaactgggtggcttagaacagtcttaatttattgtctctcagttctggagactagaagtcagcaatcaaggtattagcaggattggtttcttctgagggctgttagggagaatctgttgcctgtctgctaatttctagtagcctcagacattccttggtttgtagatggtgtcctctgtgtgttttcacatcatcttccatttgttcatgtctatctgtctgttaatcccctttttataaggacattagtcatattggattagggcccatcctgataatctcattttaacttgattacttgtgttaagaccctatttccattaggttggtgcaaaggtaattgaggtctttgacattgctttaatggcaaacaccgcaattacttttgcaccagcctaacaaatcgagtcacgttctgaggtaatgggagttaggatgttaatttatctttttgggagggggcggcacaattcaaaccataactgaagttgtatgtcgttgtggttttaatttatgttttcctaatgactaatgttgttgaacatcttttcatgggattattggccatgtggtgtatacactgtcttttggtatctgtggggtattggttctatttgatgtagcatagtacttggtgcacagcaaattcgagttttaccttttggaagtttgtggaattttttttcctgaatattttagattccaggtttgaatccacagatacagaacccatggctatggagggccaactgtatcttctttggagaaatgcctgttctaaatcttttgcccatttatttatttatatttactatttttttttttttttttttgagacggagtcttgctctgtcgcccaggctggagtgcagtggtgcgatctcagctcattgcaacctctacctcccaggttcaaacaattctcatgcctcagccttccaagtagctgggattacaggttcctgccaccatgcccagctaagttttgtatttttagtagagatggagtttcaccatgttggccaggctagtctcgaactcctgacctgaggtgatctgcccgcctctgcctcccaaagtgctgagattacaggcttgagccaccgtgcctgtccttgcccatgtagttatatgtcttttcttttatttttgagacaaggtcttgctctgtcgcccaggctggagtgcatggtgtgatctcggctcactgcaacctccgcctcctggcccaagcgatccatccacctcagcctcccaaatagctggaactacaggcgcatgccaccatgcccggctaatttttgtattttttgtagagacagggtttcagcatgttggctaggctggtctcaaactcctgagctcaagcagtctgcccgccttggcctcccaaagtgctggcattacagggtagttacttgtctttttattgttgagttgtaagaattctttatatattctggatataaatttctcatcagatgtgtaatttgcggacattttttcccgtatggtggactgttttttcactttctttttggtatgctttgaagcacaaacggttttaattttcatgaagtcaagtttatctattttttttcttttgttgcctgtgcttttggcgtgtcatatccaggaaaccagtacctaactcaggattatgaagatgtactgctgttcttctgagttttatagttttagctcttatatttagattggtgattttttttttctttcttcctccctttccctaccttctcctcgcttccacatcaagtctccatcacctgagtaatgtacattatacccattaagtaatttctcatgtatggtccattttgagttaatttttgtgtatgatgtaagataaggaatcatttgaacagatttttttattaaatggttgtacttctaattctgttatgtttttgtgcttttcatgtgtctgttcaatattttctcataattttttattaaagattttatttttatttatttatttatttttgaagcagagtctcactctgtcacccaggctggagtaccgtggcatgatctcggctcactgaaatctccacctcctgggttcaagcgatttttctgcctcagcctctcgagtagctgggactacaggcgcgcacgtcaccacacctggctaattttttgcatttttaggagagacggggtttcaccatattgctggtctcgatctcctgacctcgtgatctgcctgccttggcctcccaaagtgcagggattacaggcgtgagacactacacctagccctaaagattttattatttataaaattcattctaattcaaattatacattttcctacataaattctgggttttagaagttttattatggaaaacagaggtatctcacttttccaccaaattttccatctcccaaggcaattataaaccttgtagctgtttttttgattagttacagccctgtgtctaaataacattcttctaacactgctatttttttttccaatttacatatgtgtgttgactcctcactgtggaaggtggggatttagctctgttttatctgtgaatcaccttgaaactcttgctcagttgtctacatttcttctcagaatatttaaacacatagattgtcttctaatttcattttcttagatactcttatcccagagccttctcacaagcttatcctggactgattgctcttttagtttgcagtgcagcagctttcctgggggttcttttttgcctcttttccatattttaatccctctgttttttgtatcccatgccaacctctgttttgatttattccttgttttggtgcagctccagggcttcctgagaaaaagagtgcatgggaacaaaaacatttcttttttttgttttgttttgtttttgtttttaaagacttggctttattctgaattggcctggcaggccaagaattacagtttgaaagtaaattttcccgtggattttttttttttttttgaagtttttttgttttgttttttttgagacagagtctctctctgtctcccaggctggagtgcagtggcaggatctccattcactgcaacctctgcctcctggattcaggtgattctcttgcctcagcctccggagtagctgggactacaggtgtgcgccaccacacccgactagtttttgtatttttagtagaggcaaggtttcaccatgttggccaggctggtctcgaatccctgacctcaagtgatctgtccacctcagcctcccaaagtgctggaattacagacgtgagccactgtgcctggctgtttttgaagttttgcctcaggttttctactttcctttattgatgttaagtctaatgcattctaattcctgatcccatgttatgtgtgtgtgtgtgtgtgttttttttttttttaaacctctctagaagcttttaattattgtctttttgtttctagttttatgttctggttatgtgcctttgtggatttgtttttttaatacattgtgctgggtacttgatgagctcttttaatatggaaacttctgtcttttttttttaattctgggaaatatttttgatttattttagtgatgatttcttccccattttctgttttctttctttctggagctctacaatttctggactggtcctgtaattttaaaatcttttctttcctgtttttccttccttccttccttccttccttccttccttccttccttccttccttccttccttccttcctttcttctttttctttctttcgtatttatttattggtctgtactattttctaggaaattcacttttctattgcctttttcattttttgctataatttcattactaagacatctttcttgttctgagtgtcctcgtgtccccttttaaaggaatagcattagcattctgttctttgtggttgtaatatattttcttattactgaggagtttaaggatagcttcttagatgtttttcatctccctatgtagtccatttccctctagtgaccttttgctctgcccccacctcatttcatttgaactctgttttctgtagataacttgtctttgatgtttgttgcttatgtagtgtggggctcatatttaacaaatttaagagcagatgcacaacagtgattatattctctgtaggtatggttaggcctggtaatagtgagactcttcctggggtgcatggctaagctgtttccttggagaatccctaatgtcaaagttcacgtctttttgggctagtagatttgacaagaatctgcagattcctgcctggaaatggtaagcttggatggcagtattctggcaaatgagtggagaaaaagggctgggagtcttgccaacttctttgtataggttgactttcagttaattctcctgatttcagtatattattcctttgctcattgtgtttgatttttcctaatttagagataaatgatgttttccaaaactccagccttttggacttagttgtcctgtcttcaggttgacctttaatccttatttccctgattattggcatgacctaccaatttgagcctttttgtatgcagagttggtagggggaagtagaagtcagagagagagagagagagaggtggggaacagagtactcttgtagatgcttcttagctttcctcactactgacgatagggttagggttaatagggatggtggtgagggtttttgtttttttttttggaggagtctctctctttcatccaggctggagtgcagtggtgcgatttcggctcactgcaatctccgcctcccgagttcaagcgattctggtgctccagcctcccaagtagctgggattacaggcaccccccaccactcccggctaatttttgtatttttagtagagacgggggttttgccatgttgtccaggcttgtctcaaactcctgacctcaagtgatccacctgccttggcctcccaaagtgctgggattacaggcatgagctactgcacctggcctgagggttgatttaaaaaaaaaaaaactagtcaaacaagaaatgacatttgaggaaggaactggaagaaaaaacaatctatttgataatttcatttgttcagtttccctactgtttttcagtctgtttctatttcttacatcttaatttttcttgtgcctttatagtttcttttcattcttactaattttccttttctcttttaaaaaagaattatactattgacacatgaatacaatcctgttgcaaaagttcaagtaatagaaagttgaagccctgcttgactagagtcttttcccttacctgtctctctctctctctttttttttttttggagacgcagtttcgctcttgtcacctaggctggagtgcaatggctcaatcttggctcactgcaacctctgactcctgggttcaagctattctcctgcctcagcctctcgagtagctgggattacaggaatgtaccaccatgtctggctaacttttttgtattttttgtagagacggagttttaccatgttggccaggctggtctgaaactcctgacctcaggtgatccacccgcttcggtctcccaaagtgttgggattacaggtgtgagccacctcgctcggcctcccttacctgtctctgtttaatgtatatctttccagacttttacctgtatgcattttatttttatgtatgtatgtgtttagaaagacctagtttgtcctcctgtgtcagtagtaatgagcactgtcatcagcagtgtgagatggtccatttcctcacgttgtcttccatatttgatattatcttttttaattgaatggggcaaaaaatagaaatctgtcaacttgcttttcattgttactgaagttggacatctttctatgtttattacattatatttcttcttctttgacttgcctattcataccatttgcctgtttttctgttttgatatttgtctatttctaaataaattaataggagttgttttgtaatctggacatttttcttttgtcatatattttagaaagatgttgtagttgtgctatctttagctaatatatggtgtcttttgttgtatagaaattaaatttttgatttactcaaaccatattgcattttagacttttggttttattatctttaaagatggaaaattctatagaactatacctgtgaatatgttgcttttagctaattttgattgcctgtaagaaattatacaaccattgatggcttaaatagccaccattgggctcttttctttaaataactaaaagtttggaggttgggagctttttgcagtggttctcttgctttttattttatttttaggcagcatggttacattcaaagcaggaaaaaggaaaaaaaggatgaggcttttattatgaaagcaaagccattttcagagttgacttctgcttatatttcattggcaactctgactgcaggggagtctagtcaagcttctcttccttttttttttttttttcataaagatgatcaagagagaaaagtataggaaatggtgttcagttttcccaccagtgatgtcgtctgcagcctgcctacaaacattgaagctaagatgatatggattgaaattaaatttgttttagactttaaatattttatatgttataattattttaggactccagttcagttgtagaatggactcaggccccaaaagaaagaggtcatcgaggatcagaacatctgaacagttacgaagcagaatgggacatggttaatacagtttcatttaaaaggaaaccacataccaatggaggtatgaattaaatcttttgaaatcttaaactgatttgctacagtatactaataaacaaaaatgcaaagaagattcgtgaatgctcctcagtgagaaggatgattaatttctttggttaataggtataaatctcatattttagttatattcccttttcatctctgttttattggttgtggcttcaaaaaaatattttaaaatacttgctctattttatagttattaatggcagaaagtagaaccactttaaaacattcctttggctgtccttcatgcacatttttcttaatttagtagaattataataatcatgttattttatcctaaagtaacagagggagatggagtataccactaaatcataccattctaatttcagcatcttgctggactcttcatggctcattgcagttttcccttaatatgtgttgagtgactattctcctttctacatatataccatcatgtgccacataacagcatttcaatgactgatcgcctatatgtcagtggtcccataagcccataagattataatggagctgaaaatttcctgtcacgtagcgacatcatagtctttgtacggtcacagtgcagtgcatcaccttttctacatttagacgtgtttagatacacaaatacttagcattgtgttacagttgcctgtggtattcagtatagtaatattgctatataggtttgtagcccagaatttcataaaagaaagaagctttacatgaatgagaaaagcataatctgacaataaagatcactttattagtggttctcagccttggctgcacattgaaatcacctgggtaggttagatttttaaaaaatactacccaaaatcagactctggagatatagcctgggcatctgtgcattttagaaggtcttcagatgactttaatatgtggtcagagttgagaacttctgtgtagctgtgtagcttagcaaaaaacgacagatgtaatcctgcttatggcttgaccacagactttattttgtagttattaaaagttaaaggccgggcgcggtggctcactcctgtaatcccaacactttgggaggccaaggcaggcggatcacgaggtcaggagatcgagatcaccatggccaaaatggtgaaaccctgtctctactaaaacacaaaaaaattagccgggcgtggtggcgcatgcctgtaagtcccagctactggggaagccgaggcaggggaatcgcttgagcctgggaggcagaggttgcagtgagccgagattgtgccactgcactgcagcctggcaacacagcaagactccgtctcaaaaaaaaaaaaaaaaaaaaaaagttaaggaggcattttctaagcccgtgggttcatttctaagcttgagggtttattttgaaccctcaagcttagaaattccagaggttttaaatgtatttcattacgaaactttcttattttctaaaagtttttttccccccaaagaaaaagcttttgtttttcttaccttttacccttctcatttttaactttgtacttttttcttttttgtgtgaggcacaaagccaatttgggacaaacctttaaaaattgactatcagacttatttaattatatttcttaagagcattttgctttatatttcataagagtttctactgctacatcctttgttattatataccagacaagttaaatgttttggaaatattccttccaagaacatcagactgtctcatgtttgttctagagatccatccaaataaaatttgtccttgatgttaattctatttaaggcatatagagacttactgaactgttctgctcttacaagaagagtagagttgtttgttcagttcttctgctattatatttagtattctcatgttagtgtgttggagatagtttttacatgtatttggtaacatagtaaattcattagaactaattaattttctttacctttgctttgagtagaaagatattttgaattcactcttgatttccgttttcctttgtaaccatttctatttctggctagctatttgcagcagaatgctttgcagtttagttttatgttgacttgatactaggttgttaattcacttattcaacagatagttcatctttgactacttactgtatgctagccactcttctagcactgaggatatggctgtgaacaagataaagttcctgttctcatgaagcttttattctagtggagggcctagaatatttgtcagggctttaaatttaaatatttcttcgtcacagctttaaatgtggaaatgtgtgaggcattttcttttgtatgtaatatatgtctcttctgttaatgagggaaaaatctatgtaaaacctttactcttgaatatgcataaactcctgataattcatatagcatacatatagtatttaatatacttcatatgattttcttgcattaatttagataaaatactctgtgcaacgaagaatttaatttaaaaaattgtctatatgtagttttttgggtttctttctttttttcttttttttttcattgctgtttttctgtgaaatatttttggtctttgcagataagccagcagtatgtatctgttctaggtagtctaagtacattcatacttaaatgattcatgaataagttgaaattctagaactgttctcacttagatatcagcttgaagtggtcttatgagctctaaaatataaataccagtgaaacattatgtaaagtagtcaagtgggcacatggcacttaatctggtatctcttacatgtgagttcactgtccaaactggtgtgaaagctgctggtcattgtatatagataagttactttagcttccttcaaatgatacttgtttaagtgtccatgaaataatgatggcgcatggtttccttgcagatagaggtttctgtaagctgtagatttctttttgtgagttcaagagatcttattagagatgattgcagataggacggtgatacatccatgcaggtcaacactgattaataagtcttctgatctagtcttgtaagcaacttccttctaagtagtttatctttgtgggactggtagtatgggacagaattaataaaggtcttgagtagcaggatagtgtgacacttcttaagaaataacattttaggaaaggttttttaaaatttcagagacacgacttgcttatgttggagttaaattgttaaaatggtgttttagattagaagtgaattataagaactagcatcattagtgagaataaatagttttttctctttcagttttttatttaaattgttgaggtttaagttgcttgttatcaattacgataatgttcacaaacctggaattttcgcttctataaagaggccacaaactcagaacatgccgtattttacataactataatttggtttgaactgaggtcttaatttagtagacagttaatttagcaattgaatgtattatttttgaagcattcacaactttttatcttttcatcaattccttgctatactttgtttttctgcaaataaaatgtctgtatattcactccagtgttattttttatatcagtatgcttacttcactactagtgtagtgtcctaaaaataattacaaaaggaaatgaaggaataaaagtttttgttttgttttttgactcttcaagagaattaagctattcttattttggggggagtgggacagataaacatttactgagaattttcggtatacttggcttgcactagttagttgaaaagtattatctcctaattcttattaatagaattacaatgggaggtaagtataattatctccattttacaaatgaagtaactgaggctcagagaaattcaattatttgtcccaggtcattcagttagtaagatggtagtgctgcaatatgaatccagtctgcctgcttgcaaagccatgatcagtttttttgggcaaagcttgtattttacataggaataacatttaaaacatttatatgtggtaggataattattttaaaaatcattttttaaaagaacatataagtagccatatctaatacaggtggaagccataataatataagtgctatactgattccctgggttcaactaatttatgttaggcagtcatggagagcactgtcagtaccttttaaaaaggtgaacaaaaatattttgccccactttcttgtttttaagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgagtaagtatcatattattttctacttattgaaaccagatcattgtattaatcccaaagcaaactatttttacttgaccttgggcatcagtgacctatttgcatatgaggacatgaacagcttagttttttctgggatattgatttctttggaacaatgactgaataatattgtgttattttagtaatttgaatctgagacttaccacctaattactgttacaaagaaaagggtagtttaatattttttatacatttaaatgaatgatgatgcattagtaatttatggcctatgtgtttacctaatttaccctttattatgtattttctattaaatatacagttttacttgtgatgttgcagctttaagtcaggcaagtcctaagtcctttataaaattatttctcagttggaagacagggccttaccactttccaaaaatcttgtctctcatttagttactgtgtgcatctgtacacacacatgcttcctcactgttactctcagcaaatattttttgggtatctgttacatcccaacactggtagttgcttgatatttagtagtgaataaaacaggggtgttcctaggaattagagaattcatagtcttgtgaaggatgtcaacaagtaaaatggcaattaaaactgaaggactaagatgaagaagtgtaagccgctttgggagttcctgggaaggaatgaggggcacttaattcagactgggagtagggatcaaggaagacttcctggaggaagaagcatctaagtagagacctgaaaaatgagtgaccactataaggaacgggaaggagatacttagagggaaggatgttttagatgaagggaagagtacaaacatgatgtaatcacacaacaaattaattcagtattacaggtctgcaaagtatgaggaggggagggtgatacagttaaagatgaggccaaagagctgagtaaagtccaaagcacaaagcatcttttaagtcatgttagcaggttcttccagttatccaggtgagattaaagtggcctgaactgggatagtgacaggaaagatggaagtattggagtctttagaattagattttgtgatggattggatatatggaggtaagaagggagaagttgaggttttgggcttgggggaactgcagggaatgattgctaaccttccttccttccttcctttccttccttccatgcagtggtgcgatcttggctcactgcaacctctgcctcgtgggttcagacagttctcctaccttagcctcctgagcagctgggattacaggcgtgcgccaccacggttggctaatttttgtattttttagtagagacagagtttcaccatattggccaggctggtctcgaacccctgacctcaggttatctgcctgcctcggcctcccgaagtgctaggattacaggcttgagccactgcgcctggctgctaacttcatttataatgtcctcactttatagtagaatttaacaccttgcccaaatttagattacataaggcttgcctaaatttagattacataaggctagaagtgatacaaaaactggaagattctcgactgtgtattttctggcctgagattctcccctgccatgttaatcacctctagctggcaacaggcaagctgttcagtgccagtaagtgtaagaaagtcagacctgcttggtggtatgtggattgtggatcttggatctcgaagtgagaacctgtgataggttaccattgagaggatgagtagatttcaggagagacagtatcatgattggaatagaaaattatggttatttaatagcaggcattaaagagttgggagttttagcaccatagtaagctcagtatcggtgttgcgatgtaactcacaaatgagatcatttggtctgagactgttgattaaagcataatatctaggatgagggaggtggtagctcctctctcctttttactgattatattttggagaagtaggcttgaactgcaagtagtaaacactgcattttaaatgtgctagactacctattctataggtaagagatagcaaactactgattgaatctcttgaaaaatatgtggtattctgtgagtaagtatcatattattttctacttattgaaaccggatcattgtattaatcccaaagcaaactatttttacttgactactatttttacttgatcaactatcaagttgatcaactactatttttacttgatcaactatcaactatttttacttgattacagaatagaaaatactattctgtattgaagagataaccagtgtaaggaaggggatcaaaatggtcctatgaaaaatatttcattgaaggatgtggtttaacttgaagaagagaaatttcaatgcaacattaaataaaatccaaacttcttcactgtcatcaacaagggcctgccctatcttagctctgtttatctcttaaaactcatctcatgccattgtcttttccattctactcatgcagatttctttcagttcctaaaaccccctaaactctttcttgtcttaaggtcctttatgcatactgttttttctacttggaatattttcctctctttctgatccctgaggtctccatttaatgtcacttcctcagaggggcttatgccctctttccccatctaatgtagttttcctatctctgctcctcactatctaattttcttgtttgcttccttcatggcatctaacagcatacaataatttggtctattcttttgtgttttactctagaatgtatacttctgaaggatagggattgtatctgtcttgtttccatattcttcctagttcctagctacagtttctggtacataataaatgtgcaataaatattagttgaatgaataaatggcatgatgattatcaatttgacaaataatttttgaaaggttattgtgagaaacagattggagatttgctttatgtgactccagaaagaaattagaagacaggttttagctcaggaggtagagtttcctatcctggatgggttcaaggatagtcttgataaccacttaagcagttaataggggtatatgtatcttgaatgtgtgttgttcatgtttcgtgagagtagcaagtgaaagcttgtttccttttctaaatttgtaaacaaatgagaagtatgagaatcagagatggggatgggcacactggcctatgcctgtaatcccagcactttgggaggctgaggtgggcggatcacttgaggtcaggagttcgagaccagcctcgccaacatggtgaaaccccgtctctactacagatacaagaaagccagctgtaatcccagctactcgggaggctgaggcaggaatatggcttgaacctgggaggcagaggttgcagtcagctgagatcatgtcattgcactccatccagcctaggcgacagagtgagactttacctaaaaaaaaaaaaaaagaatcagagatggtgatgaaaatactgttattagaggggtttagacatatgacattataataattcaccccagattagttttgaactaaactggctgttgttacttcttgacacctacaggctttcctaatgaggacaggccactgaggatgtgaatgagagcagaatgaaagcaccttctctgttgataggcagatctaagagagagggaaagagagagagcttggaaggaattatgccaagcatgcaccctactctttctcaatctcagcacttaagtccctgggaaggagagtgtctttagaagtgctcatttccttttggaaatgtgaagccatagaatgttccttatacatgtttctttttttttttttttttcatttaattcaagtatttttttttgaatgcctactgtgtcttagatgcagtagtgctattttctggaaagaaagcagtaatcaaaaaagacatggcccctgccttaagttgcagctataataagtgccgtgaataagacatatggcaatataaaagtatattaggataatatgtaagttttccatgtgtgggagtgattgaaactctgagagagaatgaaatcaactaaggggagcatagagttggaggagatgtgagcctaagtgattaattgcaccctttaataatctggtaaaagagaaaaagctttgtacactttgttctcttctcattaggcttaatcattaagtttttagtgaaccaggatgtggctgctcttcttggggaaggagatagtgtctaaagtgactacttcaaaagctgttcttctaatatcagccactgctttgtgtattctcctgtgacactgggagggcaatttacgttttgacccatgaatggtctgaaatgtgtaaaaacagtgcatcaaatattttatctccaaggcccctccatactctaggctgaaaataagtgctccctccctattctccttcctgtcacaaattatgcccaaatatattatgccatgtagctcaccatagattttatagactccaagtagtagaataaagctattccaagtagtagaataaagctattccaagtaaatattcaccagtatttaaaaagtcccaaatttatataagccatcccccactgtcagattcttttttgttttaacttttattttaggttcaggggtatatgtgcaggtttgttatgtaggtaaactgcatgtcacggggttttggtgtacaaataattctgtcacacaggtagtaagtatagtatctgataggtagtttttctgatcctctccctcctcccactttccaccctcaagtaggctctggtgtctgttgttcctctctttgtgtccatgtgttgtttgttgtttagctcccgcttataagtgagaacatgtagtatttgactttctgttcctgcattagtttgctttaggaaaatagcctccagcttcatccatgttgctgccaaggacatggtctcattctttttatggctgcgtagtattccatggtgtatatataccacattgtctttatccagcctaccactgatgggcgtttatgtttatttcatgcctttgctattgtgaattacagaattcttaaggagaaatttaaaggctcttgttcttgttagttaagattcaaataagtggaattcccaaatttttaagttaaagttcaaataaatgaaaatttctaaatattatacccaatttttattctactaggtgtcagcccgaggggtctcatttcctgtccctggagcagttatcctaagtaaaacgatgtttccagagtcttatttctatggtcaaagattgttttagagaccacaaagaagagtagtcaaggaaatcttggtttcagcctcattgggatgccagtggtcacccctcctgtcttcttttgagttcaaaaccaagagaattagatcagataactttttttttatttttgattaagttaaattgaggaatgtggcttgcatttgtggccatgttgtcttcccaatctacttcctagtgaattaagtttgtcttcataaagagctgaccttccttttacaggagcagggccttaccatatggatgagcagagattgctagtaatctaggaatgggcaacctagatggctcacaagcgccaggaagaggctctgctaggctagtcatgtgtagttccttctttcagtctcaacaacccgatctagtcagtgcaacataggccatcttgacgcttaatatttttcagatagttttcttatttaccaggaaaacaaattgtcatatttgttcatgtttgtgttctttgatttatcatcatttaaaatatgatattcacttggataaaagaatcagctacaaatacatttttcttacctttctgaaaccaagttggttgctaagatatgaatgagacctgttgattccattaagttattttgtatattgggccatttttacattgatatgcaaatatccaagcagtaaaatattcccttaaaaagccaaatttgttgtatcatcaaacagcaccaaccatttaaaagattaggttctagatgtaaaattttgttattgtacctttctatcttttattcccagttttgattgataatctctgcaatgctgtttatttctttagccttacatattggtcattctcaatagaaatataaaatagttactgctacatttgggtatacaagcattgttcagtttataatttctgagtttattatgaggtctttgggacaggctcacaccaaagcctgggatatacttcagaattttcaggagatatgcttctatagttgtgatactagactatagttttcttcaaattgtttagcaggctgtaatagaattgctgggttagcatcattaaaagttcatcttactgctgcaatgagtttgaaagtcttgaataatgttagcatgagagatcaacttcccagaatatatatttatagattaaatcagtgtggtgacccagcaggtggaaacattctggtaatattttggaataccagtcttccttatggtgagctctgcaattacctagcggtgtaacagtatactacttgtcctttgactgatgtactttttaagtgttttgttgatttcctttggagcagtcaggtctttaatttcttcatatcttccctccttcttagagcttcctccaccctccatcacacaacaatagttatgagaaaagaaaagaaggaatttctttttaaaaaatatttgtggttgcttgttggtaaggcagtcatttcatcttcggatctccagtttagtggccactgtttaagatatggagccatagagttatctgaacccagatagctgaaagttgcctatttgttcctcttttatatgtataggcagtggtttgactttcatgagcattttttatttgggttttaaagaaataatttgacttaatttattgttagaaacaaaatgatggcagtgccagcagcactgtgctaggaataaaattttgtttctttattagctacttttcttttctgatgctacatttcaaagtccatcatttaaaaaatgccttgtgagagaatctgtaagtctgcctattaattatgacccctcaaaatattcagaaaagtaaatgttttaaaatgtattttttttccctcctatgtcaaatgactcaacctcagccccttttgaaaggccaaggggcttattagctactattgtatatgcagatcgagtgctgttcctgactgtgtaagaatataagatcctgttttggatttcatatccactctagcattactgttacatcctgttatgttagaattgagaagggataactgttattaaagatcttatctcaaacatttataataaacaggaggtgtatagcagcaaaataacacatttaatttttattttaaacatagaaaatttgtagatttattagaactgactaagtcataaaactcactaaatagaaaaaagactggataatttgtcagatgactagaaattagatgtctgttttggaaacattttgttaaattctgtcattactaagaaatgtgaagagacttgcttctagagtttaataagcaagaactaaaaacatagtattacccaaccattcataataatcttgttaaaatatgttcatatgtgtgtgtttgtaattatggttagcatgattaatgatctttatcaaataactaatatagcttacatttttaacatcttatattgcagtattactaagctgtgaatgaaggtggaaatgatttcaaaataggacatattttctgtatgtaaatattatatactgatgactcctaatgtctgttttggctttctttaatttttatgataataaagccagctatcttgtaatggttttctactataattctagagaagaatttaggttcattccagtttaatccttttggctttacctggaataaaaatacactttatatttgttttatttacgttatatacagtgtatttagtatttgttaattttgtattttatgtttcatgtagttttgaagctcctttaaaatagttactaaatatttgctaatgtattaatggaaaactgttaaaatattttgggttttttttttttttggtaaggaacatttgtgttagtaattgttcatgtagtaattgatacagtgtgttagtattttctacaaatcctcttttttattatagatctccacaggataaaagaacacttcttgtgaattgtcagaataagagtctttcacagtcttttgaaaatcttcttgatgagccagcatatggtttaatacaagtatgttccttaaatctatcctgtattattctgactgcattattttatataccctgtacttctcatcttctcagagagtatgcaaaatgagacaggtacatatatatacatagatatgtgtgtgtgtgtgtgtaatctttttggaactattctctaattttacagaaacaataataagttttcatgttatttgcaagactcagaggcttccttggttcttagttactcataaggaaatttctcagtttattataatactaaaattagacatcagtagatttgtatcataacttttattgattaggccagggatcacagagtaggccagtttgaattcattaatgatcggtttaggcaaaaatctggtttgaatttaagtagattgttttgacgtcatgacaatcttattcccctaagaatatttgagtactgttcttacatttggctaaaaatgtgcacttaataataggcagaagtaaatttaattatcactcagatgactatgtaaagtaatgagatggtttattcatttatttatttattcacttattcatttaacaaatatgtgagtgcttgctgtgtcccagctattcttttcctggttttgaagatgtaaagattaataagatatagagggaactttaggaaagaggatgagagagagaactaaacactgtttaaaatggacaataaaaggataattttacttattgtgaaaagaattatttaataaataactgtttttgctaaatatgaatgagcaaatagtttgggcttcagaagttaccctggcacttaacagtagaaaaaccttttgctgttttccagggtagcactgtcccagaataaattattcttgttggcatgatttactattcatataattagattaaaatgtcaactaatatttaaatatgagtttttaaatttagccatcaaatattttgtgtcagaatagcatggtggtacacacttcaagaaatattttttttgtatgaaggcaggactgctagacagaagaaagctgttgtgggccattcaccactggaaagtaagcactgcgtatgttttctgatgtatgcagattgagtgaagcctgcaaatcatttgtttatctgcaattcaatcagtagcattaacttgtcatttattatgctattttaaccaaatgaaatgattggcttagaaaatttaaatttttctttgaagaaagaaaatacaaatttaagataatcttagaacactctgttttagtcctgatttcttttcttttaaaaagctttgcttttttgctcatgatggagtattcgtttttctttatttgagttaataatgctaatatttttcttcctactgcatagaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagagtgagtaaagattagtattaatatagctcttatattttaacaggagaacatgtactatagaaatagaaacttaattttggtgatatctgcttctttccataatctgttcttaacaactttttgctagtatatctgacaatgagtgcttgtcctgccactaagttcttcatttgttctctatcttatactctttcttgattaatgttggatctctcttctttgattaccttttgataatgaagtttgtttcattgggtgcatagcagagtgaggagcgaacctttcctattacctcttagttctgttccttacttgcatgttttctcataggcatcagagacagctagtcaggatactacttttagggcttttattctcatgtaatacttccttttttaagtaagatgggttttggcctgaattatggcagatctttatatgtgctcagtaagatttaaatttgctacaattctaggcttgtacatagttagaaaactataaatatctaaattttagtgcttaattaaagggtttatcttgcaaatactattttaaaattaccaacatctgttaattgaataaaacactatagaaaatgccgagtgaagctagtgggtcatgaatcaattctgagaaatacaaactttagaagaaaagctaatttttagaatatgattaatggaataattatatattctctctttttaaataatacagcatatcatttggtttgaaggtttcttacagaatttacatgttgaatgttctatacttacataattgaacccaaaatagtaaagagctttcttttaataacaaatatttttagtctgtggggttttctgtttctgaatttataacccagtttgttgtgtgtttagtagaagggaaatacatgtaatgctaactattatagttaaactaaacatgggaaaataaggaacaatcttaaaagtattagaagtcatgtctgaaaaacagtattttaaatttagtttctatatgcctttatttcatttcactggttaaatatgtacttattattgcttaatcttatttttagattgatttgggggaacgccctgttgttcaaaggagagaaccggtatcactggaagaatggactaagaacattgattctgaaggaagaattttaaatgtagataatatgaagcagatgatatttagaggggtaatttaaacactctaatatggcttgtcttataaactcctagtatttaggggttttgttgttatcgttactgttttggtgtgtttttttttgttgttggttttttttttttttggtgggggaagtagggaggaatgaactctgttatttctttgatgaatgatgccttaaaattcctggattgagtaggacagagtgaggtgcttatgatgttcctgggggttgggtagacccttaactctgggggaagaattcttccgtacttgaagttctgtgggttttgtgaaggaggcctgcattccagtggcatttgccttattctgtaagattgggcttagactcaccagtcacactgtctgtctgctgtagtctactgtattctgtagtctactgtattctgtgcactgtttaaactttctggcagctgcttacatcttttggatctagaagtaaaaaacaagatgatattcactgaattgaactatttacatatatgaaactacctcttaaagattagttttcctttttatatgcaagttttgtgaacttacagtattacattctttttcattcatgtatttaatatgtatgctttcttcagggacttagtcatgcattgagaaagcaagcatggaaatttcttctgggttattttccctgggacagtaccaaggaggaaagaacccaattacaaaagcaaaaaacgtaagtaatggtctttcgtacatttatcaaagagattcaagtaacccactcatacaaattagtatagggtttctagatgaggatttggaatagactggggaatggaaaaacaacttcatttttatgttttaacttaaaaattatgagcattctaattattttaaatcagaaacttactagaagcacctttttgcatttatttttgtgaatatgtaaaaagaagataaacatattcccttatataagccttgtacaagccttttgcatacttgaaagataactacgtagacatacacttaaaaacatctctcattcatcttgattcatttttataattcattatgaaattataaatggctcataagaaatatatttgctatttagattaattacctttaagttacttttctgatactcttataatggatccttcattctttttggaagagtatttctattttaagttattcctcagacttgaaaggaaacacagaccaactttccaggtacaacttcttgttctcagttgtcagtctagcctttgatttaaagctattttcagtcattatgtgcatatttaagttatctgacagtcttctcttttcagcttgtttaccagttcttctaagacatttttacattaactagtttctgcaataaactgcttggaaatggaactataatgtcacattttttaaaaaaaaagtcacttagatttgtatttacaattatttggaaactttagtggttaaaatatttcatgactagaatacttttagacatgattttaaggatgagataaatgtttttgtaaaagaatacctaaaattattctagtagttgaacaaagtttatcacataaactttgtgatatttatcggttatttttttcttttgttttcacttatttatcataactttaaacgttttgctattgtttttataaacttacattccactagcatcataaatgctttgatatactgtttatagaaaaacccaattaaacagtgttaaaaataaagttttcaaatagctttctttgatgtcaaattgttttctatagtgatgaatacttcagaatgaaactgcagtggaaatccatcagccaggaacaagagaaaagaaattcgaggttaagagattatagaagtcttatcggtaattttttcttaacaactttggaaatgcaaggggggattacattgaaatcttgataagagtaaagaagtgaagatacatggtaatagcactagggctcaaaagagaaatcagaataggaaagtacattgcagtgtgtgtttaatgttctttgttgttcctcttccaataggcatattaattcagtaagtttatttataagtgttgatatatttaattttcagttccaaagtatgaatttctaaaaagattgtttacctttatttgctttttgaattaatttcatttttaaaaaactttattttcttttttattatgaaagtctgtttattgtagaaaaattaactgtagatgagcaaaaagaggtaaatagaaattatttttgtttctgtcacccagagataattatggttaataggtattggtttatatcccttcagaacttctttaaatatacatatatttcatttttaaaattaaataaatgactccagatataaaatttagtatttgaaaatagaatatttacctggggataactattctctaaaacacagagatgcttgatagaattttatcattaaagcattagttgcatttcataatctccatttacaaatgagaaactgaagcatggagaacataaatgacctgtccaaggtcacacatgtcccagtttaatgttcttattacactgtctctgtaattttaggatagcattggatagtactggaacttagttttgaaattcctatattgtatctggatttgtatatccgtggtttcataaagaatgatagagggatttgttactgctgttaacaccctcccatgaaagaaataattttttaaattatatttagaaagcccaacgtaacaggctgatttggtaccgtttgtggacatgaaaacaagatctttttggcagtgatacttttgatccaaaaagaatttatttttctgaaatgtaaattataccagaataaactttgtcctttctctgattaaggcgaaagtttgggagtcctgagttttggagtttaatctaaagtttctaactgaagcttcttgatattttcagtttcagtaggaaaaacaataagggattctggtgttttactcctgcttgagcataaaatattcgaactggaagggaagttagaggtcaactaaacctgtattttaagcctcttctttctgcatgccatatcctcttccctttatatcaaggatcaatgttgatgtctctgatattctcaacctttcatgtccttttctgatcctttccaggagactggtaggaaaatttagatatttaaagtccccataatgtaatttgaattgagacatactgtagcctactttgttcatttttagcagataaagttgaagcccagaaaggttagtcagttgtcttaagccatctatctcgttagttttatagttcagactcattcatactcagatctaattttgagtggcctttcagctataccatgctttctgccagtagaagtgcataaaataagttagttttaaagcattctttttctataatgctttttcccaaatgtattttgagaatgctcatcaaaagctttttgggtggtataaatttacttttattaaaagcaaaactacgcagtaagctttaggtcttgcatacatgccaataagttggattttactttaagtatgatgagactctattggagcattttaaggaagagtattttatttatattttaaaatcatttttactgctttgtggaaattcaatcaaagtaagagtaggaatagggagaccagttagtggaaagcataagttcaggcaataaatggtagtagaggaggtaaaaagaagtaggtgagcccggccatggtggctcacacctgtaatcccagtatttgggaggctgaggtgggaggatcacttgagcctatggggttgaggccacagtgagctgcgattgtgccactacactccggcctgggtgacagagcgagaccccttctcaaaacaaaacaaaaccaaaaaaagtaggtggattcaagttatattttggtgatagagttgataagactttctgatatatgaaatatggggtgtgaaggggaaagagaaataaaaaataggactcagtttctgactagaaaacgggcagttagtgataccccttatggagatgagaaatggggtatggtgaaattgaattaagtgttaaggtatatataccttaaggtgaaatatacaaatggaatgtcaagtaggtagttgaatagtctggactagtctggcaggagatagaagtttgggtattatcagtataaatatccatggaaacatgtgccacctagtggaaaaagagacagttaagaaggctcaggaatcccagtttttaaagcagtggtttttaactttggcaacacattaacccatttatgcctagtgttccattattggaacactaagcttgtgggagttatttgtatcctgctgctcaaggtcatctccaaggtctgatttttcacacacaaaaattcgcaacctctggcataaatgggtttaaatcaccaagggatatttctgaaaaccaaattgattatttcaagcattcatacactcattcattctttcaataagttattacttagtgcctattatgtactaggctctcctctaggcattagggattcatcactgcacaaaacaggcaaaattcttgccctaaaggagttttcattcctgtggaagaacagacagtaaacaagttaagtaagtaacatatgtggtatgttagtgatacatgccaaatagaaaaataaggcaaggaaaagggttaggatgtttgtgtgcaatgttgccattttaacttgggcaagcagagacagcttttagtaggaaagtgatatttgaatagaaacttgaaaaagggagggggttctcttaccactcctgttcagtgtagtattggaagccctagccagagcaatcaggcaagagaaagaaataatgggcatccagatgggaagagaggaagagcaactgcttgatataaagggaagagaatatggcatatggatattgctgggttttttgtctttcaagagacagattcttgcttgtcacccaggctggagtgcagtggcacaatcataattcactgcagctgggctcaaaggatactccagcctcagcctcccaagtagctggggctgcatgcacgcaccatcacacccggctaatttttaaatttttttgtacaaatagggtctcactatgtttcccaggctggtctccaactcctggcctcaagcaattctcccatctcagtgttgcaaagcattgggattataaatatgagccactgtgcccagccaatattgctgttttttttgtttttgttttttactaagatgggaaaaactgttagagaagaaagtctggaagggaatatttagaattcagttttagactttaattttgagatgcctatattgaatgtctgtaagttaatatgttgagttgaatgtggatatatggggctggaattcatgggactggagataaatttaggggtcatcaacatagatagtatgagattacataaaaccatgaattatgaaactagattacctcaaaaagtaggcatcaaaggtacataacctcaaaataataagagccatctatcacagacccacagccaacatcataccaaacaggcaaaagctggaagcattccccttgagaaccagaacaagacaaggatacccactctgacacttttattcagcatggtactataatcaggcaagagaaagaaataaaaggcatccagataggaagagaggaagtcaccctctcttcacaggcaatatgacactatacctagaaaaccccatagtctctgcccaaaggctcctagatctgataaacaacttcagtaaagtttcagtatacaaaatcgatgtgcaaaaatcagtagcattggtatacaccaacaacgtccaagccgagagccaaatgaaggatgtgatcccattcacagtaggcacaaaaataataaaatacctagaaatacagctaaccagggaggtgaaagaactctgcaatgagaattacaaaacactgctgaagggaatcagagataacacaaacaaatagaaaaacattccataccatggattgaaagaatattgtttaaaatggccgtactgcccaaagctatttatagattcagtgctattcctgtcaaactaccaatgacatttttcacagaattagaaaaaaattcatatgcaaccaaaaaagagcccaaatagccaaagcaatcttaatgcaaaatgaagaaagttggaggcgtcatactacctgacttcaaactatactgcaagggtatagtaactaaaacagcatagtcctgggacgaaaaacaggcacataaagcaacgaaacatgttagagaacccaaaaataaagccacacatctacagccatctgatcttcgacagagctgacaaaaacaagccacagggaaatgactccctattcaataaatgttcctgggataactggctagctatatgcagaggtattaaactggacccctacctttcaccatatacaaaaatcagtcaagatggattaaaaacttaaatgtaaaacctgaaactataaagaccctagaagaaaatctaggaaataccattgaggatatcgacccaggcaaagacttcatgaagaagactccaaaagcaattacaaccaaaacagaaattgacaagtgggacctaattaaagagcttgtgtacagcaaaagaaactatcaatcaacagggtaaacagacaagctacagaatggggaaaacatttgcaaagtatgcatccttcaaaggtctaatacccagaatctgtaaggaactcaaatcaacaagcaaaaacaaccccattaaaaaatgggcaaaggacatgagcagacttttttttttgagacggagtctcgctctgttgcccaggctggagtgcagcagtgcaatctcggctcactgcaacccctgcctcccgggttcaagcaattctctgcgtcagcctcccgggtagctgggattacaggtgcccaccaccacggcaggctaattttagaatttttttttagaagagacaggattttaccatcttggccaggctggtcttgaactcgtggccttgtgattcacctgccttggcctcccaaagtgctggcattacaggtgtgagttaccatgcctggctgcagacacgtcttaaaagaagacataaacactgccaaccaacatatgaaaaagtgctcaatattactagtcattatggcaatacaattcaaaacaacaatgagataccatctcctactagtcatgatggctgttactaaaaagtcaaaaaataacagatgctggtgaggttttagagaaaagggaatgcttatacagtgctggtgggaaagtaaattaattcagccactgtgaaaagcagtctagaaatttcccaaagaacttaaaacagaactaccattcgacccagcaatcccattactggatatatgtccaaaggggtataaatcgttctaccacaaaggtaaatgcacatgtatgttcatagcagcactatttgacaacagagaagacatgaaatcagcctagatgcccatcagtggtggactggataaagaaaatatacatatgcaccatagaatgctatgcagccataataaagagatcgtagcctttgcagcaacatagatggaactggaggccatactcctaagtgaattaatgcagaaaaccaataccacatgttctcactacaagtaggagataaacattaagcacacgtggacacaaaaaaggaaacagtagacactggggctgtttgagagtgaagggtggtaggagggtgaggattgaaaaactacatattgggtgttatgctcattacctgagcggcaaagctatctgtacaccaaacccccatgacacaccatttacctgtgtaacaaacttggcaatgtaccccttgaaactaaaatacaacttgggaggaaaaaaaatagattaaattgccaagggagtagtacagttacaaaaaaagaactgagccctggggcactttaatttacaagtaggaaaaattagaagacagcagaagagactaagtaaagagccacagagaaagattgaaaacatcaaagtttgatgtcctaaaagacaagtgaagaaagtatttcaagaagggataattgggatgccaagtaagattatttaaattgaccattgcatagaggaataaggagatcactggagattttgattaaagaagaattttgatggattggtgcatgtgataacctgattagagtgaattgaagagaaaatagaagaagacttggagacaatacctacagctctttcaaggagttttgctgtaaacagatgtagagaaaatgagctagcagagggaaaagtaggattaagaaaggtttttaatgatgttgaaagaaataatgtaaggttgaatactatgggaatggtacagtagaaaggaaaaactggtaaaactgaagagggaggtaattactagagtaactagatagaaattactagagtccttgggtagtcaataggggatggttctcatgcacaagaggaggggttggtctttgccacagagttatggaaactcatttatagtgttaggagagcagggagactatataaattcaaacatggttgtatgcttagaatagtgggaacctgtgaaagttctctcatagtttcattttctcagaaataggaagcagagtccttatctgagttaggatgtgggagaaggtggaggcttgaagagaaaggaagtataaaataattgtatgaatggggagtgaatggacaagggaaatagagcaggattgccaaacagcattcaggacccacttgatgttagtgatggtgaatataaaatggggtcagtcaacgtggttgtgtttttcttcagcctttttttagctacatcagattagatggagagttggatttaataagaggtttttgtttttaactgaagtactccttttcagaaatggggtttctagaaataattataaaataacatttttatatattactttttatcccttttctgtttttcacctggcttgtcactattaaatatttttacaagaagaaatactgatagttcatgagaatacaaacaacttttttttactatgtttaaaatacgtattaaggcagatattctgtattggcattatggtaatataaattatgcttgagttaataaaaattaacttatgaactttatcaactgtgaaatgagacagaagcagtttgacttttttttctttttgagtcggggtctcactgtgtcacccaggctggagtacagtggtgccatcacggctcactgcagcctcaacttcctgggctcagatggttctccaacctcagcctcctgagtaactggtaccacaggcaggcgtcaccatgcctgggtaatttttgtattttttgtagagacagggttttgccatgttgcccaggctggtcttgaattcttgggcttaagcagtcctcctgttttggcctcccaaagtgctgggattataggcatgagccactgtacctggcccattttgacatttctaattgcaattttatataaatagcatgagttttttggtattacttttgcttatttgagaactgtatccacaattctgtatgtatttgcttgctttttaaaaatcaaatgtagtacattttaacagaaagctaaaatatttgaataattttttaaatgcccttacagaatctaattaagctcacatcataccctgttgttagattctactctgttgtatctccttatcttttttttaattattactatttttgagacagagtctcactctgtgacccatgctagagtgcagtggtgggatcttggctcactgcaacctttgcctcccgggttcaagcgattttcatgcctcagccttctgagtagctgagattacagatgcacaccagcatgcccagctaatttttgtatttttggtagagacagggtttcgccatgttggccaagctgatcttgaactcctgacctcaggtgatccacctgtctcggcatcccaaagtgctgggattacaggtgtgagccaccacacctgacctcctcatctctttgtaaagagttttgagaaagttttcaggttactcagtttaattgaggggaggcagttatcacttttaaacaattgattctacagtaaattaatcaagagtttgtttaagttacttcttcctaatttactgagagattcaagtttggagaatgccttgtggtaaagtctctcacatcgtgatgcacttagtaggcatcagtgtttgtgaattgaattgtcggtgcaactttggacacattgatgatgatgtttccaaatctgtttctcatgaagtcatttccaacttataatgacatctaaagtaaatgttgtagatatgaaaataaggaaataatttgtcctaaagatgattgagacatgacaaagaatttgattatacttcttataataaatgcagtaattgtgaatgaaacaaatctctttgattatgcttgattaggtggtagcttttttttttttttattagttttcaagtactggtatctatgacatgcattaatgactggcatttttgttgctaatgcaaattattacttagtgttgcttttaattcattgaaaatgttttccactatgcagttaaaaggtttctatgtttagataataattgaaaaatattttaaaatctgcccatgaggaggactgattcttgaaaaaattctgaaatgttactttattgcatatttgaaatagaatttgatgaattttttcttcattaagtaaagcttggtgagtgaaattaatagcaagaaaaatgactctgtacttgtaagatgtgagctttatcacaatctgttttttggaagcttttcaaatatgtgatgattttcctcttcagaaaaagatgttaacagaacagatcgaacaaacaagttttatgaaggccaagataatccagggttgattttacttcatgacattttgatgacctactgtatgtatgattttgatttaggtaagttctctaaagttctaattttaaaagatgtaaatatatttactttagagtttacatttttaatccagttagacatgggtaatagctttgtaggcctagttttaagagaatttgttctccaggggactggaaacttacaaggctatggttctcaaccaaggagccctgggttgctgcagcaaactaacaggagcaccatgggatatttaaaatttttaagggaattataaagacatctataggacaccactctaactactagctgaaatagctaaaggttttaacattagatcattacattctttttgatgaagttatatctttgcaaagctgggtttttggccttgctgtgataagtactgtgtaaaaataaatgatgaaaataaatgaggatggtgatagccagttgaattttaaggtttgagaagtattgtagtgctcagtaggtgataagcacataggatatgaatacttattcagttgttttgacctaactgcttaataaatggagttgttatttctttgagacttaggagtgccttgggaaaaattgctgggatactaaggatgataaccatgaactgagaaagtttgcaaaccgttgtttgatatgcttttcccgttgtgaagaaaaatactgatttgatattttagacaagcagtgcaaaaattttgtagggcatgtagaacttactctttttttggtaaatctctttaccagaaatttgttgtaagaactgatgccggggctgggtgcggaggctcacgcctgtaatcccagcacttcaggaagtcaaggcaggtggatcacctgaggacaggagttcaagaccagcctggccaacatggtgaaaccccatctctactaaaaatacgaaagttagataggctgggtggcacacgcctgtaattccagctactcaggaggctgagttaggagaatcgcttgaacctgggaggtggaggttgcagtgaaacgagatcacgccgcattacactccagcctgggtgacagagcgagactctgtctcaaggaaaaaaaagaactgacggtggaagtagaagtgtgaaattacctgggggagggacgctaaggggtagaaaacttaaggaaccattattttaaggggcaagagaacttaagatatttatttaaagaaccaacagcttgtctaaccatcaacctttaaataagtataaatactagaaatgtttgacttatctgctatgtgagtggcttctagctaaaggatagtggaaataatgttttctagattagtaacgcttgagacatcctttagagaaggtggttggatacttagcacattaaaactaaatgaaccttgaattatgggcacattttcttcactgttcataaatatgtaaatttctcttggtttcccatatgtaagttaggggaagatataatctctgttttgatcttgaggtatcagcctctttggtgacagtaagtcaaaagttgcagagttttctttaaaatttaaaatgtagtcagtcctgtctatgagaacctataatgagcttcagattgaattgttgcaagaatattaatagagtgcttttcaggttacagagtgctttcatacttgatttgatttttaattctcgtagcagccttttgaaaaagtggggaaatctcactttatgagtaaggttattttgattcagagtgtgacttatggtcacacaagtaaataattggtctgggagtagagacccaggtttttattgcaggctggaattcttacctctacaccttcagcgcttcaaactcttgccatttattttagtttctgttaccactgtagggaataggaccattctccttgggaacagaaggcattgctccattctctcagatggtaattttgagatagaaattcatatgtattctgtagcaggagttcctgaatgcttaattttcttaggacattgtcccaaaccagctaactggataacttaccatctccatttgtttatactaatgtcacattctttctatatagacatttcagttacctgaaacatagtcaagcttcctgtggataactggccttatagaagccaagatactttttataaaagcaatagacaacatttcttactctttactcatagcagagcaacctggactgtaaatttactctgtcttgtaggtgatttcattatatggagtttggcttcttaacccataggtgaggtataggtgtatttgcattgaatacagtctcagtagggaggagtgagacaaaaattatcaaaagcagacaaaagaatttaaggaagggtgatttcgagttagtgaatgcggatactacagaaagtttctgtgggtggtatcattgcagggtatgtaatggtgatactgaataatcaatgaaaggttaaattaggagagtgtctaatgttttttaagaatgatttctgatcctcaagatttttgttttttaatttgatactctaaaggataagcttcagtaacctggaaaattgaactatatgttgtttaaatttttctttttggtgtaagcaagtgtacagtaggatgataaggtgttcatttctcgcctgccccccactgcctacactgaaacaaatttgctatggaagtaattttagggaagtactttagaaattgtactggtgctgattaagatatgcatcattcagttgtactgcagactctgagatcactaaatgccaatttaaatatatttaatctttctttaattaaaaggaatttgtacattaattccaccccctacaacccatgacataccccaaagaacataatgtataaaataaaatagcttagggtttttatggttttaggtctaatgtttgtgtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcgacgttatttctgagggctctgttctgttccattgatctatatctctgttttggtaccagtaccatgctgttttggttactgtagccttgtagtatagtttgaaatcaggtagtgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaacttgggcagtatgaccattttcacgatattgattcttcctacccatgagcatggaatgttcttccatttgtttatatcctcttttatttcattgagcagtggtttgtagttctccttgaagaggtccttcacatcccttgtaagttggattcctaagtattttattctctttgaagcaattgtgaatgggagttcactcatgatttggctctctgtttgtctgttattggtgtataagaatgcttaccattcaggacataggcatgggcaaggacttcatgtctaaaacaccaaaagcaatggcaacaaaagccaaaactgacaaatgggatctaattaaactaaagagcttctgcacagcaaaggaaactaccatcagagtgaacaggtaacctacaaaatgggagaaggttttcacaacctactcatctgacaaagggctgatatccagaatctacaatgaatttgaacaaatttacaagaaaaaacaaacaaccccatcaaaaagtgggcgaaggacatgaacagacacttctcaaaagaagacatttatgcagccaaaaaacacacgaaaaaatgctcaccatcactggccatcagagaaatgcaaatcaaaaccacagtgagataccatctcacaccagttagaatggcaatcactaaaaagtcaggaaacaacagatgctggagaggatgtggagaaataggaacacttttacactgttggtgggactgtaaactagttcaaccattgtggaagtcagtgtggcgattcctcaggcatctagaactagaaataccatttgacccagccatcccattactgggtatatacccaaaggactataaatcatgctgccataaagacacatgcacacgtatgtttattgtggcactattcacaatagcaaagacttggaaccaatccaaatgtccaataatgatagactggattaagaaaatgtggcacatatacaccatggaatactatgcagccataaaaaatgatgagttcatgtcctttgtagggacatggatgaaactggaaatcatcattctcagtaaactatcgcaaggacaaaaaaccaaacaccgcatgttctcacttataggtgggaattgaacaatgagaacacatggacacaggaaggggaacatcacactctggggactgttgtggggtggggggaggggggagggatagcattaggagatatacctaatgctaaatgatgaattaatgggtgcagcacaccagcatggcacatgtatacatatgtaactaacctgcacattgtgcacatgtaccctaaaacttaaagtataatttaaaaaaactgtaaaaataaaaaaaataaaatagattaaaggcaaccagaacatgaagattaatttgacaacttgcttcagctaagacttaacagaagaaatatgtagtgattccataagaaagctgaagacttaaaggattaaattggcttcttaggaatttttattcattataacttaataataaagcactttttaagagaggaagggtgctttgtaaatcttttgaatagcacactttgaaatatttctgatgtagatcatacacagtcaggctcagtaacgtagtactcttgcactttgttgaattcagattagatttccttcatgctttaattggtttagcctttattttttgtcattgatttcactgtgtcaggtaggaaagttctgatgataacaatttagtcttccatctatcttattctttttttaaaagtgtgcattattttagaaaccatctgtgtaaatttagataccttgttgtatgtcacttttgtctagcttttttctctaaatgtcttggtaacttcattgtctggtactgtaataattggatgtcctccatgagaacccacgtgcccttttatgctaaattgagtagagctatattttcccacagggtgcagtgtagacagagtgaggttaacaggactgtggaaagatgtggtggtaagatgattggacagaggctcacagcaaattgagctgaaactttatttgtaaggagattctgaggtgatctgagtgcttctgtctgttgtgtgtttgatctgagttttctcaagagatttagtttacctgctttctgagatcattttttaaagttttcctccaaaacagagtaatgtgtaattatgtatcatttatatgatagcagaactatctcctccctctttcattaaatatttacttttacatggcttcagtgcagatagattttggtgaataaaaatgtaaactttggattcgcaaatgaaagactattttccagacttcccaagctaccaataaagaaatttctacatgattttaataaatacacaaaagttaccgaagttgaatgataacgtttaagtaaaaaggcttagtataagttcgtgtcccttcattggttcaagaacctcttaagtctgaaaatttttcaagtcttgaaaattgtaaaacaaggataattgagggttttataagaggaagtaaaaaagaagtttgacatgttcaggtgaaaaagtaaaactaacactttttcttatttttaagtgagggatctgactccttaattttctagtttttcttttaatcaagggctctattactgtcaccattgagaaattgtaataatatcaagagacatgtaggtaagtggtcactttaggtacaaaatattgattgggttaagcccagttgctggcattggttgggtgtagagagtaacaaaaaaagaaagaaggacgtagatatgactatttaaaagaggctcttaattttgtaactcctgttatgtgaatctaaaggtctgattgttaaagcagttgaacccaaagttcttgttttatgtggcttactcatggtagtttggcattgctaaccactctgggcttgcaactttcttgttaatttttgcaacattattctcgcttgatttttttctttacttctctgactggtctttcttaaacctgtctttgagtgtatactcttacatttgatgttcctctggattatctcttcacccctcttctttctcatgatgctcttgcacattatttttaaaaatattacccactcttgatagtgtatctgcactgagacacgtactggaagctatatattgtttgacatctcaatctaaaacaactcatctttcttacttatgactagagttcctcctcttcatttatattcttttcttggtgaacatcagtgtctaccaatttctaaatgcaaaggagaaagatacaattttaagcgaaatggtggtgatatgcacaacttgcagaaggttacataaaacttgggttttcagagatgattttttcttttctttttaggatatgttcaaggaatgagtgatttactttcccctcttttatatgtgatggaaaatgaagtggatgccttttggtgctttgcctcttacatggaccaaatggtaagaacagagattccttccattaaactgatttttaaaattttagttgtataattttatagtataaggttgatttttatatttagccaactatgatggaacttaaaaaaattacctcatgccttttgttactttttctttttagtagcctttcaagggcttagaaatactggtggtatttttaatacaggaaatagtttgtgcctgtagtataggaataatcaggatttaatatcagtaaatgcttattttctactaaagagccatgtgtcattacagaatattgataaaatagatgaattcaattttgtggaatagttgaactttaatatcatctgtttcagagataaagcttagtcatgccaagtaatatccttaccttttgtgaagattttgaattttgtcattatagtaactgatttttctccagatgtgtttgaactatttgtaactctgacactttcttaggaattcattgttattttcccagaagtatgtgattattagaattgaactgtctatatatacatgttagtacaaagaacattttatctattatcattgttaaatctttgagacagagttctaggataatagtgcagagaatattgacaggaaaataaaagaaaagtctcttcaagcaatctcagaaaaataaaagcagaaggggtgagactagataaaggcagatgaagtccaaagacctgactacatagaggttgctgtgttttttcaaaataacactaacatactggatgctgggcctttatgttggatattgaaatggctggcttgcttgcaagggataaacattttgaatctaaccatctgaaatattttcctgtaatacagggtttaactcagagtttctgggatacaaatgtgaaatttggaagtggtacccttctccttttttctttacttctattctttcccttttgcttgcctatttttctttctccttcaaattttccctgcttgtggctatttccccaaatctcttgtccatagattcaacttgtttttgcttctttcagtttttttctaaatgtatacttggtaagatttgatagatttaaaatgttcttttacattaaattcatgaatattcaaattggttttttgccataaattaattttttttgactatttggaaggattatcaatgcagtaatttggtaatgtcatagtttgtcttccttccttttttgattgatttgtctaccttcttagttccatttactcccaagtgctctagaaacctgaggcatttgttataaaggtctgtacagctgatactaattacataaaaactgttgtctgccttccttgtgtttttgttgtttatcctcttttcaccagagctagtatgttccttgataaaagggattatatcttgtttcactggtagcataccagaattttcctaatgcctgacatgaggttgttcaacgggtttttgtagaataaacatgtgaatctttccccagtgattagtttaaattgctatagtagatattctaaaaaaaaaaaaaaaaacacaactaagatgaacatactgcatttagtatcatgcaataagttttcaataaaactaatccaatattggcatgtaaatatatattgacatataatgccacatacacacatgcatacagacgtgtgtatataggtctcatatgtaaagactaccttctgaacatgtgtaataaacactttacagtccgtcattttttgtgtatgaaggttcagtttctttgttctgtcattttcacagtaaatgctctctgtgtttgccttttccattaaggatgttctggggatttttctagtctttattctaaaaaagatatcttatgattatgttgtctgctaacatcttttctttcataatatttgaatgagagggaaatatatggcaatcaaaataacctgtatgattgtttttcactgcattgcccttgtttgatgtccctaaatctgtgctgctgtttcttgattctgtgtttctgttttatagctttacttcatgtaagtttgtactacctttgtggtggctgaacctaacgtctgtaaatttacttttgttgatgtttacttgcatctaatgtaggtctaggcatagactttgtctattatcatggaaatacaaagtacaagtgatctgatgaactttgttatacccatcatccattttgccatatagttttaattcctttctcctctccatctccccctcccctgccccatacagacacatttatttacagacacatttgaagccctttgtatatccattgttgatcccactctcccttctccaggagtaaccactttttcgaatatggtgtctgtcattatggacatgtttcttttttacagcagagtgggtagcaaatgtctatgccatgttggtattcccagatcagctctagtctttgactgtgtcacagcaaaaatgatcctgttaatcagagttgattctgccccttctctatagatctctctggtaaatgtggaggaactatatcctaaagccttgagttagtctattaataaactggtttttaaaattcattaaagagaaacagcttattgagaattaatagacttaaattttttttaagaatgaattgtttctaatatgatagttctaataaagcactattgtactgtaaaagtgaaaaagtaagtgtgaaggaggaaatgtttttctaaggctttcactagggttagggcggtaggttaccacagagggatcgggacatatgagttaaagggatccaaatcatttaagaagcctttcagagcatcagttttggtgccttctggccccttgactcaggtgttggtagggagtctactcaactatgaagtttctttaaagcatatgaaccccagcagttcccaaactttgtgacctcagggccccttcacactctccaatattattgaagacctgaaagagtttttgtttatgtgggttatatctgttgatgtttatgtgaaaaattaatactgagaaacttgtattcatttatttattaattcattaaataacaacacattctaccttaacatagatcacttttttttaatgaaaagtaacctttcctaatgaaaaatttaccgacacaagagattgttttaaatttttcatttttaaaaatgtctggtttaatagaagacagctgaattttcatatttgcttctgtgttcagtcttttggagtatcacacatcatacagcctttgcacttgtgaaagaatttaagtatgaaatccagataatgttttagtattgtcctgaaaatggttttggctttacagattctccaatgtaaagtaattctttaaaatgaaatacatactaaaactaaaattaattttattatgtataatttgaaggaatatttaacaatggaaagaatttgataaatatttatttcccaaatgtgtgtttctttcaccaagtcttttatgctgtgtaagaaataaatagtcagtctgcagttgctatgtctgcattcttctttatctaagtcaaatgaatagaggaaaaaataatccttagttttgagagcaaggattctttctctttaccctcccttttagtgttacgttagatttttggttagttacgcattttttaagattaccagtgtggtataagttcagcatttgtccttagacatcatgttttagttatcagtcattatgtactataaaatatttattaaatattacttgtaacaattatttccttttaaagcatcagaattttgaagaacaaatgcaaggcatgaagacccagctaattcagctgagtaccttacttcgattgttagacagtggattttgcagttacttaggtaagtttagtgaatcagaactatacccagcaaattgtagagtaatgcatagaaaaaaatgtaaagaactctttaaagaagccaggtgcagtggctcatgcctataatcccagcactttggaagccaaggagggaggattacttgcacccaggagtttgagactagcctggctagcacagtgagaccccatctctacaaggaaaaaaaaatgctggctgtggtgatgcatgcctgtagtcccagccactcaagaggctgaggtgggaggattacttgagccgaggaggttgaggctacagtgaactgggatcactccactgcactccgacctgggtgacatagcaagacactgtctcaataaaaaagaacttaaagacatatatactctattgcactttcttcggttccataaaaatgtggaaccaaactctctttgtataattctgccttaaacttgattcgtaaaatgtattatttgttagtttttaaaaagaagtcagccttcaagtttgaaatgattccttaacgtagaagacaaatgtatagggccttgaattgcctaagatgcataggaaagttagagaaaagtaactgtattctgacataattagcataagagtaagtcatatgtgtgtttttttcttctgcatagaatctcaggactctggatacctttatttttgcttcaggtggcttttaatcagattcaaaagggaatttagttttctagatattcttcgattatgggaggtaagtccttaaattattatgcaaatgtgatatttattatgaaaagaaacaatttattctgtagagtgtaaatgaattatgatagccttactgaaatatctaaggcaagtatgttccaaaattctgatgaactggtagcctcttcttaaaaattagtttcacactgaatatttggtcttttggagcttcgttcttcaaatcacaatctctgtgagatttggggccaagaggtatcccagaacaagtgctctagaccatttgctgcctttgttcttcctttgtgagacttgactttatgtgaggctttgccacatctgttatagaggatattcttatgtttttggtgtactccttttgttccattttttacccaaggcaactctttattttttcaacttttattttaggttcagggagtacatgtgcaggtttgttacataggtaaattgcatgttgctgaggtttggtgtgtgaatgattccatcacccaggtagtgagcatagtacccaataggtaattttacatcccatgtttcccttacaccatccccccatgtgtaatccccagtgtttatttttccatggcaacctttaatgaaaaaccaaatcatttcacattttctaaagtatttgctaataataaatcagtgtgctttttttttttttttttttaaagagaaggggtcttgctatgttacctagactgatctcgaactcctggactcaagtaatcctcttgcctcagctttataagtagctgggactacaggtctacaggtgtatgccactgtgtccagcccagtgtgcttgttcatagaatgctggtataatgattgatcataccttaggataacagaaattcttccaaggaaagaattgggagataatccattttgattgtaaatccaactttatacagtggaactctagtggtctctgaggtttttacagctggaaatggattcctatactattgatggctgtgctaccattagacaaggcattgtgctgattacaagttaaaagtggattactttatgctcacttcctctgttctcagattagaagtaaaacccacatggtctctatctggaatcgtacttaaatgtttatcagttttgttaaattagtgtcttaatttgggggttaaaaatgggttaatgtatttatgcctagtgttccattattggaacgctaagcatgtgggagttgtttatatcctactgctcaaggtcatcaccaaggtctgattgaaaaattcaaaaaattgcatcctcaggcataaatgggttttaaaggatgaattaagaatattattaccacatagctagaataactcctcaatctgtgtttactaaataaattcaaacttttaatgaaacctttgaggttaattgcattgtaattaaactttcaacaattgggtttagtttgaaaattattcaacttgatttactccttttgaaagaagtaaacacatttcgggtatgatctcatggtatggtttgtgtgggtgtttttatctttgtggaaaatatattattaggtacatgaagcagggggaaattaagaccctaaattcgaggatattatctgtatttaggaacagctgagctgttgatcaagcgttttctatgtttggttataaatttggggcagttaattcagttattgtcacaatcagggataaaatgtgatacaagggttttacgtatttagaatgtagagctacctctgggtgtttctgattccatgtactgtgtaactgaacctttttttatttccaggacttagctttagtcttttctcagatcgaagtgagaaactgatacttcagaaaaatattgaaaatacatctaacccttacaccttaaccttgtgtctgtagctcctgcattaataacatttatcatactggttaggctcagtaatttacttactatagttaccttaaagagccacatttagaatatatcatattcatataaactcgatgatagttactttgtagctgaaggtaagactctccttcccctcatttcctagctagaaaaaccttgggctaccctaaacaggcaacatctactttgcatagaagtcattcagtgttcagaattgtatctgtgaggaaaatgttttagaattgatacaatttgcaaaatagttcttctgccttctataggtaatgtggaccgaactaccatgtacaaatttccatcttcttctctgttgtgctattctggaatcagaaaagcagcaaataatggaaaagcattatggcttcaatgaaatacttaaggtagttattcctttaattcagattttagtgttctggcttttctatttggtggtcctgatatacagaacgtttccttggaacattattaaatctcttgagtaacttaaattgtgtcaataacagtgctaggaatgactatctgagaatgacagttcaaatacatattggccagttatttttacctggctaattaggaagaaaaggaaattcaacaagtgctcttttatgtagtttagtttttcaaaaattaattgtcttttgattataactttgagatatcagacttggaatagctgctggatttaatgttccataagcttattagctagtctttagctttaaaacttgaaataatctaaagaaagatatattgaatttcttacgtatttgtagtatatgaatgtttttattttaaggattttatctgcagtgaaatataactggtaataaattgtttatataatagaatataatagtgtattcagtttcgatatcattttattttgttgatactttttagcatatcaatgaattgtccatgaaaattgatgtggaagatatactctgcaaggcagaagcaatttctctacagatggtaaaatgcaaggtatacagtgtttcaagtaattgcaagatttgtttgtttttggtgggttgagatcaagaaagatttttcttcttggaaataaaatagcaactttagtaagctgagggcaggcacaaagtattggctggctttttgtttgctgttctagatttacagcacttaattgaaaacagttgactatggcagataggaaacagctaataataaggcaaaatggtaaaagtaatgaaaatatttctataacaaagaggctgtagaatttcagcaatgatatattacccagttgagctcatgaatgcagaataggctgtcatattaaatatgcagaatctctaaacaaaaatgaatgctaatcagaaataattaaatcaatattatttagcctgtgtcactcacttatattagtcaagttattaattattttaaaacaaggcaaatttgatgtattatctgaatttgaaccaaagcagtatacttttgatgtgttttagctttttctttctattaagagaaagggccttgctaagttgcccaagctggccttgaactcctgggctcaagtgatcctcctgccttagtttcctgagtagctgggattaccagtgcatgcacaccactgtgcccacctcatgactttgctttttttttgagacagagtcttgttctgttgtccaggctggaatgcagtggcgtgacctcggctcactgcaaccttctcctcctgagttcagtcgattctcctgcctcagcttcccgagtagctaggattacaggtgcctgctaccatgcctggctaatttttgtatttttagtagagacgaggtttcaccatgttggccaggttggtctagaattcctgacttcaggtgatccacccacctcggcctcacaaagtgctgggattacaggcgtgacccatcacgcccggccatgactgcattttttttttttgatacttcaagttctagggtacatgtgcacaacatgcaggtttgttacataggtatacatgtgccacattggtttgctgcaccccttatgactttgcatttttatgaaaattcttgcttggtccttgtatcatttgttcattgatccaaactgttacttggttcagttctacaaacatttatttgatacctgttctcttccaaagcatgtcaatgagatacttcttgccttgaagaactttgtttactgagagagacagatgatctaagaaagatattattacaaaaagtagaaagagataaatgccaaatattaggacatgctatgtttgtgggaatgtggaggtgggatggagagtgactaatttggaagatatccaagaaccacttagggcgaaaggtggttagcatttcatttggagctgagaaaaatgttgtgagaagggtacatgacatttacactgttaggacaaatgctcagattctggaatcaatgtagtcttaaacagaagtgttactttgtggttatttttcctctgtagtgaaatatggttttgagtttgatttttcatatccaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctgcttttttaaaattttttttcttgagaaagagtcttgctctgttgcccaggctggagtgcagtggcgcagtcctggctcactgcagcctccgccttctgggttcaagcgattctcctgtctcagcctcccgagcagctgggactacaggcttgtgccatcgcgcctgactaatttttgtattttgagtagagatggggtttcaccatgttggccaggctggtctcgaactcttgacctcaagtgatccactcgcttcagcctcccaaagtgctgagattacaggtgtgagccactgtgcccggctaattctttaatagaagaaaaaacatccaagatggacctcaattcatctcttatttttatatgattaaaatgataatctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaatgataatctgaataagttatggaaatgaaaaccatcctttttataactgaaaaaaaattttcattagcatggaaatgggcacagtgttgccttgaaagatacagttatttgactcagtaaagcagcttattacaactgatgctaatagtatagagaaaaaagttgtgcagttctaaaatggtcctagagattgacttttttcccccaagaaagttagggaacaaaacgaacttttttcctggttgagcattaactgacaatcacgacagtagaaccgttagagtttagtttttaatattatgtgtgttatctttcatcagttaataatgagtaagcctattcagaaaaagaacataaactgatcaaaaactcagcatctccagcctttcatttcctgctattcaggaaattgcttagaacatcttgatgtcctccttgttcttcctggacagtgactttttgggagtttgttcctgctgcgtaatgtgatacccacttcagattttttttttatcaatacatttagtaagttgaacttctgtcaagttttattacaaaattacttgttaaaacaatttttactaaactgcatttctatctagcatatttttgatatggaagtgatagtatagtatagttccaggagaagtcttaaatcagtccacagagtccagttagcaaatactctgtgccattaagattgctaaaatacacagttcaggtaaatttactagtgttttttaaaggtttatttgttttcacaagatgctctgtccacacccttataacatgtaaaatattgtgtgctgtattatgtggtaaagttgttaaaattcagtttctaacattaacttaaaagtacagacaatctaacatgatgatttgacttacaaactttcaactaaatttatgatggctttaaagcagtgcactgaatagaaaccatactttgagtacccatacagccatttttcacttttactacaatattctataaatcacatgagatatttaacactttattataaaataggctttgtgttagatgattttgcccaaatgtaaactaatgtagtgttctgagcatgtttaagttagggtaggctaaactatgtttggtaggttagatgtattaaaagcatttttgattaatgatgtcttcaatttatgatgtgtttattggaacataacctcaatataagttgaaaagcatatgtattttcaattctggcatgaacctatgggaatcttttgcatttaagaacctccccattttaataatttcatgggtctaagattcttcatctgtttataaggaactttagtcttagtgattagagactaaatttttttttgagcagtaagaaaacagccttttgggacagatagtgagtgattcttaggaacttgacattgccaagaaattttatagatgccgaagaattcttatgtgaaattcacataagcatgcccattactaaagacagtttgtataaagtaaccctaaatgtttattgaggaacctacagcttcaactgacttacgtgcagatatgtaccaggagaacatcattttagcttgggcgtctttacttggggttttcagaggatccaggaacctcactgtatgcaaagtcttgtggatgtacctgaatgtttttggaggcaggtcacatagtttctgaaagtgttctcttattttcctcaaatgtaggtaaccattgttacaagttatttaacaggagaatagtaacaatgtctaacttatgctaatgattttgtgtgctgagctcccattaattaaaatgtcttcagaa

SEQ ID NO: 2778 - DNA, 87143 bp, Homo sapiens; identical to SEQ ID NO: 2777
  source 1..87143: mol_type = genomic DNA

SEQ ID NO: 2779 - DNA, 87143 bp, Homo sapiens; identical to SEQ ID NO: 2777
  source 1..87143: mol_type = genomic DNA

SEQ ID NO: 2780 - DNA, 87143 bp, Homo sapiens; identical to SEQ ID NO: 2777
  source 1..87143: mol_type = genomic DNA

SEQ ID NO: 2781 - DNA, 11326 bp, Homo sapiens
  source 1..11326: mol_type = genomic DNA
aggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtaagcactgaggacgcattccctcgcttcagtgtatgcgaaacgccccgtctagtgatcagctcttctctcaggccttggctctcgagaatccggcacggccttggcaaacaccgatctcttataaacgcgccgtcaccctcccgtccaccgccccagggaagaacctcccatggccccgcccccccggctcaggcgactccttgagccctgccccctgtggaacgcacgtcagcatccgaacgcgggctggaccattctccccgccttggtcccggggcaatggccctcccggccccgccccctgagggtggctcctccctgggcccgtccctattggctccccaggctggtcccctcgcttgggccccagccctcgctggttccccccaactcaggtggtgtttgagaagggcggagtgtacctgcacaccagcgctaagaagtatcaggaccgagactctctcatcgctggtgtcatccgtgtcgtggaaaaggtgcgctgggagggagcagggctcggacccgctccgagcgggatgcaggcggtctgggatgcaggcggcagctgtaggagtttggtctggcggtcagcagtgggacctgaagaaggctgggtgtgggaactggaatgaggggcgggactttgaaaggctgagggtagaaactgggaaagtttggaaatttgcaacggaaagttttgggaatgtggtttggggagcgcctctaaccccgcctccctccttaccctaggacaatgacgtcctcctgcactgggctcctgtagaggaggctggagattccacccaaatcctcttctccaagaaggtaggctccacccgctttgcccttctccactcgctttttttctaggtccgtgctgttgtaagtcatttgagggacctgcgtacaatcccagacctactcgtggggcatgtgtgaccctgtttaggcttgggtactctgcctctccttttgctcctctctgtgaaatgggcagaggatgcccattcaaggaaaaagagcagggagcataagacgcacggtcgtggggacggctgacccctctctccctttgcttcttgggagatccctgccagggtgcaagatgtggattcgagttgcttgaagggaaatggcatttcctctggtgccagaggacagggcctgacagcctactcacccacttcgtcactgctcccggctttcccttcgttatgtctcctgggacttcccatggctggaccccgtcctgggcaattctgagacccagagataagtcagatccagacccacctaagccctgacccttactcactttttgagaaactgatagatgaggtcgaaaacgctaggaagtgttggaactttttgcacccagacagtctgattccagatccccaacgcttcctgggagagcagacatttgagctgggactcccaggatatgaaaggacaagaaggtatttcagggacagcagaacaaccttcaaggcacacggagaagttggatgcctctgtaggggggttctttagtggggaatgagacctccattggagctgatgagttccacccaggggccggaagtcagtcggcacccacagagctagtgacgagacactggaaggctgagctgaccacctgcgctgccccagggcaggaggatgaagatgaagatgaagatgactctccaccttgctccacagccaaacacagccaaggcaccaggaagttgcgttacatcacttccgctttccaggttggcctgcatctggttggtagaatttgtcctgtgtcctggattccagctgcaaagaaacctgggaaatgtagtgtgttttttttgttgttgttattgttttttttttttttttttgacagtctcactgtctcaaaagagtgcaaagtggtatcttattgtggttttggtttgtatttacctggtgagtacaacagtgtccattgagcactccgcagcctgactgcagagccacctgctgtgtagcatggacctccccatgcagtgggagacatggggtcaagtcctggctcgctctctggctgcattgggtgaccctgagcaagtgctgtactttcttttttctttttttttttttttttttaatgagacagaatttgctcttgttgcccaggctggagtgcaatggcgccatctcagctcactgcaacctccgcctcccaggttcaagcgattttcctttctcaccctcccgagtagctgggattacaggcatgcgccaccatgcctggctaatttttttgtatttttttagtagaaacgaggtttctccatattggtcaggctggtctcgaactcccgacctcaggtgatccgcccgcctcagcctcccaaagtgctgggattacaggcgtgagccaccgcacccggcctgctgtaccttctttgtgcctcagtttccctctttattcaatggggctatcttccagggtagcctcgaggctaagatctgaatccatggccccttactgtctgctcctttcctctcctaaggactccagtgggggtgactcatgtgcttctgaggaggaaccaacctttgaccccgactatgaacctgactgggctgtcatcagcactgtgcggccacagctctgccactcagagcccacgagaggtaggctgaggtggcggcccttgagaagcacgtgtgggccaggtaggacacatcttgccctcagtggtcacggtcccaagggctttgctgcccacaatcaagaaggccaccagtcaccaccttccagtcccaggagcatggaagtgaatgggaagacaggactgtcccagcccaggtcaacatggccagtgtctctgagactgcagccttgctcatcctactgggctcccggattggctgtgggtgctcccacaccaggcctgcccctgaggttcgaggctggtggggtgacagatgcagccagttagggtgatttgcaccatcctggggtcacacagggtgcaggggacatccagagaaggcacgtgacccctctggggaatggagattccttccaggaagaggtgatgctggagcttggcactgagggactcttgggagttttctcttctggcagagagagcagcccgtgcaagccagaggcaggcggcccccgtgtgtttagggagccgctggcctttcattgtagctcaagtgtgggattttgagtgaagaaaggttggaggtaagataggcaggggcgaaggacagacccgaggggcctcgagtgccaggttgaggaatagggcccttaccctgcaggtcgaggggtgcctaggaaggttctggaaaggtacatgtccactgggcccccttcccatcttactcatttgtgcttccaaggaatgtgaggccaggggcagaggggtggcttgtggcggggccctcaggagatgcctgtgccgaaggaacatcctgggttgtggttgataaggctgactctggcttcccacgcgcttcccccaacacagtgccgtctccctaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccaggtgagctctctcccagtgctgggccttaaaccgggcccagtcccaccatggctgcagcgtgacccctcggggctgtgaaagaaacacaactcacactgatttaaaggcaggcaaagagttgaccagcacatataactaaaaagtcaaaaaggagtattgatttcaggcaggacccaggtcccaaaatgttagaaacagttatcctttttccctctgagttcgttattctctggggccccagtatccgtggcttaacaacccggctggatagaaggcacctctttccccacgttccaacaagatcccagagctgcttctcattggctcgtccctgagtcagtcacactggaccggaaggtgaaaggccctcattggccagccccgagtcatgtgcccacccctgggatccagctgtgggcctcctttaacagcattccctgaaatgaggggttgcccaggggtggttgggacgctgcagctggaaccgatgtcggccgagcacagacagcctgggacactgggcccctacctgtgcatcacctgtgcgtcacctcccgcctcccagctccccgcaggactcccgcctctaccttgtcttcccccacgactcctctgctctctccaactccttccaccacctgcagctctttgaccaggacagctccaatgtggtgtcagtgagtgtccccagcaggaggcctggcgggtgtgggcagggagggacgagaaggggcgggccgtgacctccctttggcctcgtccccagcgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtgagtagtgagtggaccctccctgttatttctggccgtgtctccctgggcgcatgatttcatttccctgggcctcagtttcctctttggtaaaacggggatggtaatgggacaccctcagggggtgcatgaggaaagcgctcatggctctgccagacactgtgagcacctgctcacccttattgggggacccctcctaactgggggatgacttggctgctgagccccggaagaggctgctgcctgcccctgaatgttagtcatccgtcaagctaataagctctctgagcttgtggactgaggctgggttgggtccccccaccaccccgccgagccccaggctcatttgctctttgcctgcaggtggagctggggcctcggccaaccgtggagcggggccctccagttacagaggaggagtgggcacgccacgtgggccctgaaggtcgcctgcagcaggtccctgagctgaagaaccggatcttctcgggggtgagtgccaggacaggtggaagaatggggcagggccagaacaaggccccactgagctgcctgccctcctgcacccccagggtctgagccccagcctgcggcgcgaggcctggaagttcctcctagggtacctcagctgggaaggcacagctgaggagcacaaggcccacatacgcaagaaaacgtgagttctcaggaggccctgccctgccaggcatgacacctggtacctcctagggcaccaatgggcaagttctgtggacgctggttgtgaacctgctgtatctgggcaccatcctgcgcctgtggaatacggcaatgatcaagccagacccatcctcacccctgtatggtctgtctccattgcagttttcattcctgtgccatactgttttaatgatcacagttttgcagcatgttttataacctaggagggcccgtctctcctcattcctggtgtaggttatatacctgccaggcactgaggatgcagcagtgctggacgattccctgtccctggtgccctgtccagtggggggtgacaaattttcatcaaaaggccacaaggctatgtagtgagagatgccaggaaggtgaagtgtaagggatagtggcaagaatgacgaggtgacctgcttgggtctgtgtggtcagggaggggctctgcagggctgacctgggaggtggcgccaggcttggaggtctctgggtgttgcagacagtggcggcctcacatcttgtttccctctgtcactcagggatgagtatttccgcatgaagctgcagtggaaatctgtgagccctgagcaggagcggagaaactcacttctgcatggataccgcagcctcatcggtcagtgtcaggggtggcacttagggtggatgggagcagggaaccacaggagggcctcaggcataagtgcgagtgggagatagagggagccccctgcctccccaagaccagtgagagggcatcttgggggaaagctgcatgggctgttggggaatggccctgggggagcaaggccagggacaggatgggaaagaaggggagcccagctcccttcaggcccagtctcagttctgtcaatgcctggtgatcttggcaagtgattttgcctccctgggcctcagtttcccctactgtgggaggatatagccagctggtgagtgggaggcctggcgcctcacagcaggagcatcagtgatagtttctagaaccagctctgcttctcccccagagcaaaccccgaggctgggggctgccagcaggaggagcagtgggggctggcactggtggccagcagggatgggcccccctacctttctcacctttgcaccctgtgcccggtccccgcagaaagggatgtgagccgcactgacaggaccaacaagttctacgagggtcccgagaacccggggctgggcctgctgaacgatatcctcctcacctactgcatgtatcacttcgacctcggtgggtgccaggcctggggacgggcgtggccggggctgtccaggggagcgctgcgggcttggctgcagcctgaccccatgtccccccaggctacgtccagggcatgagtgatcttctctccccgatcctctacgtcattcagaacgaggtggatgctttctggtgtttctgtggcttcatggagctcgtggtgaggcttgggtcaggggtgggacacaggcctatcgagcgatcaggtgtcctggtacctcacggggtctgctctttcccccctccttccgtcccacagcaagggaactttgaagagagccaggagaccatgaagcggcaactcgggcgactgctgctgctcctgagggtgctggaccccctgctctgcgacttcctgggtatgtctctcgggagggtgggcaggagacaatggggccatagaccttgccagattctctggtagcagccacagtggcatcctggacattgggtcctgatccaaacaagagaaacatccccacacaacctagaatgtagaggcagaattgctgtttgaagcaaaacttcaccaaatgcagacacgcaggaatgctgactcaccccgtcctcatgctcacctagatcctgtttgggctttgcctttggcttaacctgcagggtatttttcagaaataaggacctaggcattcctgccacttcttatccccacctggctgtggctcaccttgaaccaggaatcagagactggttctctgggccctggggctgggggtgctgcatcccagctttaacatttttattcttcgaccaggcacagtggctcacacctgtaatcccagcactttgggaggccaaggcgggcggatcacttgaggtcaggagttcaagaccagcctgaccaacatggagaaactgtctctactaaaaatacaaaattagctgggcctggtggcacacgcctgtgatcccagctactcaggaggctgaggcaggagaatcgcttgaacctgggaggtggaggctgcagtgagccaagatcacaccatggcacttcagcctgggcaacaagagcgaaagaaactccatctcaaaaaaaaaaaaaaaaaaaaatatattctttattacttggtcaatgtaaaaactgcaggaaattaagatgaagaagaaaaagtaaggctgggtgtggtggttcatggttgtaatcccagtgctttgggaggccaaggtgggaggatcacgtgagccaaggagtttgagaccagcctgggcaacactgggagaccaaaaaaaattgggagactacaaaaagatttaaaaattagcctgggcgcaatgtcatcctgggatcacgcctgtaatcccagcactttgggaggccaggcaggtggatcacttgaggccaggagttccagaccaggctgggcaacatagcaaaactctgtttctactaaaaatacaaaaaaattagccagccgtggtggcgcccacctgtaatcccagctgttgggatcggctgaggcacaagaatcactcgaactggagtgggggaggtagcagtgagcagagattgtgccattgcactccagcctgggcaacagagtgagaccttgcctcaaaaaaaaaaaaaaaaaaaaaaaaggtcgggtgtggtggctcacgcctgtaatccagcactttgggaggccaagataggcagatcacctgaggtcaggagttcgagaccagcctggccaacatggtgaaaccccgtctctactaaaaatacaaaaattagccgggggtggtggcgagcacctgtaatcccagctactcaggaggctgagacaggagaatcacttgagccaaggttgcaccactgcattccagcctgggcgacagagcgagactttgtctcaaaaaaaaagaaaaaagaaagttaaagttgctgtttgatatcattgtttttcttgagtgcagatggtgatgataataagttaaacttattcatgaacatttcctcgatgctttaggacccccgggggagggagctgagatactctgtcctcaccttactgatgaggaaactaagccatagaaaagcatcacctcctagggcacaaggacagaggctgcctctgggtcattcaaagtcttctgaaacatcacttttcttgactgcgcggcattgtgtccacctgcaagatgtggtagatttgatgtaacttgacctgctggagattcgggtcctttgcagtttttcatcacggtgcatagtctgggtaatttcttctttaggttcacttccaagaagtggaattttgttcaggacagtgcttgttttcacacagctttggagagtttgtcctccgttgttactttcctcaaaggttagaatgctcagactctcactttcatttgagttaacttggggggaaaaaaaggttcaacaccagcttaattttttttttctttttgagatggagtctcgctctgttacccaggctggagtgcagtggtgtgatctcggctcactacaacctccacctcccgggttcaagcgattctcctgcctcagcctcccaaggagctggaattacaggggtgtggcaccatcccagctaatttttgtatttttagtagagatggggtttcaccacgttggccaggctgtatttttagtagagatggggttttaccatgttggcctggctggtctcgaactcctgacctcaggtgatccacccgcctcaccctcccaaagtgctggggttacaggcgtgcgccatcgcacccggccttcagcttaaatttttgctacagcgtatctaggagtgtcagttcccttagcgctcaccagcagcgggcagaggtctgtttcgtcgggcgtgctgggcgtcctgcctcccttccatgtccatggcagatgtggaagtataatagcacacttcctctggagagtgggaggaaggaggggcagggcccgcgttcagggctgctcctgcctcacctccgaggttccccagccaggcataagtcacttgcctagacttggggaaggtcttccagtcaggatgacttctcaaactctcagtcccagcgctgggcaaggctgagtgggctccatgtcatcccccagattcccaggactccggctctctctgcttctgtttccggtggctgctcatctggttcaagagggaattccccttcccggatgtccttcggctgtgggaggtgggccagccagtttgggcgagaggcctgaaggggtgggctcacctgccctgggaggttgggcggagagggacagaccctggtgggacctcaggcccaggctgggctatgacctccctccctccctctgtcccgcaccctcaggtgctgtggacagggctccctggccccaatctgcacctgctggtggcctgcgccatcctggacatggagagggacaccctcatgctgtccggcttcggctccaatgagatcctcaaggtgaggctccggccccgcccccgccctgtcccccctgagctgggcgctgcccagggccgcagtacctccggggagcaggtgtttagtgtgggattattgaaagcctggttagttgggagcgcagtgggggtggggccgcgtaggtttcccttctgccccatgccatgcctgctcccagcaaggtcctccgggcaggtgggtggggaccttccctccccgagtacgtgctcagaatgctcccggaggcctgagaagcatgtctcgcccagcgcacttctgagcccccagagggccagcccggtgtgtcttcattgtttcccagcacgaagcacagagtgggcgctcgggcggaggtggttgagtgccgactggcgcctgacccaccccctcccgcagcacatcaacgagctgactatgaagctgagcgtggaggacgtgctgacccgcgccgaggccctgcaccgccagctaaccgcctgccccgtgagtccccgtccgccccgcagcgccccgcccgaaccccgaccgacccccgcccccttctcaccttcaccttccgcttttcgcttctctcatcccgtgcctccaggagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 2782 - DNA, 11326 bp, Homo sapiens; identical to SEQ ID NO: 2781
  source 1..11326: mol_type = genomic DNA

SEQ ID NO: 2783 - DNA, 40998 bp, Homo sapiens
  source 1..40998: mol_type = genomic DNA
gcatcgttataaaatgtcacgtttattgctacagtgctgttatatacaggacaggtctctgaatccacctgaaagagggtcgttttaaagtcccaatcatccagccagctgtgttgacacgtatacaattattttctttaaaaaaatttttttgaaaaccatcttgaggcactcagatcacaccccccaccccccataattgtggttcccaggaactgctgtttcttcctcctcgcgctgggtgaatctcgtttgaattctatgcagaacgcacagttccagaggctatggggccactgcccacccagacctaggggcagggccaggagcaaaacaagagggagaggcaagttcccttaagagatcaaactcccagggcgtaggggaagccaccgagaagggagaggcagccggacagcccctcccctccgcctggcctggactgggggcagataccaggcattgagctggccttgaggtttcccttgcatctaccatggggcccaggctcccaagccagtctggggaggggagtcaggcagtccaggatctcctgggggtaacggtgggagtctcaggagtggcacggggggagacgcccgacctgcagcggggatgaacacagccagcccaggggtccacaaggcctcaatgcagggaggggcatgaagggcacatgaaggcccccagctagccaggcccacacctgggtgccacagtgaccactgccctagttcgtgtggaactggatgggatcccagggtaggagacttgcagttttaaacccaagacagtccccagccagctgggaagagctggttaccctcatggcaaaagaccagaaaaggagacctggagagaggcctgggtgctgggacatgggacacagatgggcccgaggggacaccctgctggttctgcagcagggtcggacgcacagcccaaggccttcgtggggctcagaccagcacagtcccccggctccagccactcttgcccttggaccacacagagggagggcagcaggtgtggccccaggcccagggatgctccccagcattgggggaggctggccaggcccctggcatcctgtctacgtcacgatggccctctggtgtaatggggacatggtggggtggggtggggggtgtcctgtgctggctcctgagcagcatcctctcagccagagttcagagcatgagcctgggtccctggggcaaaggagtgaaggacagggtgtccaggaggtccccagcaccgggctccagggtgtggtccccatgccaggggtcactggtcccaacaaaatgccccatttcagagagctgtgcaggttccaagggagagcagcttaggggggcctggggagggcgttgtgtagggtagccctgggggccacagctgcttggcagagtcacctgggagggtcagagccaccttgctgacgtcccttcccccaagcccaggtcagtccccttcctgaggggagaggatgcggcagggaagccccaaggtgccttcatcagggaacgcccacgcatcactttccacatgacaaaaccaagagaacccccaacatcaaaaaaacaaaagacccgccgcctgtccccgttctgtctgtgtgcagtggcttccggggggggggggggacgggggggctcaggtttacacggggtctttttaatacaacgtttaatcatctggttgatcaagaaatgcaatgctcagtctaggaacagcagcagaaatagcgagagacacgggacttttatacaaaaaaatttgttgcttacaaaacatatgcaaaaaaagcttaaaaaaaccagagaccaaaggcagcatccttgctaattttcatctacattaagaaaaaaaaaatcttgtaactaatgtttttattttccttaaaaaaaatatttcgcttaggcacaatttgctggtggctttagaagaataagccaggtttccacagcatcccccttgagtgatatgtttccatttctccgctttttatagttaaggcatttttttcttctctgacaaagtgtatgttttgttgcttgctttcaggttttgtttactggaaaaaaaaaaaatgctcctgtcagcccaggcaacagggccaagatgcagtttcaggatccatgggacaggtcacagagtgacacggtggctgagattcggggacagggggagcgaggccagtgagtggtaggccagggccccagggagctcctggacccagtgtcaccttggccgcccccatcactccgaaccttgtcaggttggtgttggctcgatgctgacaacaggtgtgtgaggtgtggatgtggatgaagcccggggtctcgagtggccgttctggggccagagcacagggctgaaagcgggtggctcgtcccacggaggcatacctttcacatgtgcccggcggggttgtgggcttcgctcaggcctgggtggggagctgaaagcaccatctgggggtctccaaccacacctgacaccttttcctcttctcgccgtttcaaacaggctgctttgggattcaggttccgctctggagggaggggggagagctctgtgggagacggtcccagggaggagaaagatgtgaggtgggagtggggggtaggatgtcgggggggggggtgggggcagagccccatcacgtgtggcctcctgtatttccggctctcacctccttccttgagaaggctggggggatggggtggaggcttgtaaagaagagagtgggtatcagggggtgtctggggaacatcactgggtctgagtccagccacaaagacagacatggacagagtccgggggcggcaagcacaggaggaccccagcatctgcacctgggtgtggggaagggagagggtgctggggcagccctggccggggagcctacctcgcacctgctgctccagccccaggatgacctgcacggcctgctgcaggatgagcagcttggtctgcgctttgtccgacttgaggtgcatctggcacatgcgccccagctcccggaaggcctcgttaatatcccgcacgcgcacccgctcccgcgcgttattggccatgcgcctctcccggtccctcaggtctttctcctccagggacagcacctcgtccgtactgctgggtcacagcaccgaggcctctgttagtgatgcgccaaggctgggtgggagggcagggctgggttgtggagagggtatccagctacttgtgtttgtgctggtgtgggcagcagtgtgggtacacggctggtgttggtgggcacagcagtgtgggcagcagtgcaggtacatggcttacattggtgggcacagcagtgtgggtacacggctggtgttggtgtgggcagcagtgcaggtacacggctggtgttggtgtgggcagcagtgcgggtacacggctggtgtgggtgtgggcagcagtgcgggtacacggcttacgttggtggacacagcagtgtgggtacacggctggtgttggtgtgggcagcagtgcagttacacagctggtgtcaggcactgcagtgcaggtacacggctggtgtcgggcacagcaatgcaggtacatggctggtgtgggtgtggacagcagtgggggtacacggctggtgtgggcagcagtgcgggtacacagcttacgttgctgggcacagcaatgtgggtacatggctggtgctgctgtgggcagcagtgcagttacacagctggtgtcaggcactgcagtgtaggtacacggctggtgtcgggcacagcaatgcaggtacatggctggtgtgggtgtggacagcagtgggggtacacggctggtgttggtgtgggcagcagtacgggtccacatgctgatgtgtgtgttgtcacatgcgtgaaaatgtgcttctctgtgcacgcggcgaatgtgctccctggaatgcagcagagccccatggtggggcgcctgtgtgtgtacgcgactggctgcccaggtgcaagtgccctcagactcagctctaggggaggctgtggatgtggtcacacccaggaagacccaaggtctgactgttcccagacgtttctgtggagggagatggggccctgcttccccgtctgggagcccacagggtaactgcttctcccttgaccctgctcactctgtgggccccagggcagggctgggggcaggggaggcccagtgcctgctcctctctttgttcttccctcccaagatgatgactttccctgctcagagcagccacttgcggggtgatggacagctaggcctggccagactcactgtggacagaggaggccttgaagacacgggctcagcaggcaaatacctgggccactccaaaaacccgggactggggagtccaggactcaaatcagggctcacatggagcaaaccagctcccatcccccgagacccccacaccctggggaggagcctcagaaatgcacccgtcccctacagtgaactccggctgccccaagatgagccctccctgagctcctgcccctggctgggaaggccagctccctaggcctccaggaaccccattgtcactgccaccgtgaatggtcgcagtaggagctctgaggttccaagagcctgttctgtgccaggcccaaggctgagccccctctccagccgagcagcatgcagctggcgagcgggcactgttgctgctgccgcaggggtgcgggtcccggcccaggcctctgtgctgcatggccctgcatgggtgacctcgctctgttccctggcttcctacttggtagaatggatgccggtccccatcagggcacccactgctctaggttgtggtgaagatgaaatgggtgaaggtctggcccagtgcccagcatgcctggtgccctgtcttagtctctagggggctgcctcacccacttgcctgcccaccctgccttaggggcctgaggggatccctccaggtggtgggggcggcccctggagcccaggacaagcgcacagaccaaactgacaggaccaggggctgcgtgctcccgggtctggtttcttcccgcaagccctgacggggggctttgggggaggaaacgccctgaggttgcagcccagccgctcccggtgctcgggcagcaagtgcgaggtgaggaggggctgccacgggaagcagagggacggacgggcgggatggaggggagggcggaaggcagacagcagagaggcgggcttggggggcgcgaggcgtgccacacacggctgcagagactcggaaaccttagagctgaggggatagcgtgtgggccgggccggggctctggctccggtcccagcaacagtgctgcaggagagaaagggttaacggggtgcaggcgaggaaaggaaggagttaaggaagcagccgccagcgccagcggggggaaggagtcagctcacatctgcgggtggggacagggtctgtctgtatccttcctccccctggccctgggaaatgggggtgataggaagtttccctatcaccttcagatagggaaactgagtcagagacaggggatgggctcatgtggccttgcgtggcatctgcctgacgggaaggggccagggtggtttgcacaccagctcctgtctctgggatcgggggacactggcctctgtgagctgggttctgggcttcccaagaaaggaggaccacggcgagtgggagccccgtggagctgggagatacagttctgagccacagagcccaggcctgaaggactaggggtccagaaagagtccagtcctcccactgtggaggggatgctgaggcaggcagggagaagggctggcagtcaggagtggacagtcatggcaatgcggtcagaggggtgaagggcacagtcactgcaaggaggcaactgctgcagagggagggctggctccaggaaggcgggcggggaaggagaacgagggcaggaacacgagggagggtggcgctgcagggacgctggtggcccgcgcccccactgacctcgcacttgctgctccaagttcaggatgaccgagacagcctggtgcaggatgagcagtttggtctggggcttctcgctgttgaggtgcagttggcacatgcgccccagctccttaaaggcctcgttgatgtcacggacccgcagccgctcccgggcgttattggccacccggcgctccttctcccgctcggccttctgctctggggggagaaggtcgtcctcgtcctcgtctgggctatggggagggcgccgggagggggccagagggagacagtgaggttgggggaagagcgtggggcccgccgacggcctcccagtgtgggtgcggtgtgcgtgtggcctgtgcacatgtgcgtcctgatggggtgagggtggggagtgccgaggggtgggttggcacctggtccgggcccggggggccttcagctccttcttctcctcctccgagtggtcagccgctgacgtgttctcctcgtcctccttctcctcccgcttgatctcgctggcggccgccgtggcacctgctcgccctagccctgcaacaggcctagggtcaggggcctgcgtcggcctccagggccaactgacatatctctttgtgctcctgtggtgagggacttgggctttcctggaaaaaccaggtcttggccaaaaataaaaacaaaaaaccaacaaccagaactggatccctacctcacgccatgtgtagctaccaatgccagacagattaaggaccacaagatgaaagggaaacagttttaccacctttggaacaaagtgtgtagaaattctgcagcaactcaatggcaggaatctactaagatgctaaaagaacactcttcttttttggtgaaagtaaactgtttcaatcattaacttaaaaatatggaacacttcggatgggcacagtggctcacaccagctcacacctgtaatgccagcattttgggaggccgaggtgggtggatcacgaggtcaggagatcaagaccatcctggctaacatggtgaaaccccatctctactaaaaatacaaaaaattagccagctgtggtggtgggtacctgtaatcccagctacttgggaggctgaggcaggagaatcacttgaacccaggaggcggaggttgcagtgagccaagattgcgccactgtactccagcctgggtgacaaagcaagactccgtctcaaaaaaaaaaaaaagaataaaactttggaacacttcaggaatgtccacgtcacccttgtgcagatgctatgctaatctttatcattctcattttagtccaagagctgtccaagcaagtgctcaaagcgctgcttttgaaagaacacaggccgggcacagtggctgactcacgcctgtgatcccagcactttgggaggctgaggtggaagggtcacttgaggccagggggtcatggctaccgtgagctgtgatcatgcccctgcactctggtgtgacagggtgagaccctgtctcaaaacaaaacaagtaaaaaagaaaaaacaaaaatcagtaagctggactatatcagaattgagagttcctgatcagcaaagataccaggaaaagaaaagcatttgccaaagaatagaagacacccaccacagatgtagccaaccaggaggtgatctcccacaatcaatgggaaaggacaaaaagaaagtaactcagtagaaaaataagcaaggtatccaaaaaggcatctcacagacaaggaaaccacatggctagaaacacgtggaagtccgcttcagcacatcaagagattaaggaaatgcaaattagggtggctttgcgctaccctttcatacccagtcagctagcaaagttgagggacctgaacagtcaaaatcttgcctgtgggagggcaacttggctgctttggaaaataattcatcagcctttcctctgaattgacaacaggtgtatcacacccttgatcagcaggttggcaggaaagcgtgatgttggaatgacctacagccccacgcccgggccagggccaacggcacactcacaatgggaccccagccgctcacaccacacatgtaccccacacacaacataagccagcaaaccagcgtgtaaagaacacgctagtgggacgccgtgttcatgaagctcaagaacaataattgcaaaacatgtggcttaagggtacacagtgccccaaatgaatgcggccactctgcattcagcagggcctgggccacccccaaaacccgggcttggggagtccaggaatcagtcagggctcacatggagcaaaccagctgccatcccctgagacccccgtaccctgagggggagcctcagaaatgcacccgctccccacagtgaactctgctccaatcggccaacgccagccaccaggaccagcccaggcctcagcacacgaagtgaaggacaggaaggaaacagaggggagcctatgggtgaaagactaagcttggggctgcccctggaaactgctgacctgtgggtccggacccttctctggggtggggccgtcctgggcactgcagggtgctgagcagcatccctggcccccacccactccatgccaggagctcccctcagccctgacaactgtagatgtccccagacatcacccagtgtcccctgggggcagagccgctgcggtgagatgccctggcctaggagtgatagaatcaaggtacttggaaagtctgcctggaaagcaggcaggattcctgggctggtggaaggcacagggccaggacagcgcccacaatgaccccaccttctcctgggcctctcatgggtgtctgagacactcaacaatccccaggcccaggtccagatttgtccccaaccttttcctttgtccccttccttacggagttcccagccccagtgtcacccacagctcgggccagaaatcccagagccaccctgccttctctcaccctcaagtcctgtccatcacaaatcctgtgggccccgccttcaggagatgcagggcccacccactgctcacccctccaaggcccctggaccagccctgtggcctctgccttggtctcccggtgccactcatagtctgtcctccaagcagccaccagagggtatctgtgagcacctgggtcaggtcccatccctcctcagccctccacggctgccacctttctcatggccaaatcccaagtcctccccgcagcccacaaggccccgcatgacctgccctgccccgccctccccccttccctctctccctctcctcactctgctccaaccccacgggtctcctggctgttcctcccaggtgcagtccagccccagggcctttgcctgggctgcgccctctgcctgaaaccctcctcctccaggtacttgcctactcttgcctcctcccagatgctgcccaaacaccaccttgtggcctcatgggccaccatcttcaaagccatacaaaacccccaacccaccgcagccacttcgttccttctccctggcacctgtactgtgcagcgagctcctggtctgtctcccctgaggcagaggcatcctgctgcacccctcgccccttccccagtgctgagcgctgccaggcacacagcgtctgggagcaggcgaatgaagaggcagcccagagctgtccacctcacacgcccagggccaacgccggccccgccggtcttacccaccctcctgaagttgctgactggggcgcccatgtcaccaggtgcccccacggtgacacctgccctgggctcccaccctgacccccaccactagagtgcctcagtttccccaactggaaccaggagtcggacagtcccaagctcaagggcttaccactgtaggagtcgggaggccgagacaggtcagggagggtgcctggctggctggggagggccgcgtggttgtgcatgaggctggtgctgcctgcgaggccgtcctcggggtggctgcctccaacctgcaggcgtggggagacgggtgcatcagggggagccgggtccccgcccactgcccagctccaccctcgcccagcgctcaccaggcctgcgtgccgcccgcccagtgacatggggccggtgaaacctgaggccagcgccccgtggccaggcagcagcgtgtgcatgtcgccggctgtgcccacggcgtggctgcggagcacgtggatggcctcgtccaggtggtcttctatcttactctgctgcagggtggggggatgggtggtgaggggcccaagccgagggaccccacaggcctccattcatgtcccttccgcatgcaagtggccggtggtcccatcttccccttccccaggaagctgcatatgccaggcatctggcgcccgggagcacacacaaaatgtgtgtgccttggcggccacgaggcctcaataacagcttggggcttatttacaagaaactaacaaaaaggtttctccttctcaaggagcgtctgtcctgcaaattctgtcggggaagggtggggtggggcggggcaggcactcaccaggccgtggagacccccgtcgtagctgggcgataaggcaccgggggctcctgctcgaggccactgtgacgttcctggaagggagtggggacgtgaatggggtgcgaggggcggggtgtgagcatggcctgatgcccatggggagggattcatgaaccaccccgcctgtccagcctccggtgatgcccaagatggccattccggggcaccccacactgatgcaaagctgctcggccccgccaggcagggatgctgggtgcccagtgggtactgccattcctatctctgagcctcagtttccccatctacaaaatccaactccccactcagaggataaagtggctcggcagcacacagtagggggctcctccccatgctgccccaccctggctgacccacgctgggctccagcagcaggcaagaaagtggcaagctccaggtgggaccagacaggccgaggtgaagtgagggttcctggcgcttcccatgggggcagagatgaggactcacgggtgtttttaaacacccagaccttctggaaacctccagttctcactccccctcctcctgtacctgcccccgaccccctgcggataagcaagcacgtcctcacagggataggagggtctgccctcccatgccggagcaccgcacagggtaaacagtcagtacctaataaatacccagtgggtgagcaaatggcaacacgcacacattctagagtccaggccacagccctggcgatgctggccccatcggacctgggagctgctaggcacgccaatgtcccctcatgttcacgcagtgtgaactgccaggtcctgcctcctggctttgcctgtgctgtgacctaacctggacgccacctcccagccctccctcactgcctggttatgtgctatagccttggagggctggcttggaggctgcctccactaggcagctttcctggattgcccagtggaacacaagcccatgggggactcccttccaccgtcggttcctgaccagcgatgccacgggcccttgggggccatctgctccctccccgctgcctgcctatcccagcaaggtgcagacaccagaaccagcctcccctcccccgcaaagccttcacagacctcagcctcccctccccccaaaccctcacagacctcagcctcccctccccccaaaaccctcacagacctgccaggccctggggggagcccacgggggtagaagggctggacgagaagttattgcttgagtgatccggggagtagatctgcgaggaggaccaggagagatgggcggtcaggggccggcctctcaggtcacttgcctggccaccccccatgccccacgcctcaccgaggccagtgctttgccgagggcatccccggagctgccagctgtggtccctcgggagcctgtgggtgaagagaggtgaggcccacgcagcccggcctgggtgctgccgccgacggcaagctctcctgcgttctgccgtcctgcacagacactgctgcgccagggagagcagcctgactcgggtccggtttctgtctgaccccctgaaaccagcctctgcaggggttgaggcactggggacaggccactggcaggggaccctgggtgggtgagtccccttctgggcctgggtgggtgagtccccctctgggcctggatgggtgagtccctctctgggcctgggtaactgagtccctctctgggcctgggtgggtgagtccctctctgggcctgggtgggtgagtccctctctgaccctgggtgggtgagtccctctctgaccctgggtgggtgagtccctctctgagcctctttcccagctgtaaggcgggaaagccgctcctcaaagatctgtttccagacatcccaagcccaacgcacgtggcaggccctgcagacagcggacaatgagaactgacaacaacccgctctcagggccagcagacgcgcctgcgcctcccgtggagtcctcgccaccccccacccagaccctgcctggagcccagtgtcccctcggagaggccgcatcccagggaggggccatacccaggaggctgtcggccccgctgacaggcggcgtgtggctggagacgccgccgtacgtggctccgggggctgaggagaaggaggatgcagatgggagcccaccgttcacctctgctccatgcagctggtagccctggggggtcaggcaggaggagggtgggttagatgggcactgccaccctccgcccaccccctgccccctgccctgggtcctaccatacgctcgtgctggtgcaggccaccaaacgtgctgctgcttccactgctgcccaccgggccgctaccgggcgggaggggcagcggggatgagcccccacccagcatgggcccgaagcccgcctggcccgggggactccagagctcggctgaggggtgcaggctgccatctgtggaggggagctggtaaggtgggggccgagtggggaaccccagccctgccctaccgtccctggcgagcccccgccctgccatgtacctgccacgtagaagggggcgggataggtgctgctgggggtcttggcggacgggtaggcggtggcatccctgccgtagtcctcacctgagctgggtgggtacacctgcgggcgggtgggcggtggggggtgcagtcaggacggagggaccacgatcagcccatgcaccttgccggcctcctgtcccctcctggtagcacatctaccaccccgtttcccttccctgtaaagccacccccctttaggtaaatcccagcccctggccaagtttgaggttcttatgatgtcctggtctctctctcctactccttttccagcccccacctcccgcctccctgaacttctgacctttgtacttgaggacttggatctggctctgcctactaaacctttttcctccttaatccagaaaactcctatcgacccatcaaaaccccagctccaacaccccatcccatccttctcccttgttccccagctggaatcaatcttccagtgctgagcttcccttggtcccagagcaacattcgtccttcactaaagtaacaggaagaggggtctgtgagtagcgccagctctgactggttggcactgcctggactgtggggctggggcctgttggtaacgtctgctgctgtgctggagcgggaagtatgctgggtgggcctgatgttgtaataaactggggggcggtttcagggcagagaaagtgcaccctggggaaggaggggagtgagtgatactgttgggagcagagcctgaccacgcctttggcctgggaagtcaacctgactctaaccccgaacccaggcctgtggggagctggtcggctggaggggtgaggagatgtatgcccagggctcttggggccagcacaggcactgggcagagggtggttggtggctactgagccagggaatcggcaaattccctctccctccagcgagatgagaccgcaggagtgtggcacagcagcctggaccatctgcgaggcctggtagggaggcagggatgcggggcagcctgaagctgtgaggatgtaacagggagccccaattgcggcaccccccgctttttttttttttttttttgagacagagtctcactctgttgctcaggctggagggcagcggcatgatcttggctcactgcaacctccgcctcctgggttcaaacgattcttctgcctcagcctcccaagtagctgggattacaggcacgcaccaccacgcccggctgatttttgtatttttagtagagatggggtttcaccatgttgactaggctgatctagaactcctgacctcaggtgatccacccacctcggcctcccaaagcgctgggatgacaggcatgagccaccacacccagcacaattgtgccctttctaaaggggcctcagccaccaggactgcctttctctcaaaacaagacagacagaggctggacctagggaaggacttccccgccttcccttggaggcggcctcgggtcagagctcagatcttggctcagaaatcacagggggcctgtccactcagggcccaccccgccatgtgtgttcccaagcttcgccaggacacagggcctggcactgccactgacgagctgtggggtcccttctccctcgtgcgactcaccgaggatggaagacccggcgggaccttccggaccttcttgggctgcgtgtctgttagaagcaaaaggggtgagaaccggccaccggccatgagaacaacccctgccctacaccctggaggagagaccctcacaattcccgtttcatatattaaaaacctcgggtcggctgggtgcggtgcctcatgcctgtaataccaggactttgggaggccaaggcaggcagatcacgaggtcaagagatcaagaccatcctggccaacacagtgaaaccccgtctctactgaaaatacaaaaagtagccgggcgtggtggcgggtgcctataattccagctactcgggaggccgaggcaggagaatcacttgaacccgggaggcagaggctgcagtgagccgagatcgtgtcactgcactccagcctggggacagagaaagactccgtctcaaaacacaacagcagcagcagcaacaacaacaaaaagccccgggtctatttatacggctccaaagatgtcgaagaaccacgatggttttctcccgcgacgcgcagtttggaaaacgaggagttggtggattctaagccaaggctctgctgagaagccccttggccccaccctccttccaagatggccccgactatcccacgcagtcaggcttcaccactaggggctgctgtttgcaaactcgcctacaggataaaatccgtaacccggaaaccagcactcaggcgccttcctgatcactcacggacgtgcgcacagtgggaaaagttcgagtggcccaggcgcatgtgcccagccaaggcggaacagaggcctcctcccgcatcatggggctcctgtccttggtctattcagagccacgatcttttacgtttttgtgctttttgtgggtgatttcacgcttatttttttcaggcagggtcttgcgctgttgctcaggctggagtacaatggtgcgatcgcagctcattgcagcctcgaactcccagggtcaaaccatcctcctgcctcagcctcctgagtagctgggaccacaggtgtgtgccaccatacttagctaatttttaaaatttttcgcaaagatgggatctccctatgttgcccagaatggtttgcaacttttggcctcaagtgatcctcctgtctcggcctccagagaagctgggaccccaggtgagtgccgccatgcctggcgactgtgctgcctggaatgggccccgggtagttcaaggcgccgtccagtgctcctgagcccgaggctgtgacgtgcctcgcgggggatgcccgcgtgtgcagcagggctcagtgcagaggagccacgatgcagccccatgaggcatctgacacagaaagcacatggcagagcccgtgcccgtcagctgcaggaacctcgggaccagaggctcgtaggaacctctccctggacgtgccacgcccgccggcccctgcctcgaccccccgtcaccgtccatccctcccacggcccgagcgcccgacgtccagccaggacctggaaggtgcggggtctgctccctctggtgccctcagctaacgggaagcctcctacctccctttgcaggctccctcccagaagcccccgatgccccggccagaccccgctcacctaggctgccgtctgccgctctccgccgggagctgccggagtaggaggggtagtactgggaggtccccttcatgcccgaaggggacaggggcccggggctgttgagggccagctcgcctgacaggaagccagcctggtggggagcggatggtcagaaagcgcccagctggcatccagaccccaggctgttccattcaagaaaaaactgcaaaggccgaagccactcagacccgccctgcagtgggtgatgccccttctgcctgtcacggtgtttctctgtgacacctgctgtgtttttctgacttgagactgaccgcatcccacactgctgttttcacgaagaacgaaagactgagaaacagataccagtgtggccaacccaaggggctgctcccccgattctgagacgcaaagtacaaagctgcgtggctaagcgtctgtgcacccggctgcttcctatctttttggttttgttttgtaaagccctcggttggattctgtacatgttagtgtgaaacgggctttcttcctggggagccagggctgccctgagccgggtcccggaactgactcctgcatttcatccgttctaaggccgggcacggtggctcacacctattatcccagtactttgggaggctgaggcgggcggatcacctgaggtcgggagttcaagaccagcctgaccaacatggagaaactccgtctctacaaagaatacaaaattagccgggtatggtggcacatgcctgtaatcccagctactcaaaaggctgaggcaggagaatcgcttgaacccaggagacagaggttgcggtgagccaagattgcgccattgaactccagcctgggccatgagcgaaactccgtctcaaaaaaaaaaaaaagaatcatctgttctatcatcatccagtggccccacggggtggcccagcgcccaggacagggccttctcccgaggcccggcctgtcctgagcccgcaccctgtgtggccaccgcggggctcgatgagtcacccgggagcgccagagagcagggcccgagccctagttctgcttctcggatggggagcccgggcacttgcgtattcctgtctgtaaaatgggcacgtaggccgcggcccctcgttgcggggactgatagggaaacgcgcatctgcccctggcgcagagcctggcacccggctggccccctccatcactatggctactgttgctctggcttgggcacagtgagcacacagacggccccacctgtgacaaggccgagccccaccgagagctaggagctgacggcggggacagagatgaagtcctggggtgagggaggaaccctgggggtgcccagcaccggaggctgcatgggacccctgtggctggtcacagcccccaacatcctcccccagcctcacaaccagggccagcgtgggtgaggatctcggctgcacaggggcctgttgtatgggctccccagggggtccacacctgcaaagccctgctgcatggcctgttttcctgcctgccactcagaggagagggcaaccgagcccctccagctaagcatggcagccctgcaggccttggcctccctggtcctcacctacctcccctctgctcccggtccacacccacccagcccaccctggcccaagcccagcctggtttcgctatcaggaagcaaacataacctagctaagccaggagagcttctgcagatcagagagggtgggtgacagatttgtttaaaatcaaaatacaccccagcccggcccgagcccctcacctgagtcaggccgcccacgcctgcgtctctcccgaaggaggcataggcgccccgctcaccgctcttgcctgcaaggggagaaggaaggttagtgggaggcgaccccaaggaacatcctgagggcccccgagtgcctgccatgtgcctacaataggctctcagtaagtgcacacgactgagagcgccacggcaggatgctggcagagcctgaccccagtgtgcccatctcggggagccctggccccagtatgcccatctcccgcagagccctgccctcagtgtgcccatctcctgcccaatgacaggcttggggacaagaaggggtccccgatgatttcggggccaactctgagcatctgcagcccacagaagccctgcccagggggtggggcggaaaggggacagcagagctcacggggtgaggtgggaaggggacagcagagctcacagggggtgaggcgggaaggggacagcagagctcacagggggtgaggcgggaaggggacagcagagctcacagggggtgaggcgggaaggggacagcagagctcacagggggtgaggcgggaaggggacagcagagctcacaggggatgaggcgggaaggggacagcagagctcacggggtgaggcgggaaggggacagcagagctcacagggggtgaggcgggaaggggacagcagagctcacagggggtgaggcgggaaggggacagcagagctcacgggggtgaggcgggaaggggacagcagagctcacaggggatgaggcgggaaggggacagcagaactcacggggtgaggcgggaaggggacagcagagctcacggggtgaggcgggaaggggacagcagagctcacagggggtgaggcgggaaggggacagcagagctcacgggggtgaggcgggaaggggacagcagagctcacggggtgaggcgggaaggggacagcagagctcacaggggatgaggcgggaaggggacagcagagctcacagggggtgaggcgggaaggggacagcagaactcacggggtgaggcgggaaggggacagcagagctcacagggggtgaggcggaaaggggacagcagagctcacaggggatgaggcgggaaggggacagcagagctcacagggggtgaggcgggaaggggacagcagagctcacgggggtgaggcgggaaggggacagcagagctcacgggggtggggcaggaaggggacagcagagctcacagggggtgaggcgggaaggggacagcagaactcacggggtgaggcgggaaggggacagcagagctcacagggggtgaggcggaaaggggacagcagagctcacaggggatgaggcgggaaggggacagcagagctcacagggggtgaggcgggaaggggacagcagagctcacaggggatgaggcgggaaggggacagcagaactcacggggtgaggcgggaaggggacagcagagctcacggggtgaggcgggaaggggacagcagagctcacggggtgaggcgggaaggggacagcagaactcacggggtgaggcgggaaggggacagcagagctcacggggtgaggcgggaaggggacagcagagctcacagggggtgaggcgggaaggggacagcagagctcacgggggtgaggcgggaaggggacagcagagctcacggggtgaggcgggaaggggacagcagagctcacggggtgaggcgggaaggggacagcagagctcacggggtgaggcgggaaggggacagcagagctcacagtggccctgcttcctgctggccaggcccctgcccttcctgagcctcagtttcctctgtttcaggcgttgaggggctgatgccctggggtgctggggtcagaggcatttgtctgtcccaggggacaggcctgggggccctggcggggagccccggggcctgtgcacaccgcatcaggttcaccgcacaggctcccccaaagtgcccagcattcagccttcaggccagggttcattcgcgaatgagcacgtgacctgcaccccaccaatgagcacttccctggggcgctcagtgacaaaggacaggtgaggcctcggggctacggagggggtcagctggccagggcgagcccccagcatggaaggcctgggctacggaggggaacagctggccaaggcgagcccccagcatggagggcctgggctacggaggaggacagcctgccggggcgagcccccagtgtggagggcctggggctgatgcggtgacacctggatccagccttgcctgaagcaggcaccccgattactcaggacctgagccacttaaatccccttctggctgacactgggcacggaatgtgactggggctgctgtgaggggctgggacgcgcgatcgagtaatgtacattattctcaaagcaggaaaaaaatttcccgatttttgaattttaaaagttcaacgatttcccaactcctggaacaaatgctgctgttttttgcctcccgtttcctcatcttggtgacccggggggacatggggaagatgacagccacgacccaccccacaggccacacccggccacagcagtcactcgcccggctcctcgggtgagaaaactgaggccataggagactgaggttatggcaaaagccccccgtgcctccccgggacccccgcctgccctctccaagctgcctggctatggcctgggccccacccgtgggggtggcaggtgggacatggctgggctctgggcattgctggccgggccgtgggaactgcccacgtcagccctgcccaccctggggccatcgggggtatgaggaagaggctgggaggaaggaacagccagtgaggaaccaggctcccaggtgcaggggccacccccggcaggggggcggggccaggcctcacctaccccgtaaggggaacgggcagaaatcgcccgtggcacgtggtgggccctcagacacacccgccagaccttcacgctattcgcttcctactcaggacaccaactgactctactgtactccaagttcgaggccgggcaaagcgagacaggaccgtccctgccccgctgtggggcccaaacaggcgctgcccctcagggtccagggaaaaggctgggtcggccaaagtcctccgggcctcagtttccccgcaagccaacaatgccgaggggtacacggtgagcacctgggccccgcagcaggtccagtgccccacagctcccggcttctaagcagcgcacacccccactgcaccacgaaaagccagcagaaacactgcctcaaaccgtcgggttccagagaagggaaggatcccgcatcccaggatgactgagggatgaaaccacaaattccacagctgaggcactggggcaggaggctgaccacgacagcgggacccctgaggcccttaccagccccccaagcagcgggacccccccaagacccctacctgagcccccgaaccctggggcacaggacttgacactcccgcaggaggcggagcatgtgaagctcggggcatttcctgtgtcacccgcaggagggaccgcacacgggacactgtcccagtcgcagccccaggtgcctggaggagggcgtcccagtcagccccacccagccgcagacccccggccagggtgcccttcccaagcgtcggttcgttcccctgcagcacgggtgagcctgcagcggggctggaatatacccaagaccaggcaccaacccccacctggcattgggcagggcctgcagagctgggtcagtcctcaccgcctccctccaagaaggttctgggagggtccctttcccacagtggggaaactgaggctcagaagaggatggcgcttgcccaggttccgtggtggggtgggaccagacaccaggcctgagtcttcattctttttttttttttaagatggaatctcgctccatcacccaggctggagggcaatggcgtgatctcggctcactgcagcctccacctcctgggttcaagcaattctcctgcctcagcctcctgagtagttggcactataagcatccaacaccatgaccggctaatttttgtgtttttggtagaagcggggtttcaccatgttggccaggctggtctcaaactcctgacctcaggtgatccacccacctcgctctcccaaagtgctggtattacaggcgtgagccaccgagcccaacctgagtcacgattctctcggttaacaggagggccccccagggaaagagggcgggcgggcggtctgcggaagggcatgggctctgaccaccgcacactctggccgccctcccgagtctccagaactcctacgcctccttcccagcgggcacaggccagcccggctgacccctccccgggaagcaggaggagccctgcagaaatcccagggaggaagtggggtctggaacggcctccctgcctctacgctcaggcggggaagcctagttgcagagtgccgtgccagggagtccgggccacgtcccctgcacctccccgcagctgctcccaggacgggcagaggcttcggctgtccacaccctctgggtgaacgctggggacttgcctggcgctgtgcgtgcactgaccatgccaaggcccacgtctgcacatctgtgcacagcagagggaccgcaccaggccaggcactcacctccgagtcccggtcccaggaatgtggatgaagagaggctgctgtgcgactcagtgaagtgggtgccctcgctgaaggtctaggggagatggggtggggatgagaggtgctggggcttcacaggccccccctccaccccgcattacagctggagaggcaggactcaaacccatgtcccccagtccaaacccctggaaggctggccccttctctcagcctcagtttccccacacccctcgcccccaactctggggacaggaaactcagggtctcaggcctcacggggactcctacccggctggggtcaaaggaggagctgctctggtcgccgctgccccaggagcctgagctgggccggtcctcaagacctgcaggcaggacagagagagttatgggtcaccctcacgcctgcccagctctaaaagcttcggttcatcatctcaggggcaaacctcagtggacccggggggcttgtggaacccttcctaacccagcctcacccagcccgactcatgaggacaccagtcagcagctaacacccagacaccctgggactcggagcacttacaggtccataaacttaaattaactcttccgtcggctctctgctggccaactcctacccacccactaaagccccagctttcataccctccttgggcaaagacctcactctcacgccgagcctcctccccatcagccccaagtccctccctctggcccagccctgactatgtggactggggtctctgtgtcagatgcagactcttctgaccctgtgagaaaggctcatgacagcatgagggtgtggaagctaacccatgagctctggggaggcccagggtctccctgtccccacctgccagtgtgggaagtggggccgccctttgctgaagcagcagcagaggctcacccatcgggcaggaggctggcagcccgtgagggtggagccgaatctcatcacccaggaacaagcccagtgtggagaccagaagcctgcgtggggcaggagttcccggcgcagcaagggacgggacgaggaccttggtcccggggcggggcgggcggggcccttatctctcagaacactcacaggcaacgcccaggactccagaatcttctgccctgggcagggagggcctgcttggatccttcccccttccatcgggggccacagagcacacccgtggagaagcaggagcgggccctgggcctcctcagcttggccacggagttgctgccctgccttggtttccctctctataaatgatttacaaacaggccctacttttgcagggctgggggtgtccatgtccaactcccaagtccagaggcttcccgagagccaggcctgggggacccagcccagtgctgatgtctgtgaccggcaccacctcaggctgttctgcaggctcccccgccccgccccctgccctccctgctcatccacaccagaaacttctttcaaatcgcatccttctatttcggtgcctttgtgttaatcattccccccggggagtattggtgtttaattgctgtctgatttgcataattatgcatattaatctccaagtctaatgaatattcatgcgcctcatttagattttgttttctaatcaaaaatttccaatgtgattatgagtggggggctgggatgctgccttggctgggttgggggccaggcagggggctcctgtggtctccaggaatccacacggcattcgctgccaggtctgggccatctgcaccccaagatcctggtcctgcacgtgggccctggtgaacagggcagctgctgaggccagggtgggctggctgtgtaggggtgggcacagcgccggcaccctctgggtctcagtttgcctctataccacctgcatgttgtctggtcccctccggccatagccagtaccccaggaggtgcagagacccccaactgagcaaacgggaggctcctggcaccccagccctcatcccctggaaggcctggtgtggtgggggacctcctggggccccatgcccagggatcgcccccgaagttcactccaacaggcctgtgccagaggcactgcggcctcaatctgccctttgggggaaccctccctcacccagccttggcctcctcctagaaatgacaaaaataaggacagcccccacattaatacagttattaaaatcccccccaccgattaatgatgcattttaataacccaccatgaatattcataatgcatccattgctcctgttctaattaaaatgtactaatagaataagacactgctgtcagagtgtggttttctgtgatttctttggtgaagcaccgcagagttttacccgggaagggcaccttcctgccctgggccagcctggctgcctcgggagaggcctgcgagtggacggcgcaggggcgctggggagagggccccaggagcggcccaccccttgggcttcagttccaattccagtcacggggtgtggaagccgcccacctgcctgggctgccgtgaggataacaatgaaagatgctgcttcagagaggccatccgtagccaaggaatgctccaggctggtggtttcccagtcccggtccctgttgggtcccctcctgagagggaccggggactggtctttgcctggtggctcgttggcaaatgggagagggaggcttcaaaaggcgcttagtaaataccgggtaggactgagattggtctgcagcagggatctgcaaacagtacacaaggaccaagtctggcccctaagctgctttttaaataaagttttattggcacacactatgcccgtttgtccatgtactatcaacggctgcttttgctgcaacagtagagttgaatcaattccaatagagaccatctgtcctgcacagccaacaatattcactccttggtcctttccggagaaggctggctgaccttgatacagaaaaagactgtccaagtgccttcagctgcctctgcacaagaaacccaatcgacagacttcagtaccaggagtggggttaccatgccgggcaggcaaaactattggtggacacgggccctgaacacagccctgtgtaccgcccctgccaaaccctcaggcacaccaccaggtggtctggcttcagatgggcctggggacttcatcctatagccccagctctgcaatgtgcccccactcaggtgctcaggctaaagtcctgggagtcctcctcaccttccctcctcccaaagaacagcagcttgccccatagctacagcagcgggttaagcccagtccctgcagcagcttccttccaagtctgctgacatcctcaggcagccggatggagcctttagaagcaaaacttggctcttctccctccctctaccctctctcatggctccccaccgtcctcaggataaagaccaaactctttcctgatctcaccactctcctcttccccaacacaggaggtgacccccacccacaccccctgcctgagccccttcccagcctgggacccctctttgtctgcagcactgcctggaacacagctgacgcccccaaaacacccaccctcaacgtcttcattttactcataaataactgtgcttccaagaacattttcctggaggatcaaaatattctccacctctgctgtccaatacggggaccacactaccaactgctggaaacgtggccagcattttttcaagcacattaaaaattacatttaaaaatgtgtatatggctaatgcctgctgtactgaacaacccagtccccaaaagcaaatgaaataacagccaccaccaaataccacggtcacgtctaaaaaccaattaacacctcgacagctcctcacgcaggttccgtttactcgggagtaggagcgggccacccgatacagggtcactatgaccccccaagcccgtgcctcgccccgtctcttcttcctccttataattaaaatcgtgaaggaccccgatggcagcctgtcccaccgccctgcctgggtctggcccctgcagcttgtgatgcttctcagacccattcccagcccctctgggggtcatgacgggtgagatcagacagaggtttgaatccgggggtggcctttccttgggtggagcagtattttaaaaaattttttttttcttttgctttgagacagggtcttgttgcccaggctggagtgcagtggtgcgatcttggctcactgcaacctccgcctcctgggttcaagtgattttcccgcctcagcctcccacgtagctgggactacaggagcctgccaccacgcacagctaatttttgtatttttagtagagacggggtttcatacatgttggccaggctggtcttgaatcccagacctcaagtgatccgtctgcctcagactcccaaagtgctgggattacaggcatgagccacaacgcctggtgaatttaaaaaaatttttttgtagagatggggtctcactacattgcccaggctggtctcaaactcctggactcaggcgctcctcccaccttgtatttcccaaagccctggggtcacaggcgtgcacagcctccattttatctaaattcaagctatgggagaagatgaaagaccaggatgccctcggcccagctcgcgcactgcagccgccctgggtttatcttcctgtcgtgtcttcttggtcagggcccgcaggctgtgtagcacatgctcccagcttctgaggaggatcccgagtgggggagaaaatgcttctggggcaccacagagcccttccttgttggggggctgacgagatcccgcaaagcctcccacttcgatctgcctctaatgtctggcgatggggggtgggacagcagggccctgtggcccgcccgcgagcagacaaacctgaggctgaagagaatgtgagtggagaccacacaccaccctaagagtgggggtccccacagcacctaaagtggcaggacgtgccctcgggtagaggcacagtgaggctgtgcgggcaacacaggcaacctcctccgccagaaccggggacgcctcgcaacctcctccaccagcacgggggacaacctcctccgccagaaccggggacaactggcaacctcctccaccagaagcggggacaacctcctccaccagaaccagggacaagctcctcccccagaaccaggggcgcctcgcaacctcctccaccagaaccgaggacgcctggcaacctcctccaccagaaccgaggacgcctggcaacctcctccaccagaaccggggatgcctggcaacctcctctaccagaaccgaggacaacctcctccaccagaaccagggacaaccttctcccccagaagcaggggcgccttgcaaccccgctcccccaaggccctggggtttccctggagggcagagctggccccgagagtgggcatcgagcacagatgttaagtaacaactcagagaaacagggccccgctttgaatttcagtgaccacagagataaccgagaccccatcccgctcttgcttccatgtctatgggcatcaccagtgacacctgagtgtggggaccggagaacctgcccctcaaaacaagctcagaaaccaacccggggccgggcacggtggctcacgcctgtaatcccagcactttgggaggccaaggcgggcggatcacgaggtccagaaatcaagaccatgctggccaacagggtgaaacccccgtctctactaaaaatacaaaaattagctgggcgtggtggtgggcacctgtagtaccagctactcgggaggctgaggcaggagaatggcgcgaacccgggaggcagagcttgcagtgagccgagatcgtgccactgcactccagcctgggcaatagagcgagactccacctcaaaaaaaaaagaaaaagaaaaagagacacaagagggaacccaacatggaacaaaaaggatgaagttcaagaagttcaatgatttaccctaaaaaacgagaagactgtcttaagcctgtaagccccatggatcctcaaagaaatggcagagcctgggggttctatggaatgaagtagacagtgagcacatttaattacgaatcaagagattcctagaagccgtaacaagacaggcacacaaggaaagccctctgggggcactttgtgagttctctctcatttcactgaatccttgcagtggctacattacccctaccctacagataaggaaactgacgcaaaagatagatgccatttgctcaagccctcacagtaagtagcaaagtcactatttaatgatacaaatgtttcctagtaagatgcaaatacacaattatgaacagatacaatgtttttttgttttttttgtttgtttgtttgagactgagtctggctctgtcgcccaggctggactacaggcgcccaccaccgcgcccggctaatttttttgtatttttaacagatacggcatttcaccgtgttaaccaggatggtctcgatctcctgacctcatgatccgctggcctcggacaatgttttttaaaagtagcaatttattggtagcaaataccagcagggaagagaaatatacaggctcaattttcaccttctcacagaagggggcagatgcgatttcacttcggacgttgagagcgcgagaaacggcgtgtttaaacgtgttcttcacaacgcagaatactaaccgctattcaatcacggccttaaacgtgttattcaaaactagaaaagaaccactggcagagccgcaaagcggtacagagcttcagaaaacacacaccgggggaagcaatccggagttgggagcacacagatggaaaaacaaaataagacgatggaaggaaaagctgagaacgaagatggacgggtgcttaacgtctttaatctgaaaacacggtgccgaccaaagacagttttgaaacaagcgactcaggagatacaaccaggagcacaaagatctgccaagccacaccaacaaaaaggaagggttgcaaccttcatatcgaagtttcaattcaagggaggtttctttttctgagacagagtctcgctgtgtcgcccagggtggagtgcggtggcgcgatctcagctcactgcaacctctgcctcccaggttcaagtgattctcctgcctcagcctcccgagcagctgggattgcaggcacctgctaccatgcctggctaattttttatattttagtagagatggagtttcgccctgtgggccaggctggtcttgaactcctgacctcagaagatccacctgccttggcctcccaaagtgctgggattacaggcatgagccaccaccaccagccaaggaacggatttttttgttgttgacaatggctcgacccacaacgaaatcccactgtctcagcccacacaagcccacaatcctggcatctaaatacgtcaacagagaaaccgacaaacagaacagagggggatggcgctgctctcagcctgacattaaacagattaaaaatctaaatatggttcaaaggcctcgcagctccacatccaactatccctcaagtactcacaaagaaggacaaaaataatccatgtttcagcctcggcagaggagctctgcgtcctccaaacagtagctaccgtttaagccaaagctgagttttggcactggagatctagaaatcaagaaaggacctccaacttggaactcagaaacctctgaagcaacctgacctgaagaggaaattaggaaaaaaaaaaaaaaaaaaaaaaaggaacaaatgtcagtaatatgagaaaaacatgcattatggaaaccaatgggatggggttcacggggtggaaccctcaacaccacactgatggaacagaagagggcagaagtcagcaaaaggggcctgtgatctgaaagtcaccaaaaactttagaaagagaagaaatgccgataaagaggaaaattgatcaattgatcaatatcgatttgccaatgaagcagattctccagaagaaaaatcaacgagagagagaaaatgcacagggcagccgagtcaagaacaaagaaaccacctaaaagttggcgcattgaggaccgcggcgccctcagcctccctgcgcaggtggaaagacaggcgcctccaaacgttatcaaagagccgaacggggccaggcgcagagggtcaggcctggaatcccagcacttttggcacgggtggacagacaggcgcctacaaacattatcaaacagccaaatgaggccgggctcggtggctcatgcctgtaatcccagcactttgggaggccgaggcgggaggatcaccaggtcaggagaccgagactgtcctggctaacacggtgaaaccctgcctctactaaaaatacaaaaaattagcgcaatggttactaaactctctaagtttcagcttctttaccagtaaaatacggtaataattacacctatttcgctaacctgttagaactgagaattcccagtgaataagccaagctttgtgtccaatgcacagtgctcaagaaacactgatgtaagcagtggctcacacctgtaatcccagcacttcgggaggccgaggcgggcggatcacaaggtcaggagatggagaccatcctggctaacaaggtgaaaccccgtctctactaaaaatacaaaaacttagccggcacctgtagtcccagctactagggaggctaggcaggagaatggcgtgaacctgggaggcggagcttgcagtgagctgagatcacgccactgcaccccagcctgggtgacagagcatgactccgtctcaaaaaaaaaaaaaaagtgatgtaaattgttgtattactgatgttgttaaaaagttaatgaggcggccaggcgcggtggttcacgcctgtaatcccagcactttgggaggccgaggtgggtggatcactggaggtcaggagtttgagaccagcctggccaacgtggcgaaaccatgtctctactaaaactacaaaaaattagccaggcatggtggcaggcacctatattcccagctactcaggaggctgaagcaggagaatcgtttgaactcaggaggcggaggcggaggcggaggttgcagtgagctgagatcgtgccactgcactccagcctgggcaacaagagcaaaactcggtctcaaaaaaaaaaaaaaagttaatgaggcagcaataaaaagaaaaaaaaaagatacagccaacagcttggctggatctccagggaattatgctaacgtaacagaataaaagctaatctcagaaggttgcaaactataggattccatttacacaaaatactcaaagtgaaaaattgggctgggcacagtggctcacacatgtaatcacagcactctgggaggctgaggtaagaggatcacttgagctcatgaatacaagatcagcctggagaacacagcaagaccccatctagacaatatttttttattcttcagacacggtctccctctgtccccgaggccagagtgcagtggcgcaatctcagctaactgcaacctccgcctcccaggttcaagtgcttttcgtgtctcagcctcccgagtagctgggatgacaggcacgcaccaccacgcccagctaatttttgtatttttagcagagacggggtttcgccacgttgactaggctggtcttgaactcctggcctcatgtgatccacacaccctggcttcccaaaatgctgggattataggtgtgagccaccgcacccagctgaaatttttctttttttttaaacagagacagggtttctccatgttgcccaggctggtcttgaactcctgggctccggcaattctcccatctcaacctcccaaagtgctggggattaccagtgtgagccgctgacccagccctctacaaaatacatatttttttaattaggtggtcgcagctgctcacaaggctgaggtgggaggatcagttgagcccagaacttcaaggctacagtcagttatgatcacaccactgcactccagtctggacaacagagtgagacctggtccctaaaaaaaaaaaatcgtacagatgaagaacagattggtgattcctgggcttaaagaaggtgcatgtctcaaaactgcacagaactacacacacacacacacacacacacacacacacacacgcacgcgtacacacacgcacgcagacacagacgcagacacgcacacacgcgcagacgcacagacacgcacgcgcagacgcacacacacgtgcgcacacacgcacgcacacgcacagacgcgcacacgcacagacacacacccgcacgcacacacagacacacacacgtgcgtgtaaagccggtggaatctgatcaggatctgtggacggcaccaatgtcggcttcctaggtctgacgcagcaccacgggtgggcgggacggtacccctgggggtggctaggtgagaggagaacactctgccacttcctgtgaatcccgaaagacttcagaataaaaagtggatcaacttcaaggacgagggcccaagagagtaacagaaaattcaccagagagccattcacagggtcaatccccttccgagaagaccaccgccctctattaaacaagtggcaggtgaaaggacacgatctttgtcacctattaaatgagacaggccgtgctgtcaccacgttggccaggctggtctcgaacacctagtcccaggtactcctcttgccttggcctcccaagtgctgggattacaggcctgagccaccgcgcccggtcacaagggacgctttcaatgtgaaaaagcatccagggacccagcaattccactcccagacacgcacccggaggaaatgacccatgcgccaggttctcccggggtttcctcttaaagcagaacgcggaggtgccgttctgtggattttcactctgaccgtgtgtcacacttacaatcgcacggacagagaaagcgacggggaaatgaaaaataggaaagaactttcctttggtccgtcaataagcaatttcctggtgtctcccgtggcctcagagcctgtctgtcttggcagaagataggctgtcactcagagacctgtgcctgagggtttccaaaaatgggaggcggtgggtgggagaaggcgtacgaaaattattcccgttttaaatgtcttccgatccagacaaccagaaaatcttggtttcctattcgttaatctctaatgccttttttgtttcgtttctgttttgagacagggtctggctctgtcacccaggctgcagggcagtggcgcaatctcagctcactgcaacctccgcctcccaggctccagcaatcctcctgcctcagcctcccgagtagctgggaccccaagtgtgcgccaccacgcccagctaatttttgtatttttagtagagatgaggttttgctgtgttacccaggctggtctctaactcctgcgctcaagcgatccttccgccttggtcccccaaagtgctgggattataggcatgaaccactgtgtctggcccttttctgtttgtttgagttggggtctctcagtcacccaggctggagcgcagtggctcaaacatagctcactgcagccttgacctcctggcctcaagcgatcctcctgccttggcctcccaaagtgctgggattaaaggtgtgagccaccttgcccagtacctaactcctctctcgacaccaatttttaaatatttataaatatcgaagaacaggcagacccttcacaggggaaaacttatgtttaattaattttcagggacaccttttattctcacctgggtttctggttctcaaatctaaagtttcctttcaaatgaacttaagaaaagcgaggtgacttaaaagggagctagaacagggcacatgaagaaggggccaaggtggagaatgcggctggggtaccccatcagccatcagcgttggggactcctggcgaagggtggcgtccccgaagccaactaggccccgcctggaaggaagctgcacccactgttccaggaagaagccgaggtttgggaagggatcccacagctccggggctccatcctgctgatgagccccaaactcccctcttcctgggtcctcggagaggagaagcaggaagcggggaaatgagctactgcagctcctgggccctgccgggatccctccgcccctcgcacccatcgactcgctgaacctgacgatggaagagagcaggtgcccatcttgcgggagcttcgggagggccacacctggggccagcgccacagcctgcaggggcctgggggagtggaggcaatgaggagggtgccaccaactcaggccttggagctctgcatcctccaccacccccgggctcaggcgggcgttaactgcatggactgaacggggagggggtcacccctctgtgtccaggagctggggggtcccaggctggagcagccacatcacgtccctcaagggcaaaaaatgcaacatactgggcctcactgggccctccaaagcctccgccctaacgtgtgaggggacaaggcgagaccctcccaacctgcagcattggggcagggccggagcacagggcgagactctgtgggaaccacagaaaatacatctgcaaacattggcaggttcctgctgggaccgggctgggcgtccagggagaggcaacccagagggagcattctcaggtccacacggcctacacaccacagctctggttacccagggaccaatctcacagtggtccgtgccagggctgagggggtgagaggcgacaggggacgagggaagacacctcccaccccaccctccccaccaggccctgctgtaagcccacccagaggcccaggagaatgggggtggacggccttgggagttgcgcttcctcctccaggaagcccccagggcctgaccctctgcctcacacagggaagcattagcatgtccggttcctggggctgtttccggggggctggcagggtggcgtttggggatttccacgcctcagggagcatattccggccagccctgtggccacttcctcacgtagaggggaaggccagtgtgaggcagtgggggcagcaaagcgatgtctctccatgtgggggtgcaagtgcccaagtacagaaccccctttgcccaccactcaaaaccccgacactccagccagggcccacccctgggggattctggagataactgcaggacggcgctttccacccagatcccggaggcaggaaggacacagcttcagaggccccaacccgaggcccccactccccggaaagatgctgatgtccacaaagagacccgtggctctgaagcagcatcgggggcacccgccccaacctcccccaccaaatcctgtcgacagccagcctgggccgcccaaatgcacatcagactagaccctctctccattcacaaccatccagggctccccgctgcccctgcaacgaacacagcgcccctagcccgccccgccggccggtcccaccgcagggcgtccgtacgggctgctctctctgcctggcaaattcctcccctcatgctcccacggccccttcctctcaccctcagggctctgccccgacacgccctctgcggagaccttcactagaggtcccgctttggggcaacctggccctcgctgggtgtgccgtgaagccctgcccatgctccagagtgtgattttcaggccacccccaggaccccacgtctcccctatctgtcccgcccactgctgtgtcatcagcgagggtgacccgctcatccaggtcagcctgggatgtttctgctttgagcactcaaagccgcgggtcccaggaattgcccctcagtcctgggcaaaccacaatggccggtcaccctggtgctgggccctgcatacagcaagcgcctaatacctgcttaaatgaaagtcgtcgaggctcacaaggtgggtgggatccagtgagagccgggatcccgcaccacgccctctccagagcctcagtttcccccttatggattgactggagaaacggatgctcgagatccccacccacacacaggcccagctccaaccctgcgcctaaaaacaagccccacccagcccccagacccaggctccaggcgcgggagggacgaggggacgaggggctcaggggctcgggctcccaaggcaggtcacacgggcaacggcagctgatttcaggggtcttcaggctcgctgcccccgacccggcctgtgtggccctttccccattgtctccctcctttgctgccccagcctccctcgcccgcacactgtcttcaacagacccttgatctcctcactccacgagcgctggcaggaaggcggggtcctacctgaacctccgaactgcgccccggccagggaggcgggccggcccttcccgttggtgacaggcagcgggaacatctgcagggaggggaggggagacgtgagcggggcgggtggcaaaccaaaccctacagtcccgggttcaaacccaagctgggagcagagctggggacacccgggaacctgagactgcgctccatctaggcccggcccgtcctgctccgccccatcacagaccagaagactctgaggactcgcgtgccctcaagtgacgctgcaccctggacacccacgcccagagtgagaaaactccagacgatgaccccgctgtaccgccaggcagagtccctgccgctgaaaactcgctgttccccctgcctttgctctggggggaggggtatcccattaggcgaaggatacaacttatcagctcttgacagtgatacaaagttgtctttacgtttcagctctgaaaagtgagaggtttacactcaacaggtggacatgtggagagtccccggatgcctgagccctggctgactcctcgtttcctgtgtgtgcactggccccgcatggcaggccctggagcagggggtccctggagcggggggtagggcccagtgtccccctaccagggctgggtatgggtttgcttggcaaaaggggaagccgaggctcagacaggcagcaggtcgaggaagacacgggatggagccccgggcccggcaggaagctggaggggctggggagaggctgcaccccacagctgatccagctcctgggtgctaggggtgtgggactgccaccctccctcccgcccggctcacccgtacccagaacactaagtccctaaagattaacgggctcagcggcattaaccggaaaagccaacggcaacaaacccttttgccacagaaaaaaacacaacaagcctccgccctgccccaaggggctgcgttttaaggctcccatcggggcttaagtgatcaaagtggctggaatcagagccaggggctttctgaggagcagccaagatccccaacaccttccccagccagccaggaggcgaaggcacagcgcctgtggccacgatccacaggtccaaaggggacccaggaagcggggttgtcccccactccctggtcctgcagaaggggaaacggaggccgcattctcacctggccctggagaggaagaacggtcttgcgggtaggggtggcacccgcgctgaaggcagtgttcgccctggaccacaccccctcccgcaggctccggtgcacccagcctcccctggacccagacctccaagggccaacctctcatttgggaaacaaaggcctgctgtgggggacagccaactgcatttctatctgctttgtcccctaggacaccagggctgcaccaacgtgccacaggtcacatgggtaccgggctgtgtcctgtgggctctgcaggcctcatgagcagcccagaacagcccccgcaccccttggagcatcagtttcctcttctgagaaatggaccgagggctctggctgtgtgggacgtggtgaaacccaaaagcccatgggagtctcgcacgcggcagggcctggggagctcgcttccaacagcctcggtcctagggactcgctcccccttcattcctgaagcccctgactcaggcccagggactgcctgggacccaggcagggcatgtcagcccaggccagtgctggcgggtccttcgttcccgaccaaagctagcctgggtcagggcaggacaaaggcgcgctgggaacagcctgggttagcgttctccctcgtatttatttggagttccctgttctctcactttatacgcatctggtccagggaagtaagtgcttcccctaggacccagcctcggcaggggcagaaggcaggcatgcaggaacagagtggggatgcgggcagtcacaggggctgcctctgcctccccgtcctggccagggaggtggaactccacctctgggtaaagcccgaggggggacgcccggagaggacgggcacctcgccgctcccagcctgtttcctcatctgggaacggctccgacccgggatggggagacgtgctgagtggcttgaggtgaggagtcaggtcctggggctgaacctgtgccccctccccccaaacgctggtctgttccagcccagcggtctgtgacttgtcagtttaacaaaaaacaacccaactgcacctcgggttactcagccagggaagcaaaaataaaacggggcttaaaaataccagcatggcccttccggagccttggcccctccggcccttgggctgtttttttccgcagggtggccggtgttgtttcagtttggggacttttgtttttgacagacctcagtggcctgtgcctcataggcgggagggttaaattcagactgaaagtgccctcccccaacctgtttcaaccccaaacgctgccactgggcatggggggggggggggagcagaatttaaggacatctgtagacaggccagaagaaacaaaccaaggtccctgggcttctccaggaacccataacacatggccccactgtaccagcaggcaaaccgaggccccgggcctttacagcacccgtcagcggccggtaccccagggggctccggcattccagcctcactgcacctgcctgaactgtgtgacttctgaggaccagcaccctctgagcctccgttcacccaggtggagaatgggccgtacagggacagatccaaccacctaagactctgaagaagccgccccgccctccccaccgggcctgcctgctccgcagtgataaccgtggcagtcacaatggtggcgctgctgtctgctcggtggcccatgaattcccactcaatcccaatccagcctcctcctggcccaagctcggcttctggcagcttaacttcagcacccacgtgtgactaattaaccacacagtcagtttcatgcccgcatcctctgcccaccaggggagtcccgtatggggcaggttgtgtctgccctgttcacggagggtggtccgctcagcactgggcaccccctcctttacttctttgaggaaggatcttactctatcgcccaggaaggagtgcagtggcgcaatcacagctcactgcagcctcaacctccagggctcaagtgattctccttgcctcagcctcccaagtagctgggaccacaggcatctaccaccactcctagctaattttttgagttttgttttgtctttttgagaaatggggcctcactatgtttcctgggctggacttggaactcctggcctcaagcgatcctcccgcctcagcctcccaaagtgctggaatgacaggtgggaaccactgtgcccagcccccctcccatttactgaaacagggtctccagggtctcactgtcaaccagactggagtgcagtgatcttttacttacttttaatttttgtatctacaatgaggtaagcgaccctgatcaggcccattttacagatcagaagatcaaggccgcattttgcttacccagccaagctgggggcccaggaccatgcccctgaggactcagtttccccatctgtaaagcagtaggctgtagaatgctgcgtccgggcaaaagccccatagcacacgtgctgccgtgcgctgtcagcctcctgccagagagcggcccactcccccagccccaccggggcctcccatccaaacagctgaggctccatcgctgaagtattcagcaaacactctcccctgaaaaccttcccgtgaactgtggaggcaaaggggtgtcgggggctgggcgggggtcctggctcaccatgctgaagtccaggaggtcactgagctccttgtctgtgcccacaggcgccatcctctgcggctggttcattctcctggggccagggcgggcacctcaggcctggaaacc

SEQ ID NO: 2784 - DNA, 43040 bp, Homo sapiens
  source 1..43040: mol_type = genomic DNA
gcatcgttataaaatgtcacgtttattgctacagtgctgttatatacaggacaggtctctgaatccacctgaaagagggtcgttttaaagtcccaatcatccagccagctgtgttgacacgtatacaattattttctttaaaaaaatttttttgaaaaccatcttgaggcactcagatcacaccccccaccccccataattgtggttcccaggaactgctgtttcttcctcctcgcgctgggtgaatctcgtttgaattctatgcagaacgcacagttccagaggctatggggccactgcccacccagacctaggggcagggccaggagcaaaacaagagggagaggcaagttcccttaagagatcaaactcccagggcgtaggggaagccaccgagaagggagaggcagccggacagcccctcccctccgcctggcctggactgggggcagataccaggcattgagctggccttgaggtttcccttgcatctaccatggggcccaggctcccaagccagtctggggaggggagtcaggcagtccaggatctcctgggggtaacggtgggagtctcaggagtggcacggggggagacgcccgacctgcagcggggatgaacacagccagcccaggggtccacaaggcctcaatgcagggaggggcatgaagggcacatgaaggcccccagctagccaggcccacacctgggtgccacagtgaccactgccctagttcgtgtggaactggatgggatcccagggtaggagacttgcagttttaaacccaagacagtccccagccagctgggaagagctggttaccctcatggcaaaagaccagaaaaggagacctggagagaggcctgggtgctgggacatgggacacagatgggcccgaggggacaccctgctggttctgcagcagggtcggacgcacagcccaaggccttcgtggggctcagaccagcacagtcccccggctccagccactcttgcccttggaccacacagagggagggcagcaggtgtggccccaggcccagggatgctccccagcattgggggaggctggccaggcccctggcatcctgtctacgtcacgatggccctctggtgtaatggggacatggtggggtggggtggggggtgtcctgtgctggctcctgagcagcatcctctcagccagagttcagagcatgagcctgggtccctggggcaaaggagtgaaggacagggtgtccaggaggtccccagcaccgggctccagggtgtggtccccatgccaggggtcactggtcccaacaaaatgccccatttcagagagctgtgcaggttccaagggagagcagcttaggggggcctggggagggcgttgtgtagggtagccctgggggccacagctgcttggcagagtcacctgggagggtcagagccaccttgctgacgtcccttcccccaagcccaggtcagtccccttcctgaggggagaggatgcggcagggaagccccaaggtgccttcatcagggaacgcccacgcatcactttccacatgacaaaaccaagagaacccccaacatcaaaaaaacaaaagacccgccgcctgtccccgttctgtctgtgtgcagtggcttccggggggggggggggacgggggggctcaggtttacacggggtctttttaatacaacgtttaatcatctggttgatcaagaaatgcaatgctcagtctaggaacagcagcagaaatagcgagagacacgggacttttatacaaaaaaatttgttgcttacaaaacatatgcaaaaaaagcttaaaaaaaccagagaccaaaggcagcatccttgctaattttcatctacattaagaaaaaaaaaatcttgtaactaatgtttttattttccttaaaaaaaatatttcgcttaggcacaatttgctggtggctttagaagaataagccaggtttccacagcatcccccttgagtgatatgtttccatttctccgctttttatagttaaggcatttttttcttctctgacaaagtgtatgttttgttgcttgctttcaggttttgtttactggaaaaaaaaaaaatgctcctgtcagcccaggcaacagggccaagatgcagtttcaggatccatgggacaggtcacagagtgacacggtggctgagattcggggacagggggagcgaggccagtgagtggtaggccagggccccagggagctcctggacccagtgtcaccttggccgcccccatcactccgaaccttgtcaggttggtgttggctcgatgctgacaacaggtgtgtgaggtgtggatgtggatgaagcccggggtctcgagtggccgttctggggccagagcacagggctgaaagcgggtggctcgtcccacggaggcatacctttcacatgtgcccggcggggttgtgggcttcgctcaggcctgggtggggagctgaaagcaccatctgggggtctccaaccacacctgacaccttttcctcttctcgccgtttcaaacaggctgctttgggattcaggttccgctctggagggaggggggagagctctgtgggagacggtcccagggaggagaaagatgtgaggtgggagtggggggtaggatgtcgggggggggggtgggggcagagccccatcacgtgtggcctcctgtatttccggctctcacctccttccttgagaaggctggggggatggggtggaggcttgtaaagaagagagtgggtatcagggggtgtctggggaacatcactgggtctgagtccagccacaaagacagacatggacagagtccgggggcggcaagcacaggaggaccccagcatctgcacctgggtgtggggaagggagagggtgctggggcagccctggccggggagcctacctcgcacctgctgctccagccccaggatgacctgcacggcctgctgcaggatgagcagcttggtctgcgctttgtccgacttgaggtgcatctggcacatgcgccccagctcccggaaggcctcgttaatatcccgcacgcgcacccgctcccgcgcgttattggccatgcgcctctcccggtccctcaggtctttctcctccagggacagcacctcgtccgtactgctgggtcacagcaccgaggcctctgttagtgatgcgccaaggctgggtgggagggcagggctgggttgtggagagggtatccagctacttgtgtttgtgctggtgtgggcagcagtgtgggtacacggctggtgttggtgggcacagcagtgtgggcagcagtgcaggtacatggcttacattggtgggcacagcagtgtgggtacacggctggtgttggtgtgggcagcagtgcaggtacacggctggtgttggtgtgggcagcagtgcgggtacacggctggtgtgggtgtgggcagcagtgcgggtacacggcttacgttggtggacacagcagtgtgggtacacggctggtgttggtgtgggcagcagtgcagttacacagctggtgtcaggcactgcagtgcaggtacacggctggtgtcgggcacagcaatgcaggtacatggctggtgtgggtgtggacagcagtgggggtacacggctggtgtgggcagcagtgcgggtacacagcttacgttgctgggcacagcaatgtgggtacatggctggtgctgctgtgggcagcagtgcagttacacagctggtgtcaggcactgcagtgtaggtacacggctggtgtcgggcacagcaatgcaggtacatggctggtgtgggtgtggacagcagtgggggtacacggctggtgttggtgtgggcagcagtacgggtccacatgctgatgtgtgtgttgtcacatgcgtgaaaatgtgcttctctgtgcacgcggcgaatgtgctccctggaatgcagcagagccccatggtggggcgcctgtgtgtgtacgcgactggctgcccaggtgcaagtgccctcagactcagctctaggggaggctgtggatgtggtcacacccaggaagacccaaggtctgactgttcccagacgtttctgtggagggagatggggccctgcttccccgtctgggagcccacagggtaactgcttctcccttgaccctgctcactctgtgggccccagggcagggctgggggcaggggaggcccagtgcctgctcctctctttgttcttccctcccaagatgatgactttccctgctcagagcagccacttgcggggtgatggacagctaggcctggccagactcactgtggacagaggaggccttgaagacacgggctcagcaggcaaatacctgggccactccaaaaacccgggactggggagtccaggactcaaatcagggctcacatggagcaaaccagctcccatcccccgagacccccacaccctggggaggagcctcagaaatgcacccgtcccctacagtgaactccggctgccccaagatgagccctccctgagctcctgcccctggctgggaaggccagctccctaggcctccaggaaccccattgtcactgccaccgtgaatggtcgcagtaggagctctgaggttccaagagcctgttctgtgccaggcccaaggctgagccccctctccagccgagcagcatgcagctggcgagcgggcactgttgctgctgccgcaggggtgcgggtcccggcccaggcctctgtgctgcatggccctgcatgggtgacctcgctctgttccctggcttcctacttggtagaatggatgccggtccccatcagggcacccactgctctaggttgtggtgaagatgaaatgggtgaaggtctggcccagtgcccagcatgcctggtgccctgtcttagtctctagggggctgcctcacccacttgcctgcccaccctgccttaggggcctgaggggatccctccaggtggtgggggcggcccctggagcccaggacaagcgcacagaccaaactgacaggaccaggggctgcgtgctcccgggtctggtttcttcccgcaagccctgacggggggctttgggggaggaaacgccctgaggttgcagcccagccgctcccggtgctcgggcagcaagtgcgaggtgaggaggggctgccacgggaagcagagggacggacgggcgggatggaggggagggcggaaggcagacagcagagaggcgggcttggggggcgcgaggcgtgccacacacggctgcagagactcggaaaccttagagctgaggggatagcgtgtgggccgggccggggctctggctccggtcccagcaacagtgctgcaggagagaaagggttaacggggtgcaggcgaggaaaggaaggagttaaggaagcagccgccagcgccagcggggggaaggagtcagctcacatctgcgggtggggacagggtctgtctgtatccttcctccccctggccctgggaaatgggggtgataggaagtttccctatcaccttcagatagggaaactgagtcagagacaggggatgggctcatgtggccttgcgtggcatctgcctgacgggaaggggccagggtggtttgcacaccagctcctgtctctgggatcgggggacactggcctctgtgagctgggttctgggcttcccaagaaaggaggaccacggcgagtgggagccccgtggagctgggagatacagttctgagccacagagcccaggcctgaaggactaggggtccagaaagagtccagtcctcccactgtggaggggatgctgaggcaggcagggagaagggctggcagtcaggagtggacagtcatggcaatgcggtcagaggggtgaagggcacagtcactgcaaggaggcaactgctgcagagggagggctggctccaggaaggcgggcggggaaggagaacgagggcaggaacacgagggagggtggcgctgcagggacgctggtggcccgcgcccccactgacctcgcacttgctgctccaagttcaggatgaccgagacagcctggtgcaggatgagcagtttggtctggggcttctcgctgttgaggtgcagttggcacatgcgccccagctccttaaaggcctcgttgatgtcacggacccgcagccgctcccgggcgttattggccacccggcgctccttctcccgctcggccttctgctctggggggagaaggtcgtcctcgtcctcgtctgggctatggggagggcgccgggagggggccagagggagacagtgaggttgggggaagagcgtggggcccgccgacggcctcccagtgtgggtgcggtgtgcgtgtggcctgtgcacatgtgcgtcctgatggggtgagggtggggagtgccgaggggtgggttggcacctggtccgggcccggggggccttcagctccttcttctcctcctccgagtggtcagccgctgacgtgttctcctcgtcctccttctcctcccgcttgatctcgctggcggccgccgtggcacctgctcgccctagccctgcaacaggcctagggtcaggggcctgcgtcggcctccagggccaactgacatatctctttgtgctcctgtggtgagggacttgggctttcctggaaaaaccaggtcttggccaaaaataaaaacaaaaaaccaacaaccagaactggatccctacctcacgccatgtgtagctaccaatgccagacagattaaggaccacaagatgaaagggaaacagttttaccacctttggaacaaagtgtgtagaaattctgcagcaactcaatggcaggaatctactaagatgctaaaagaacactcttcttttttggtgaaagtaaactgtttcaatcattaacttaaaaatatggaacacttcggatgggcacagtggctcacaccagctcacacctgtaatgccagcattttgggaggccgaggtgggtggatcacgaggtcaggagatcaagaccatcctggctaacatggtgaaaccccatctctactaaaaatacaaaaaattagccagctgtggtggtgggtacctgtaatcccagctacttgggaggctgaggcaggagaatcacttgaacccaggaggcggaggttgcagtgagccaagattgcgccactgtactccagcctgggtgacaaagcaagactccgtctcaaaaaaaaaaaaaagaataaaactttggaacacttcaggaatgtccacgtcacccttgtgcagatgctatgctaatctttatcattctcattttagtccaagagctgtccaagcaagtgctcaaagcgctgcttttgaaagaacacaggccgggcacagtggctgactcacgcctgtgatcccagcactttgggaggctgaggtggaagggtcacttgaggccagggggtcatggctaccgtgagctgtgatcatgcccctgcactctggtgtgacagggtgagaccctgtctcaaaacaaaacaagtaaaaaagaaaaaacaaaaatcagtaagctggactatatcagaattgagagttcctgatcagcaaagataccaggaaaagaaaagcatttgccaaagaatagaagacacccaccacagatgtagccaaccaggaggtgatctcccacaatcaatgggaaaggacaaaaagaaagtaactcagtagaaaaataagcaaggtatccaaaaaggcatctcacagacaaggaaaccacatggctagaaacacgtggaagtccgcttcagcacatcaagagattaaggaaatgcaaattagggtggctttgcgctaccctttcatacccagtcagctagcaaagttgagggacctgaacagtcaaaatcttgcctgtgggagggcaacttggctgctttggaaaataattcatcagcctttcctctgaattgacaacaggtgtatcacacccttgatcagcaggttggcaggaaagcgtgatgttggaatgacctacagccccacgcccgggccagggccaacggcacactcacaatgggaccccagccgctcacaccacacatgtaccccacacacaacataagccagcaaaccagcgtgtaaagaacacgctagtgggacgccgtgttcatgaagctcaagaacaataattgcaaaacatgtggcttaagggtacacagtgccccaaatgaatgcggccactctgcattcagcagggcctgggccacccccaaaacccgggcttggggagtccaggaatcagtcagggctcacatggagcaaaccagctgccatcccctgagacccccgtaccctgagggggagcctcagaaatgcacccgctccccacagtgaactctgctccaatcggccaacgccagccaccaggaccagcccaggcctcagcacacgaagtgaaggacaggaaggaaacagaggggagcctatgggtgaaagactaagcttggggctgcccctggaaactgctgacctgtgggtccggacccttctctggggtggggccgtcctgggcactgcagggtgctgagcagcatccctggcccccacccactccatgccaggagctcccctcagccctgacaactgtagatgtccccagacatcacccagtgtcccctgggggcagagccgctgcggtgagatgccctggcctaggagtgatagaatcaaggtacttggaaagtctgcctggaaagcaggcaggattcctgggctggtggaaggcacagggccaggacagcgcccacaatgaccccaccttctcctgggcctctcatgggtgtctgagacactcaacaatccccaggcccaggtccagatttgtccccaaccttttcctttgtccccttccttacggagttcccagccccagtgtcacccacagctcgggccagaaatcccagagccaccctgccttctctcaccctcaagtcctgtccatcacaaatcctgtgggccccgccttcaggagatgcagggcccacccactgctcacccctccaaggcccctggaccagccctgtggcctctgccttggtctcccggtgccactcatagtctgtcctccaagcagccaccagagggtatctgtgagcacctgggtcaggtcccatccctcctcagccctccacggctgccacctttctcatggccaaatcccaagtcctccccgcagcccacaaggccccgcatgacctgccctgccccgccctccccccttccctctctccctctcctcactctgctccaaccccacgggtctcctggctgttcctcccaggtgcagtccagccccagggcctttgcctgggctgcgccctctgcctgaaaccctcctcctccaggtacttgcctactcttgcctcctcccagatgctgcccaaacaccaccttgtggcctcatgggccaccatcttcaaagccatacaaaacccccaacccaccgcagccacttcgttccttctccctggcacctgtactgtgcagcgagctcctggtctgtctcccctgaggcagaggcatcctgctgcacccctcgccccttccccagtgctgagcgctgccaggcacacagcgtctgggagcaggcgaatgaagaggcagcccagagctgtccacctcacacgcccagggccaacgccggccccgccggtcttacccaccctcctgaagttgctgactggggcgcccatgtcaccaggtgcccccacggtgacacctgccctgggctcccaccctgacccccaccactagagtgcctcagtttccccaactggaaccaggagtcggacagtcccaagctcaagggcttaccactgtaggagtcgggaggccgagacaggtcagggagggtgcctggctggctggggagggccgcgtggttgtgcatgaggctggtgctgcctgcgaggccgtcctcggggtggctgcctccaacctgcaggcgtggggagacgggtgcatcagggggagccgggtccccgcccactgcccagctccaccctcgcccagcgctcaccaggcctgcgtgccgcccgcccagtgacatggggccggtgaaacctgaggccagcgccccgtggccaggcagcagcgtgtgcatgtcgccggctgtgcccacggcgtggctgcggagcacgtggatggcctcgtccaggtggtcttctatcttactctgctgcagggtggggggatgggtggtgaggggcccaagccgagggaccccacaggcctccattcatgtcccttccgcatgcaagtggccggtggtcccatcttccccttccccaggaagctgcatatgccaggcatctggcgcccgggagcacacacaaaatgtgtgtgccttggcggccacgaggcctcaataacagcttggggcttatttacaagaaactaacaaaaaggtttctccttctcaaggagcgtctgtcctgcaaattctgtcggggaagggtggggtggggcggggcaggcactcaccaggccgtggagacccccgtcgtagctgggcgataaggcaccgggggctcctgctcgaggccactgtgacgttcctggaagggagtggggacgtgaatggggtgcgaggggcggggtgtgagcatggcctgatgcccatggggagggattcatgaaccaccccgcctgtccagcctccggtgatgcccaagatggccattccggggcaccccacactgatgcaaagctgctcggccccgccaggcagggatgctgggtgcccagtgggtactgccattcctatctctgagcctcagtttccccatctacaaaatccaactccccactcagaggataaagtggctcggcagcacacagtagggggctcctccccatgctgccccaccctggctgacccacgctgggctccagcagcaggcaagaaagtggcaagctccaggtgggaccagacaggccgaggtgaagtgagggttcctggcgcttcccatgggggcagagatgaggactcacgggtgtttttaaacacccagaccttctggaaacctccagttctcactccccctcctcctgtacctgcccccgaccccctgcggataagcaagcacgtcctcacagggataggagggtctgccctcccatgccggagcaccgcacagggtaaacagtcagtacctaataaatacccagtgggtgagcaaatggcaacacgcacacattctagagtccaggccacagccctggcgatgctggccccatcggacctgggagctgctaggcacgccaatgtcccctcatgttcacgcagtgtgaactgccaggtcctgcctcctggctttgcctgtgctgtgacctaacctggacgccacctcccagccctccctcactgcctggttatgtgctatagccttggagggctggcttggaggctgcctccactaggcagctttcctggattgcccagtggaacacaagcccatgggggactcccttccaccgtcggttcctgaccagcgatgccacgggcccttgggggccatctgctccctccccgctgcctgcctatcccagcaaggtgcagacaccagaaccagcctcccctcccccgcaaagccttcacagacctcagcctcccctccccccaaaccctcacagacctcagcctcccctccccccaaaaccctcacagacctgccaggccctggggggagcccacgggggtagaagggctggacgagaagttattgcttgagtgatccggggagtagatctgcgaggaggaccaggagagatgggcggtcaggggccggcctctcaggtcacttgcctggccaccccccatgccccacgcctcaccgaggccagtgctttgccgagggcatccccggagctgccagctgtggtccctcgggagcctgtgggtgaagagaggtgaggcccacgcagcccggcctgggtgctgccgccgacggcaagctctcctgcgttctgccgtcctgcacagacactgctgcgccagggagagcagcctgactcgggtccggtttctgtctgaccccctgaaaccagcctctgcaggggttgaggcactggggacaggccactggcaggggaccctgggtgggtgagtccccttctgggcctgggtgggtgagtccccctctgggcctggatgggtgagtccctctctgggcctgggtaactgagtccctctctgggcctgggtgggtgagtccctctctgggcctgggtgggtgagtccctctctgaccctgggtgggtgagtccctctctgaccctgggtgggtgagtccctctctgagcctctttcccagctgtaaggcgggaaagccgctcctcaaagatctgtttccagacatcccaagcccaacgcacgtggcaggccctgcagacagcggacaatgagaactgacaacaacccgctctcagggccagcagacgcgcctgcgcctcccgtggagtcctcgccaccccccacccagaccctgcctggagcccagtgtcccctcggagaggccgcatcccagggaggggccatacccaggaggctgtcggccccgctgacaggcggcgtgtggctggagacgccgccgtacgtggctccgggggctgaggagaaggaggatgcagatgggagcccaccgttcacctctgctccatgcagctggtagccctggggggtcaggcaggaggagggtgggttagatgggcactgccaccctccgcccaccccctgccccctgccctgggtcctaccatacgctcgtgctggtgcaggccaccaaacgtgctgctgcttccactgctgcccaccgggccgctaccgggcgggaggggcagcggggatgagcccccacccagcatgggcccgaagcccgcctggcccgggggactccagagctcggctgaggggtgcaggctgccatctgtggaggggagctggtaaggtgggggccgagtggggaaccccagccctgccctaccgtccctggcgagcccccgccctgccatgtacctgccacgtagaagggggcgggataggtgctgctgggggtcttggcggacgggtaggcggtggcatccctgccgtagtcctcacctgagctgggtgggtacacctgcgggcgggtgggcggtggggggtgcagtcaggacggagggaccacgatcagcccatgcaccttgccggcctcctgtcccctcctggtagcacatctaccaccccgtttcccttccctgtaaagccacccccctttaggtaaatcccagcccctggccaagtttgaggttcttatgatgtcctggtctctctctcctactccttttccagcccccacctcccgcctccctgaacttctgacctttgtacttgaggacttggatctggctctgcctactaaacctttttcctccttaatccagaaaactcctatcgacccatcaaaaccccagctccaacaccccatcccatccttctcccttgttccccagctggaatcaatcttccagtgctgagcttcccttggtcccagagcaacattcgtccttcactaaagtaacaggaagaggggtctgtgagtagcgccagctctgactggttggcactgcctggactgtggggctggggcctgttggtaacgtctgctgctgtgctggagcgggaagtatgctgggtgggcctgatgttgtaataaactggggggcggtttcagggcagagaaagtgcaccctggggaaggaggggagtgagtgatactgttgggagcagagcctgaccacgcctttggcctgggaagtcaacctgactctaaccccgaacccaggcctgtggggagctggtcggctggaggggtgaggagatgtatgcccagggctcttggggccagcacaggcactgggcagagggtggttggtggctactgagccagggaatcggcaaattccctctccctccagcgagatgagaccgcaggagtgtggcacagcagcctggaccatctgcgaggcctggtagggaggcagggatgcggggcagcctgaagctgtgaggatgtaacagggagccccaattgcggcaccccccgctttttttttttttttttttgagacagagtctcactctgttgctcaggctggagggcagcggcatgatcttggctcactgcaacctccgcctcctgggttcaaacgattcttctgcctcagcctcccaagtagctgggattacaggcacgcaccaccacgcccggctgatttttgtatttttagtagagatggggtttcaccatgttgactaggctgatctagaactcctgacctcaggtgatccacccacctcggcctcccaaagcgctgggatgacaggcatgagccaccacacccagcacaattgtgccctttctaaaggggcctcagccaccaggactgcctttctctcaaaacaagacagacagaggctggacctagggaaggacttccccgccttcccttggaggcggcctcgggtcagagctcagatcttggctcagaaatcacagggggcctgtccactcagggcccaccccgccatgtgtgttcccaagcttcgccaggacacagggcctggcactgccactgacgagctgtggggtcccttctccctcgtgcgactcaccgaggatggaagacccggcgggaccttccggaccttcttgggctgcgtgtctgttagaagcaaaaggggtgagaaccggccaccggccatgagaacaacccctgccctacaccctggaggagagaccctcacaattcccgtttcatatattaaaaacctcgggtcggctgggtgcggtgcctcatgcctgtaataccaggactttgggaggccaaggcaggcagatcacgaggtcaagagatcaagaccatcctggccaacacagtgaaaccccgtctctactgaaaatacaaaaagtagccgggcgtggtggcgggtgcctataattccagctactcgggaggccgaggcaggagaatcacttgaacccgggaggcagaggctgcagtgagccgagatcgtgtcactgcactccagcctggggacagagaaagactccgtctcaaaacacaacagcagcagcagcaacaacaacaaaaagccccgggtctatttatacggctccaaagatgtcgaagaaccacgatggttttctcccgcgacgcgcagtttggaaaacgaggagttggtggattctaagccaaggctctgctgagaagccccttggccccaccctccttccaagatggccccgactatcccacgcagtcaggcttcaccactaggggctgctgtttgcaaactcgcctacaggataaaatccgtaacccggaaaccagcactcaggcgccttcctgatcactcacggacgtgcgcacagtgggaaaagttcgagtggcccaggcgcatgtgcccagccaaggcggaacagaggcctcctcccgcatcatggggctcctgtccttggtctattcagagccacgatcttttacgtttttgtgctttttgtgggtgatttcacgcttatttttttcaggcagggtcttgcgctgttgctcaggctggagtacaatggtgcgatcgcagctcattgcagcctcgaactcccagggtcaaaccatcctcctgcctcagcctcctgagtagctgggaccacaggtgtgtgccaccatacttagctaatttttaaaatttttcgcaaagatgggatctccctatgttgcccagaatggtttgcaacttttggcctcaagtgatcctcctgtctcggcctccagagaagctgggaccccaggtgagtgccgccatgcctggcgactgtgctgcctggaatgggccccgggtagttcaaggcgccgtccagtgctcctgagcccgaggctgtgacgtgcctcgcgggggatgcccgcgtgtgcagcagggctcagtgcagaggagccacgatgcagccccatgaggcatctgacacagaaagcacatggcagagcccgtgcccgtcagctgcaggaacctcgggaccagaggctcgtaggaacctctccctggacgtgccacgcccgccggcccctgcctcgaccccccgtcaccgtccatccctcccacggcccgagcgcccgacgtccagccaggacctggaaggtgcggggtctgctccctctggtgccctcagctaacgggaagcctcctacctccctttgcaggctccctcccagaagcccccgatgccccggccagaccccgctcacctaggctgccgtctgccgctctccgccgggagctgccggagtaggaggggtagtactgggaggtccccttcatgcccgaaggggacaggggcccggggctgttgagggccagctcgcctgacaggaagccagcctggtggggagcggatggtcagaaagcgcccagctggcatccagaccccaggctgttccattcaagaaaaaactgcaaaggccgaagccactcagacccgccctgcagtgggtgatgccccttctgcctgtcacggtgtttctctgtgacacctgctgtgtttttctgacttgagactgaccgcatcccacactgctgttttcacgaagaacgaaagactgagaaacagataccagtgtggccaacccaaggggctgctcccccgattctgagacgcaaagtacaaagctgcgtggctaagcgtctgtgcacccggctgcttcctatctttttggttttgttttgtaaagccctcggttggattctgtacatgttagtgtgaaacgggctttcttcctggggagccagggctgccctgagccgggtcccggaactgactcctgcatttcatccgttctaaggccgggcacggtggctcacacctattatcccagtactttgggaggctgaggcgggcggatcacctgaggtcgggagttcaagaccagcctgaccaacatggagaaactccgtctctacaaagaatacaaaattagccgggtatggtggcacatgcctgtaatcccagctactcaaaaggctgaggcaggagaatcgcttgaacccaggagacagaggttgcggtgagccaagattgcgccattgaactccagcctgggccatgagcgaaactccgtctcaaaaaaaaaaaaaagaatcatctgttctatcatcatccagtggccccacggggtggcccagcgcccaggacagggccttctcccgaggcccggcctgtcctgagcccgcaccctgtgtggccaccgcggggctcgatgagtcacccgggagcgccagagagcagggcccgagccctagttctgcttctcggatggggagcccgggcacttgcgtattcctgtctgtaaaatgggcacgtaggccgcggcccctcgttgcggggactgatagggaaacgcgcatctgcccctggcgcagagcctggcacccggctggccccctccatcactatggctactgttgctctggcttgggcacagtgagcacacagacggccccacctgtgacaaggccgagccccaccgagagctaggagctgacggcggggacagagatgaagtcctggggtgagggaggaaccctgggggtgcccagcaccggaggctgcatgggacccctgtggctggtcacagcccccaacatcctcccccagcctcacaaccagggccagcgtgggtgaggatctcggctgcacaggggcctgttgtatgggctccccagggggtccacacctgcaaagccctgctgcatggcctgttttcctgcctgccactcagaggagagggcaaccgagcccctccagctaagcatggcagccctgcaggccttggcctccctggtcctcacctacctcccctctgctcccggtccacacccacccagcccaccctggcccaagcccagcctggtttcgctatcaggaagcaaacataacctagctaagccaggagagcttctgcagatcagagagggtgggtgacagatttgtttaaaatcaaaatacaccccagcccggcccgagcccctcacctgagtcaggccgcccacgcctgcgtctctcccgaaggaggcataggcgccccgctcaccgctcttgcctgcaaggggagaaggaaggttagtgggaggcgaccccaaggaacatcctgagggcccccgagtgcctgccatgtgcctacaataggctctcagtaagtgcacacgactgagagcgccacggcaggatgctggcagagcctgaccccagtgtgcccatctcggggagccctggccccagtatgcccatctcccgcagagccctgccctcagtgtgcccatctcctgcccaatgacaggcttggggacaagaaggggtccccgatgatttcggggccaactctgagcatctgcagcccacagaagccctgcccagggggtggggcggaaaggggacagcagagctcacggggtgaggtgggaaggggacagcagagctcacagggggtgaggcgggaaggggacagcagagctcacagggggtgaggcgggaaggggacagcagagctcacagggggtgaggcgggaaggggacagcagagctcacagggggtgaggcgggaaggggacagcagagctcacaggggatgaggcgggaaggggacagcagagctcacggggtgaggcgggaaggggacagcagagctcacagggggtgaggcgggaaggggacagcagagctcacagggggtgaggcgggaaggggacagcagagctcacgggggtgaggcgggaaggggacagcagagctcacaggggatgaggcgggaaggggacagcagaactcacggggtgaggcgggaaggggacagcagagctcacggggtgaggcgggaaggggacagcagagctcacagggggtgaggcgggaaggggacagcagagctcacgggggtgaggcgggaaggggacagcagagctcacggggtgaggcgggaaggggacagcagagctcacaggggatgaggcgggaaggggacagcagagctcacagggggtgaggcgggaaggggacagcagaactcacggggtgaggcgggaaggggacagcagagctcacagggggtgaggcggaaaggggacagcagagctcacaggggatgaggcgggaaggggacagcagagctcacagggggtgaggcgggaaggggacagcagagctcacgggggtgaggcgggaaggggacagcagagctcacgggggtggggcaggaaggggacagcagagctcacagggggtgaggcgggaaggggacagcagaactcacggggtgaggcgggaaggggacagcagagctcacagggggtgaggcggaaaggggacagcagagctcacaggggatgaggcgggaaggggacagcagagctcacagggggtgaggcgggaaggggacagcagagctcacaggggatgaggcgggaaggggacagcagaactcacggggtgaggcgggaaggggacagcagagctcacggggtgaggcgggaaggggacagcagagctcacggggtgaggcgggaaggggacagcagaactcacggggtgaggcgggaaggggacagcagagctcacggggtgaggcgggaaggggacagcagagctcacagggggtgaggcgggaaggggacagcagagctcacgggggtgaggcgggaaggggacagcagagctcacggggtgaggcgggaaggggacagcagagctcacggggtgaggcgggaaggggacagcagagctcacggggtgaggcgggaaggggacagcagagctcacagtggccctgcttcctgctggccaggcccctgcccttcctgagcctcagtttcctctgtttcaggcgttgaggggctgatgccctggggtgctggggtcagaggcatttgtctgtcccaggggacaggcctgggggccctggcggggagccccggggcctgtgcacaccgcatcaggttcaccgcacaggctcccccaaagtgcccagcattcagccttcaggccagggttcattcgcgaatgagcacgtgacctgcaccccaccaatgagcacttccctggggcgctcagtgacaaaggacaggtgaggcctcggggctacggagggggtcagctggccagggcgagcccccagcatggaaggcctgggctacggaggggaacagctggccaaggcgagcccccagcatggagggcctgggctacggaggaggacagcctgccggggcgagcccccagtgtggagggcctggggctgatgcggtgacacctggatccagccttgcctgaagcaggcaccccgattactcaggacctgagccacttaaatccccttctggctgacactgggcacggaatgtgactggggctgctgtgaggggctgggacgcgcgatcgagtaatgtacattattctcaaagcaggaaaaaaatttcccgatttttgaattttaaaagttcaacgatttcccaactcctggaacaaatgctgctgttttttgcctcccgtttcctcatcttggtgacccggggggacatggggaagatgacagccacgacccaccccacaggccacacccggccacagcagtcactcgcccggctcctcgggtgagaaaactgaggccataggagactgaggttatggcaaaagccccccgtgcctccccgggacccccgcctgccctctccaagctgcctggctatggcctgggccccacccgtgggggtggcaggtgggacatggctgggctctgggcattgctggccgggccgtgggaactgcccacgtcagccctgcccaccctggggccatcgggggtatgaggaagaggctgggaggaaggaacagccagtgaggaaccaggctcccaggtgcaggggccacccccggcaggggggcggggccaggcctcacctaccccgtaaggggaacgggcagaaatcgcccgtggcacgtggtgggccctcagacacacccgccagaccttcacgctattcgcttcctactcaggacaccaactgactctactgtactccaagttcgaggccgggcaaagcgagacaggaccgtccctgccccgctgtggggcccaaacaggcgctgcccctcagggtccagggaaaaggctgggtcggccaaagtcctccgggcctcagtttccccgcaagccaacaatgccgaggggtacacggtgagcacctgggccccgcagcaggtccagtgccccacagctcccggcttctaagcagcgcacacccccactgcaccacgaaaagccagcagaaacactgcctcaaaccgtcgggttccagagaagggaaggatcccgcatcccaggatgactgagggatgaaaccacaaattccacagctgaggcactggggcaggaggctgaccacgacagcgggacccctgaggcccttaccagccccccaagcagcgggacccccccaagacccctacctgagcccccgaaccctggggcacaggacttgacactcccgcaggaggcggagcatgtgaagctcggggcatttcctgtgtcacccgcaggagggaccgcacacgggacactgtcccagtcgcagccccaggtgcctggaggagggcgtcccagtcagccccacccagccgcagacccccggccagggtgcccttcccaagcgtcggttcgttcccctgcagcacgggtgagcctgcagcggggctggaatatacccaagaccaggcaccaacccccacctggcattgggcagggcctgcagagctgggtcagtcctcaccgcctccctccaagaaggttctgggagggtccctttcccacagtggggaaactgaggctcagaagaggatggcgcttgcccaggttccgtggtggggtgggaccagacaccaggcctgagtcttcattctttttttttttttaagatggaatctcgctccatcacccaggctggagggcaatggcgtgatctcggctcactgcagcctccacctcctgggttcaagcaattctcctgcctcagcctcctgagtagttggcactataagcatccaacaccatgaccggctaatttttgtgtttttggtagaagcggggtttcaccatgttggccaggctggtctcaaactcctgacctcaggtgatccacccacctcgctctcccaaagtgctggtattacaggcgtgagccaccgagcccaacctgagtcacgattctctcggttaacaggagggccccccagggaaagagggcgggcgggcggtctgcggaagggcatgggctctgaccaccgcacactctggccgccctcccgagtctccagaactcctacgcctccttcccagcgggcacaggccagcccggctgacccctccccgggaagcaggaggagccctgcagaaatcccagggaggaagtggggtctggaacggcctccctgcctctacgctcaggcggggaagcctagttgcagagtgccgtgccagggagtccgggccacgtcccctgcacctccccgcagctgctcccaggacgggcagaggcttcggctgtccacaccctctgggtgaacgctggggacttgcctggcgctgtgcgtgcactgaccatgccaaggcccacgtctgcacatctgtgcacagcagagggaccgcaccaggccaggcactcacctccgagtcccggtcccaggaatgtggatgaagagaggctgctgtgcgactcagtgaagtgggtgccctcgctgaaggtctaggggagatggggtggggatgagaggtgctggggcttcacaggccccccctccaccccgcattacagctggagaggcaggactcaaacccatgtcccccagtccaaacccctggaaggctggccccttctctcagcctcagtttccccacacccctcgcccccaactctggggacaggaaactcagggtctcaggcctcacggggactcctacccggctggggtcaaaggaggagctgctctggtcgccgctgccccaggagcctgagctgggccggtcctcaagacctgcaggcaggacagagagagttatgggtcaccctcacgcctgcccagctctaaaagcttcggttcatcatctcaggggcaaacctcagtggacccggggggcttgtggaacccttcctaacccagcctcacccagcccgactcatgaggacaccagtcagcagctaacacccagacaccctgggactcggagcacttacaggtccataaacttaaattaactcttccgtcggctctctgctggccaactcctacccacccactaaagccccagctttcataccctccttgggcaaagacctcactctcacgccgagcctcctccccatcagccccaagtccctccctctggcccagccctgactatgtggactggggtctctgtgtcagatgcagactcttctgaccctgtgagaaaggctcatgacagcatgagggtgtggaagctaacccatgagctctggggaggcccagggtctccctgtccccacctgccagtgtgggaagtggggccgccctttgctgaagcagcagcagaggctcacccatcgggcaggaggctggcagcccgtgagggtggagccgaatctcatcacccaggaacaagcccagtgtggagaccagaagcctgcgtggggcaggagttcccggcgcagcaagggacgggacgaggaccttggtcccggggcggggcgggcggggcccttatctctcagaacactcacaggcaacgcccaggactccagaatcttctgccctgggcagggagggcctgcttggatccttcccccttccatcgggggccacagagcacacccgtggagaagcaggagcgggccctgggcctcctcagcttggccacggagttgctgccctgccttggtttccctctctataaatgatttacaaacaggccctacttttgcagggctgggggtgtccatgtccaactcccaagtccagaggcttcccgagagccaggcctgggggacccagcccagtgctgatgtctgtgaccggcaccacctcaggctgttctgcaggctcccccgccccgccccctgccctccctgctcatccacaccagaaacttctttcaaatcgcatccttctatttcggtgcctttgtgttaatcattccccccggggagtattggtgtttaattgctgtctgatttgcataattatgcatattaatctccaagtctaatgaatattcatgcgcctcatttagattttgttttctaatcaaaaatttccaatgtgattatgagtggggggctgggatgctgccttggctgggttgggggccaggcagggggctcctgtggtctccaggaatccacacggcattcgctgccaggtctgggccatctgcaccccaagatcctggtcctgcacgtgggccctggtgaacagggcagctgctgaggccagggtgggctggctgtgtaggggtgggcacagcgccggcaccctctgggtctcagtttgcctctataccacctgcatgttgtctggtcccctccggccatagccagtaccccaggaggtgcagagacccccaactgagcaaacgggaggctcctggcaccccagccctcatcccctggaaggcctggtgtggtgggggacctcctggggccccatgcccagggatcgcccccgaagttcactccaacaggcctgtgccagaggcactgcggcctcaatctgccctttgggggaaccctccctcacccagccttggcctcctcctagaaatgacaaaaataaggacagcccccacattaatacagttattaaaatcccccccaccgattaatgatgcattttaataacccaccatgaatattcataatgcatccattgctcctgttctaattaaaatgtactaatagaataagacactgctgtcagagtgtggttttctgtgatttctttggtgaagcaccgcagagttttacccgggaagggcaccttcctgccctgggccagcctggctgcctcgggagaggcctgcgagtggacggcgcaggggcgctggggagagggccccaggagcggcccaccccttgggcttcagttccaattccagtcacggggtgtggaagccgcccacctgcctgggctgccgtgaggataacaatgaaagatgctgcttcagagaggccatccgtagccaaggaatgctccaggctggtggtttcccagtcccggtccctgttgggtcccctcctgagagggaccggggactggtctttgcctggtggctcgttggcaaatgggagagggaggcttcaaaaggcgcttagtaaataccgggtaggactgagattggtctgcagcagggatctgcaaacagtacacaaggaccaagtctggcccctaagctgctttttaaataaagttttattggcacacactatgcccgtttgtccatgtactatcaacggctgcttttgctgcaacagtagagttgaatcaattccaatagagaccatctgtcctgcacagccaacaatattcactccttggtcctttccggagaaggctggctgaccttgatacagaaaaagactgtccaagtgccttcagctgcctctgcacaagaaacccaatcgacagacttcagtaccaggagtggggttaccatgccgggcaggcaaaactattggtggacacgggccctgaacacagccctgtgtaccgcccctgccaaaccctcaggcacaccaccaggtggtctggcttcagatgggcctggggacttcatcctatagccccagctctgcaatgtgcccccactcaggtgctcaggctaaagtcctgggagtcctcctcaccttccctcctcccaaagaacagcagcttgccccatagctacagcagcgggttaagcccagtccctgcagcagcttccttccaagtctgctgacatcctcaggcagccggatggagcctttagaagcaaaacttggctcttctccctccctctaccctctctcatggctccccaccgtcctcaggataaagaccaaactctttcctgatctcaccactctcctcttccccaacacaggaggtgacccccacccacaccccctgcctgagccccttcccagcctgggacccctctttgtctgcagcactgcctggaacacagctgacgcccccaaaacacccaccctcaacgtcttcattttactcataaataactgtgcttccaagaacattttcctggaggatcaaaatattctccacctctgctgtccaatacggggaccacactaccaactgctggaaacgtggccagcattttttcaagcacattaaaaattacatttaaaaatgtgtatatggctaatgcctgctgtactgaacaacccagtccccaaaagcaaatgaaataacagccaccaccaaataccacggtcacgtctaaaaaccaattaacacctcgacagctcctcacgcaggttccgtttactcgggagtaggagcgggccacccgatacagggtcactatgaccccccaagcccgtgcctcgccccgtctcttcttcctccttataattaaaatcgtgaaggaccccgatggcagcctgtcccaccgccctgcctgggtctggcccctgcagcttgtgatgcttctcagacccattcccagcccctctgggggtcatgacgggtgagatcagacagaggtttgaatccgggggtggcctttccttgggtggagcagtattttaaaaaattttttttttcttttgctttgagacagggtcttgttgcccaggctggagtgcagtggtgcgatcttggctcactgcaacctccgcctcctgggttcaagtgattttcccgcctcagcctcccacgtagctgggactacaggagcctgccaccacgcacagctaatttttgtatttttagtagagacggggtttcatacatgttggccaggctggtcttgaatcccagacctcaagtgatccgtctgcctcagactcccaaagtgctgggattacaggcatgagccacaacgcctggtgaatttaaaaaaatttttttgtagagatggggtctcactacattgcccaggctggtctcaaactcctggactcaggcgctcctcccaccttgtatttcccaaagccctggggtcacaggcgtgcacagcctccattttatctaaattcaagctatgggagaagatgaaagaccaggatgccctcggcccagctcgcgcactgcagccgccctgggtttatcttcctgtcgtgtcttcttggtcagggcccgcaggctgtgtagcacatgctcccagcttctgaggaggatcccgagtgggggagaaaatgcttctggggcaccacagagcccttccttgttggggggctgacgagatcccgcaaagcctcccacttcgatctgcctctaatgtctggcgatggggggtgggacagcagggccctgtggcccgcccgcgagcagacaaacctgaggctgaagagaatgtgagtggagaccacacaccaccctaagagtgggggtccccacagcacctaaagtggcaggacgtgccctcgggtagaggcacagtgaggctgtgcgggcaacacaggcaacctcctccgccagaaccggggacgcctcgcaacctcctccaccagcacgggggacaacctcctccgccagaaccggggacaactggcaacctcctccaccagaagcggggacaacctcctccaccagaaccagggacaagctcctcccccagaaccaggggcgcctcgcaacctcctccaccagaaccgaggacgcctggcaacctcctccaccagaaccgaggacgcctggcaacctcctccaccagaaccggggatgcctggcaacctcctctaccagaaccgaggacaacctcctccaccagaaccagggacaaccttctcccccagaagcaggggcgccttgcaaccccgctcccccaaggccctggggtttccctggagggcagagctggccccgagagtgggcatcgagcacagatgttaagtaacaactcagagaaacagggccccgctttgaatttcagtgaccacagagataaccgagaccccatcccgctcttgcttccatgtctatgggcatcaccagtgacacctgagtgtggggaccggagaacctgcccctcaaaacaagctcagaaaccaacccggggccgggcacggtggctcacgcctgtaatcccagcactttgggaggccaaggcgggcggatcacgaggtccagaaatcaagaccatgctggccaacagggtgaaacccccgtctctactaaaaatacaaaaattagctgggcgtggtggtgggcacctgtagtaccagctactcgggaggctgaggcaggagaatggcgcgaacccgggaggcagagcttgcagtgagccgagatcgtgccactgcactccagcctgggcaatagagcgagactccacctcaaaaaaaaaagaaaaagaaaaagagacacaagagggaacccaacatggaacaaaaaggatgaagttcaagaagttcaatgatttaccctaaaaaacgagaagactgtcttaagcctgtaagccccatggatcctcaaagaaatggcagagcctgggggttctatggaatgaagtagacagtgagcacatttaattacgaatcaagagattcctagaagccgtaacaagacaggcacacaaggaaagccctctgggggcactttgtgagttctctctcatttcactgaatccttgcagtggctacattacccctaccctacagataaggaaactgacgcaaaagatagatgccatttgctcaagccctcacagtaagtagcaaagtcactatttaatgatacaaatgtttcctagtaagatgcaaatacacaattatgaacagatacaatgtttttttgttttttttgtttgtttgtttgagactgagtctggctctgtcgcccaggctggactacaggcgcccaccaccgcgcccggctaatttttttgtatttttaacagatacggcatttcaccgtgttaaccaggatggtctcgatctcctgacctcatgatccgctggcctcggacaatgttttttaaaagtagcaatttattggtagcaaataccagcagggaagagaaatatacaggctcaattttcaccttctcacagaagggggcagatgcgatttcacttcggacgttgagagcgcgagaaacggcgtgtttaaacgtgttcttcacaacgcagaatactaaccgctattcaatcacggccttaaacgtgttattcaaaactagaaaagaaccactggcagagccgcaaagcggtacagagcttcagaaaacacacaccgggggaagcaatccggagttgggagcacacagatggaaaaacaaaataagacgatggaaggaaaagctgagaacgaagatggacgggtgcttaacgtctttaatctgaaaacacggtgccgaccaaagacagttttgaaacaagcgactcaggagatacaaccaggagcacaaagatctgccaagccacaccaacaaaaaggaagggttgcaaccttcatatcgaagtttcaattcaagggaggtttctttttctgagacagagtctcgctgtgtcgcccagggtggagtgcggtggcgcgatctcagctcactgcaacctctgcctcccaggttcaagtgattctcctgcctcagcctcccgagcagctgggattgcaggcacctgctaccatgcctggctaattttttatattttagtagagatggagtttcgccctgtgggccaggctggtcttgaactcctgacctcagaagatccacctgccttggcctcccaaagtgctgggattacaggcatgagccaccaccaccagccaaggaacggatttttttgttgttgacaatggctcgacccacaacgaaatcccactgtctcagcccacacaagcccacaatcctggcatctaaatacgtcaacagagaaaccgacaaacagaacagagggggatggcgctgctctcagcctgacattaaacagattaaaaatctaaatatggttcaaaggcctcgcagctccacatccaactatccctcaagtactcacaaagaaggacaaaaataatccatgtttcagcctcggcagaggagctctgcgtcctccaaacagtagctaccgtttaagccaaagctgagttttggcactggagatctagaaatcaagaaaggacctccaacttggaactcagaaacctctgaagcaacctgacctgaagaggaaattaggaaaaaaaaaaaaaaaaaaaaaaaggaacaaatgtcagtaatatgagaaaaacatgcattatggaaaccaatgggatggggttcacggggtggaaccctcaacaccacactgatggaacagaagagggcagaagtcagcaaaaggggcctgtgatctgaaagtcaccaaaaactttagaaagagaagaaatgccgataaagaggaaaattgatcaattgatcaatatcgatttgccaatgaagcagattctccagaagaaaaatcaacgagagagagaaaatgcacagggcagccgagtcaagaacaaagaaaccacctaaaagttggcgcattgaggaccgcggcgccctcagcctccctgcgcaggtggaaagacaggcgcctccaaacgttatcaaagagccgaacggggccaggcgcagagggtcaggcctggaatcccagcacttttggcacgggtggacagacaggcgcctacaaacattatcaaacagccaaatgaggccgggctcggtggctcatgcctgtaatcccagcactttgggaggccgaggcgggaggatcaccaggtcaggagaccgagactgtcctggctaacacggtgaaaccctgcctctactaaaaatacaaaaaattagcgcaatggttactaaactctctaagtttcagcttctttaccagtaaaatacggtaataattacacctatttcgctaacctgttagaactgagaattcccagtgaataagccaagctttgtgtccaatgcacagtgctcaagaaacactgatgtaagcagtggctcacacctgtaatcccagcacttcgggaggccgaggcgggcggatcacaaggtcaggagatggagaccatcctggctaacaaggtgaaaccccgtctctactaaaaatacaaaaacttagccggcacctgtagtcccagctactagggaggctaggcaggagaatggcgtgaacctgggaggcggagcttgcagtgagctgagatcacgccactgcaccccagcctgggtgacagagcatgactccgtctcaaaaaaaaaaaaaaagtgatgtaaattgttgtattactgatgttgttaaaaagttaatgaggcggccaggcgcggtggttcacgcctgtaatcccagcactttgggaggccgaggtgggtggatcactggaggtcaggagtttgagaccagcctggccaacgtggcgaaaccatgtctctactaaaactacaaaaaattagccaggcatggtggcaggcacctatattcccagctactcaggaggctgaagcaggagaatcgtttgaactcaggaggcggaggcggaggcggaggttgcagtgagctgagatcgtgccactgcactccagcctgggcaacaagagcaaaactcggtctcaaaaaaaaaaaaaaagttaatgaggcagcaataaaaagaaaaaaaaaagatacagccaacagcttggctggatctccagggaattatgctaacgtaacagaataaaagctaatctcagaaggttgcaaactataggattccatttacacaaaatactcaaagtgaaaaattgggctgggcacagtggctcacacatgtaatcacagcactctgggaggctgaggtaagaggatcacttgagctcatgaatacaagatcagcctggagaacacagcaagaccccatctagacaatatttttttattcttcagacacggtctccctctgtccccgaggccagagtgcagtggcgcaatctcagctaactgcaacctccgcctcccaggttcaagtgcttttcgtgtctcagcctcccgagtagctgggatgacaggcacgcaccaccacgcccagctaatttttgtatttttagcagagacggggtttcgccacgttgactaggctggtcttgaactcctggcctcatgtgatccacacaccctggcttcccaaaatgctgggattataggtgtgagccaccgcacccagctgaaatttttctttttttttaaacagagacagggtttctccatgttgcccaggctggtcttgaactcctgggctccggcaattctcccatctcaacctcccaaagtgctggggattaccagtgtgagccgctgacccagccctctacaaaatacatatttttttaattaggtggtcgcagctgctcacaaggctgaggtgggaggatcagttgagcccagaacttcaaggctacagtcagttatgatcacaccactgcactccagtctggacaacagagtgagacctggtccctaaaaaaaaaaaatcgtacagatgaagaacagattggtgattcctgggcttaaagaaggtgcatgtctcaaaactgcacagaactacacacacacacacacacacacacacacacacacacgcacgcgtacacacacgcacgcagacacagacgcagacacgcacacacgcgcagacgcacagacacgcacgcgcagacgcacacacacgtgcgcacacacgcacgcacacgcacagacgcgcacacgcacagacacacacccgcacgcacacacagacacacacacgtgcgtgtaaagccggtggaatctgatcaggatctgtggacggcaccaatgtcggcttcctaggtctgacgcagcaccacgggtgggcgggacggtacccctgggggtggctaggtgagaggagaacactctgccacttcctgtgaatcccgaaagacttcagaataaaaagtggatcaacttcaaggacgagggcccaagagagtaacagaaaattcaccagagagccattcacagggtcaatccccttccgagaagaccaccgccctctattaaacaagtggcaggtgaaaggacacgatctttgtcacctattaaatgagacaggccgtgctgtcaccacgttggccaggctggtctcgaacacctagtcccaggtactcctcttgccttggcctcccaagtgctgggattacaggcctgagccaccgcgcccggtcacaagggacgctttcaatgtgaaaaagcatccagggacccagcaattccactcccagacacgcacccggaggaaatgacccatgcgccaggttctcccggggtttcctcttaaagcagaacgcggaggtgccgttctgtggattttcactctgaccgtgtgtcacacttacaatcgcacggacagagaaagcgacggggaaatgaaaaataggaaagaactttcctttggtccgtcaataagcaatttcctggtgtctcccgtggcctcagagcctgtctgtcttggcagaagataggctgtcactcagagacctgtgcctgagggtttccaaaaatgggaggcggtgggtgggagaaggcgtacgaaaattattcccgttttaaatgtcttccgatccagacaaccagaaaatcttggtttcctattcgttaatctctaatgccttttttgtttcgtttctgttttgagacagggtctggctctgtcacccaggctgcagggcagtggcgcaatctcagctcactgcaacctccgcctcccaggctccagcaatcctcctgcctcagcctcccgagtagctgggaccccaagtgtgcgccaccacgcccagctaatttttgtatttttagtagagatgaggttttgctgtgttacccaggctggtctctaactcctgcgctcaagcgatccttccgccttggtcccccaaagtgctgggattataggcatgaaccactgtgtctggcccttttctgtttgtttgagttggggtctctcagtcacccaggctggagcgcagtggctcaaacatagctcactgcagccttgacctcctggcctcaagcgatcctcctgccttggcctcccaaagtgctgggattaaaggtgtgagccaccttgcccagtacctaactcctctctcgacaccaatttttaaatatttataaatatcgaagaacaggcagacccttcacaggggaaaacttatgtttaattaattttcagggacaccttttattctcacctgggtttctggttctcaaatctaaagtttcctttcaaatgaacttaagaaaagcgaggtgacttaaaagggagctagaacagggcacatgaagaaggggccaaggtggagaatgcggctggggtaccccatcagccatcagcgttggggactcctggcgaagggtggcgtccccgaagccaactaggccccgcctggaaggaagctgcacccactgttccaggaagaagccgaggtttgggaagggatcccacagctccggggctccatcctgctgatgagccccaaactcccctcttcctgggtcctcggagaggagaagcaggaagcggggaaatgagctactgcagctcctgggccctgccgggatccctccgcccctcgcacccatcgactcgctgaacctgacgatggaagagagcaggtgcccatcttgcgggagcttcgggagggccacacctggggccagcgccacagcctgcaggggcctgggggagtggaggcaatgaggagggtgccaccaactcaggccttggagctctgcatcctccaccacccccgggctcaggcgggcgttaactgcatggactgaacggggagggggtcacccctctgtgtccaggagctggggggtcccaggctggagcagccacatcacgtccctcaagggcaaaaaatgcaacatactgggcctcactgggccctccaaagcctccgccctaacgtgtgaggggacaaggcgagaccctcccaacctgcagcattggggcagggccggagcacagggcgagactctgtgggaaccacagaaaatacatctgcaaacattggcaggttcctgctgggaccgggctgggcgtccagggagaggcaacccagagggagcattctcaggtccacacggcctacacaccacagctctggttacccagggaccaatctcacagtggtccgtgccagggctgagggggtgagaggcgacaggggacgagggaagacacctcccaccccaccctccccaccaggccctgctgtaagcccacccagaggcccaggagaatgggggtggacggccttgggagttgcgcttcctcctccaggaagcccccagggcctgaccctctgcctcacacagggaagcattagcatgtccggttcctggggctgtttccggggggctggcagggtggcgtttggggatttccacgcctcagggagcatattccggccagccctgtggccacttcctcacgtagaggggaaggccagtgtgaggcagtgggggcagcaaagcgatgtctctccatgtgggggtgcaagtgcccaagtacagaaccccctttgcccaccactcaaaaccccgacactccagccagggcccacccctgggggattctggagataactgcaggacggcgctttccacccagatcccggaggcaggaaggacacagcttcagaggccccaacccgaggcccccactccccggaaagatgctgatgtccacaaagagacccgtggctctgaagcagcatcgggggcacccgccccaacctcccccaccaaatcctgtcgacagccagcctgggccgcccaaatgcacatcagactagaccctctctccattcacaaccatccagggctccccgctgcccctgcaacgaacacagcgcccctagcccgccccgccggccggtcccaccgcagggcgtccgtacgggctgctctctctgcctggcaaattcctcccctcatgctcccacggccccttcctctcaccctcagggctctgccccgacacgccctctgcggagaccttcactagaggtcccgctttggggcaacctggccctcgctgggtgtgccgtgaagccctgcccatgctccagagtgtgattttcaggccacccccaggaccccacgtctcccctatctgtcccgcccactgctgtgtcatcagcgagggtgacccgctcatccaggtcagcctgggatgtttctgctttgagcactcaaagccgcgggtcccaggaattgcccctcagtcctgggcaaaccacaatggccggtcaccctggtgctgggccctgcatacagcaagcgcctaatacctgcttaaatgaaagtcgtcgaggctcacaaggtgggtgggatccagtgagagccgggatcccgcaccacgccctctccagagcctcagtttcccccttatggattgactggagaaacggatgctcgagatccccacccacacacaggcccagctccaaccctgcgcctaaaaacaagccccacccagcccccagacccaggctccaggcgcgggagggacgaggggacgaggggctcaggggctcgggctcccaaggcaggtcacacgggcaacggcagctgatttcaggggtcttcaggctcgctgcccccgacccggcctgtgtggccctttccccattgtctccctcctttgctgccccagcctccctcgcccgcacactgtcttcaacagacccttgatctcctcactccacgagcgctggcaggaaggcggggtcctacctgaacctccgaactgcgccccggccagggaggcgggccggcccttcccgttggtgacaggcagcgggaacatctgcagggaggggaggggagacgtgagcggggcgggtggcaaaccaaaccctacagtcccgggttcaaacccaagctgggagcagagctggggacacccgggaacctgagactgcgctccatctaggcccggcccgtcctgctccgccccatcacagaccagaagactctgaggactcgcgtgccctcaagtgacgctgcaccctggacacccacgcccagagtgagaaaactccagacgatgaccccgctgtaccgccaggcagagtccctgccgctgaaaactcgctgttccccctgcctttgctctggggggaggggtatcccattaggcgaaggatacaacttatcagctcttgacagtgatacaaagttgtctttacgtttcagctctgaaaagtgagaggtttacactcaacaggtggacatgtggagagtccccggatgcctgagccctggctgactcctcgtttcctgtgtgtgcactggccccgcatggcaggccctggagcagggggtccctggagcggggggtagggcccagtgtccccctaccagggctgggtatgggtttgcttggcaaaaggggaagccgaggctcagacaggcagcaggtcgaggaagacacgggatggagccccgggcccggcaggaagctggaggggctggggagaggctgcaccccacagctgatccagctcctgggtgctaggggtgtgggactgccaccctccctcccgcccggctcacccgtacccagaacactaagtccctaaagattaacgggctcagcggcattaaccggaaaagccaacggcaacaaacccttttgccacagaaaaaaacacaacaagcctccgccctgccccaaggggctgcgttttaaggctcccatcggggcttaagtgatcaaagtggctggaatcagagccaggggctttctgaggagcagccaagatccccaacaccttccccagccagccaggaggcgaaggcacagcgcctgtggccacgatccacaggtccaaaggggacccaggaagcggggttgtcccccactccctggtcctgcagaaggggaaacggaggccgcattctcacctggccctggagaggaagaacggtcttgcgggtaggggtggcacccgcgctgaaggcagtgttcgccctggaccacaccccctcccgcaggctccggtgcacccagcctcccctggacccagacctccaagggccaacctctcatttgggaaacaaaggcctgctgtgggggacagccaactgcatttctatctgctttgtcccctaggacaccagggctgcaccaacgtgccacaggtcacatgggtaccgggctgtgtcctgtgggctctgcaggcctcatgagcagcccagaacagcccccgcaccccttggagcatcagtttcctcttctgagaaatggaccgagggctctggctgtgtgggacgtggtgaaacccaaaagcccatgggagtctcgcacgcggcagggcctggggagctcgcttccaacagcctcggtcctagggactcgctcccccttcattcctgaagcccctgactcaggcccagggactgcctgggacccaggcagggcatgtcagcccaggccagtgctggcgggtccttcgttcccgaccaaagctagcctgggtcagggcaggacaaaggcgcgctgggaacagcctgggttagcgttctccctcgtatttatttggagttccctgttctctcactttatacgcatctggtccagggaagtaagtgcttcccctaggacccagcctcggcaggggcagaaggcaggcatgcaggaacagagtggggatgcgggcagtcacaggggctgcctctgcctccccgtcctggccagggaggtggaactccacctctgggtaaagcccgaggggggacgcccggagaggacgggcacctcgccgctcccagcctgtttcctcatctgggaacggctccgacccgggatggggagacgtgctgagtggcttgaggtgaggagtcaggtcctggggctgaacctgtgccccctccccccaaacgctggtctgttccagcccagcggtctgtgacttgtcagtttaacaaaaaacaacccaactgcacctcgggttactcagccagggaagcaaaaataaaacggggcttaaaaataccagcatggcccttccggagccttggcccctccggcccttgggctgtttttttccgcagggtggccggtgttgtttcagtttggggacttttgtttttgacagacctcagtggcctgtgcctcataggcgggagggttaaattcagactgaaagtgccctcccccaacctgtttcaaccccaaacgctgccactgggcatggggggggggggggagcagaatttaaggacatctgtagacaggccagaagaaacaaaccaaggtccctgggcttctccaggaacccataacacatggccccactgtaccagcaggcaaaccgaggccccgggcctttacagcacccgtcagcggccggtaccccagggggctccggcattccagcctcactgcacctgcctgaactgtgtgacttctgaggaccagcaccctctgagcctccgttcacccaggtggagaatgggccgtacagggacagatccaaccacctaagactctgaagaagccgccccgccctccccaccgggcctgcctgctccgcagtgataaccgtggcagtcacaatggtggcgctgctgtctgctcggtggcccatgaattcccactcaatcccaatccagcctcctcctggcccaagctcggcttctggcagcttaacttcagcacccacgtgtgactaattaaccacacagtcagtttcatgcccgcatcctctgcccaccaggggagtcccgtatggggcaggttgtgtctgccctgttcacggagggtggtccgctcagcactgggcaccccctcctttacttctttgaggaaggatcttactctatcgcccaggaaggagtgcagtggcgcaatcacagctcactgcagcctcaacctccagggctcaagtgattctccttgcctcagcctcccaagtagctgggaccacaggcatctaccaccactcctagctaattttttgagttttgttttgtctttttgagaaatggggcctcactatgtttcctgggctggacttggaactcctggcctcaagcgatcctcccgcctcagcctcccaaagtgctggaatgacaggtgggaaccactgtgcccagcccccctcccatttactgaaacagggtctccagggtctcactgtcaaccagactggagtgcagtgatcttttacttacttttaatttttgtatctacaatgaggtaagcgaccctgatcaggcccattttacagatcagaagatcaaggccgcattttgcttacccagccaagctgggggcccaggaccatgcccctgaggactcagtttccccatctgtaaagcagtaggctgtagaatgctgcgtccgggcaaaagccccatagcacacgtgctgccgtgcgctgtcagcctcctgccagagagcggcccactcccccagccccaccggggcctcccatccaaacagctgaggctccatcgctgaagtattcagcaaacactctcccctgaaaaccttcccgtgaactgtggaggcaaaggggtgtcgggggctgggcgggggtcctggctcaccatgctgaagtccaggaggtcactgagctccttgtctgtgcccacaggcgccatcctctgcggctggttcattctcctggggccagggcgggcacctcaggcctggaaaccctgcttggtggatgtggggacagatggacagggagaaacagggaggggagaagagttgtgagtggtcaaagcacagagtgctaaaagccacctaaaaaaccctcaaccgccctggggtctgagttccagcagagccctgggggcacggggagccctgggagcaggcgcagggaagctggaattccagagtctaggtccctgcagagtcctccccagagaccacagggagtctgaaaaatggggggagggtgtgcaaatataaactccctaactcccccagggaacaccagggcatcaagttgccaagtttaaactgcacgcagggcagccagaacctctcctttctccaactctctcatttccaaccaaccccgggcttcctctgaggccccctacccccgggaaagggaggaacagcccgatcctaccccgccccgagggaaatttggtgattcccccctcccccagcagatggcacagcccgttgaagaccaggtcgcccccaaattcaacatgaaggaaatccacaagtcagaaaaccacgaaactcttttacaagcttcaagacttaaagtgccgggggtgggggggacgcgcatcctatgcagggaccagcaaagctttcctccaccctcaatctccctccccccaagaaaaccccaacagtattcaggaaagaaaaaaaaaacagccctagattgctttactgtcgcgatgtatccgggaattatttttaagcaaaactttgacaacatcccttgcctgccctccatgagcggggagagcgtctcaagaccagggtgctcccgcgtggtcccagggggctccattctaagatgggggatgggggatccacctgccaagacccattccacccccagaaaaaggtacagagaaaaatttccattccaaagaaatgcactccaggcccctccagtctcgactttccccaggggtccccaggtggggacgggggcagcccgggagacacctccgaggctgggggtggggaggagcctccgaggtcgagggagacccaacttcagaagcagagaaatcccctctttgtctgccaactggaggccgggtgtgaagcgggcgccccagcgcagcccctcccccgctcagtttttttcttttttggagggcgtgtgaaactgactttttttgaggactacgaaaccgcacttttttgtggggtagctgaaaccgattttaagacagacttagttgggggggtggcgagctaaaacgggcattctacgggagctggaagacttctggggcgtcccaaggactttgagagacttggagaatgtttgaagccactttgcacggcgccgaaggcggggggcgcgctggaacgcctttttcccggggggaggcggcccgggaagccggacccccctccccccgcagccggtgcaggcggtgcggcccgggagcctttgaagctcgcagcgcggccgccgcctcgccccgcattaacgcggagcagatgttacccgcgcgcccccccccggcccgcccggccccgaccagcgcctgcagcgcgcggcaccttccccgcgcagacaaaaggacgtccctcccgcgcgctccccaccccaaactccggcgcccgggccgggcccccctctacccgagaaagggggcgccccggggtccccgtgcgcccgggctgggggggacggtcctcgcgcctaagttgcacagcccgtccggcgccccccgcgcccccgcccggggctgcttaaagtttcccgaagtgcccggcccgacgggggcgacgcgggcctggcgagctccgggctcctccacgtcgccgcccccccggcgccgcgcgaagttggagaacaatgactcccgggccgcggggcgccccccgacaccgcccccgccccaacttcctccgcgcccccccccaacaagcgcgcgcggggcgggccggggttccctgggcacaaagcacgggggtaccgggcgcgccccccgccccccgccgggctcacctgctgggcgcggccgggcacgcggcgcgt

SEQ ID NO: 2785 - DNA, 19978 bp, Homo sapiens
  source 1..19978: mol_type = genomic DNA
tacctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtggtgagtaactcgcctctatcctgtgcctctttcctcctgggtccttagtggggtggctagggcataggatgagggaacttacctgcccttctaagctcccatagcagtttgggcttagctggacctcagcatttaacacatcctattgtgattgattatatgtttgactcctcaccagacaagatctccgttaattcagtcattcgttcacacattcattcagcgcatactgagccttttctgtgtcaggcccagtgttagcctttggggaacgtgcaaagcatgagacaagtctaatccctgccatcctagagcttatgttctagggaagggggacagacaaaagaaatggttaggtgctcccacctgaaatctcagcattttggaaggctgaggcgggaggggaggatcgcttgagctcaacagttcaaggtcagcctgggcaacatagggagaccccatctctacaaaaaataaaaaaaattaaaaaatagctgggcatggggaagactttctgaagaccaagaggacacatgggagctgaaactcgaaggaagaaaaggagctggcaggaaaggagtgggggacacacattctaggcagcaggaagtgagccttcggaggtcctgcctgctccagctctgtgccccaaggggtctcttggagcacagtctcctgggacctgtctatgagtctgagcttagaggctcagggctgctccttcagacaggaggcagaaggcaggctttgggaactttgggccgcccacgcgccttttctcctcctctgcacctaggattacgttgagcaatacactttcacccccatggtctcttgagaccctggggaaaccctgagaggtgggtgcagtcatgtccaggtgtcaagtgaagaagtcgagggttggaggggctgagtgacccactcagggtgctccaccttttccagagctttgctgaacttagtttttagaacttgaagcctcgtttgttttcgttttgttttttgttgagagaggttctccctctgttgcccaggctggagtgcagtggcacgatcttggctcactgcagcctctgccttgtgggttcaagtgattcccccacctcagcctcccaagtagctggagactgcatgtgcatactaccatgcttggctaatttttgtatttttttgtagagacagggtttcgccatgttgcccaggctggtctcgaactcctgggctcaagtgaaactcttgcgtcggcctcccaaattgctgagattacaggcgtgagccaccgtgcccggccagaactccaagcctctcatctgtgttccataaatgcaatcagacacctcaggtctgggcccaggaaccccagctcttggttcatgtccggacagtccccaggggagttctgggttcaaccagcaagagctcttcctcctggctgatctggtcctcagccttggacagttagtccattaacctgaccccacaggagccccaatcccttggggtctggggaatcttgaactggggtttggggtgcaaatatctgcactgagtcacttaattgcacccagcctcattcctttatctgtaaagtgggctaagaatgctcccctgccttcctcctcggtgtagtacaaggaaggatcccatgacacctgctctcccagtttaaagctctatatgtatgttgtgaaattgacagggatcgctgcacaaacgctaatgcaaagtgggctcctgtgcttccttttctctttcttcttcttttttttttttttaattttcttctagagatgaggtctcactatattgcccagggttggtttcaaactcctagggtcaagcgatcctcccaccttggcctcccaaactgctggtattacaggcgtgagccactctgtctggctcctgtgcttgtgaatgtcaacagcaatcagcccttagctggcagggctgggttggtagggcgagagctcacccaaggctgcttttattaccctgcgtgaatctgcctggccccttccttctaaggaggttgctctgtggttgtcagtctctccctttacagctggatcctgatctttcagtttctaaccctgtgctgactcatcgtgctggaagtgagagcccggggtgaggtcagggaactcccttgcgcgtttcaagaaaagggaaaaggaaagagaggtgaggaggggggcagatgaccagagagacacaggctgagagagactgagacagacccagagagcctcacacattgagtgacagagacggagaaatggagataggcaccaaaaaatggttctcagtgacagaaagggaaaaaagcaaccccccagtctctcttaacatctggtgagaaaccagccatgtgctttggtctgggcccacacagcaaaggattatgtagggtttcatgctggtggatggtcaccttatagcaacaggtatctggggctgtcgggaaaacagacacgaggttgtgggacccagacccacagagatggagctgttctaggagctctggtcctcgttctggtcccctgggatatggcacagtgaaggccaccatcaggcagctggagcccagcagcaactgggaggcagtaaacagggaccgaaagtgcaaggttacctccgaggcaaactactctaagctaccctgtgctgagctcaagtcccttggaactatccctaaggcttccgcttccagagtgtttgagtattttcgttgcacagcttcgaataaatcccacagcaacaggtaaacggctgcaagctgtgactgttttctaagagctcatctcacaatctcaggtcctcttcatttaaacagagatggcaggaaaggcgttattttgagatctgcatggaggaagttcaccaggcagcctcaattcaccagctggaagtttgcgttgtttggaaatttgatgtgtaacacgttctgcatgtgggctgatgtttttgtaaacgggtagcacacacattcagcagggcaccaaagagcgggggctttgcagttaggtccatccttggctctgcagccttgtgtaagacatgacacgactttgaacttctgtttcctcttctgtgcaaagcaatgatgacagtatctacatcacaggactggcatgaggaccaagtgagattgggcaaggtgcccgggcacaccagtctcactgtcactgctgatgggcagagtggttgcctggcagtagcatcctctatcttcagcccaccacctctcttgctggctcactccaactgctctttagagatacacgcttcccctcttttctcctcccactgcctttcagtatggctgcatttccccctgcaagttggtgtgtgctgggtggaggtgggggtgaggacatgtattctctggagaaggccctggtaacgtcaaagcacttctttgctggtggcctggccctgtgacctcatttgtaccattttcttttctaagaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtattgccacactctctttttccatgtcttgctccacatactaagagatgggaaacttgggtactagtttgggcctgtcaccactttgtgggcagaccttaggcaaattttctccatctatagaatggaggacctttgtccatctatagaatgaaggggttggttggattagatcagagatgctaatgcaaggctccttttgctactactgtccatcatgtgtctgaggcagacataactaatccgtgactatactctttgatgatgagcccaggagcagcatctgactctatgctcccttagtgtgcctgaggcagatatcactaatcgatgactgcagtcttctacattgagcttagaagcagcatctgactctgtatgctcccctcccatgcatgaggcagacatcagtaatccatgaccgcattctttcatactgagcccagaagcagcatcttttcttttctttcctctcactctgttgcccaggctagagtgcagtggcacaatcttggcttgccccaacctccaattcccgggttcaagtgattctcgtgcctcagccacctgaatagctgggattacaggcgtgtgccaccatgcccagctgatttttgtatttttggtagagatagggtttcaccatgttggccaggctggtcttgaactcctgacctcaggtgatccgcctgtcttggcttcccaaagtgttgggattataggcatgagccactgcaccaatccaaaagcagcatctttgtgctcccttttcaagaggcatcacagagaggcctgttttggggtttgaatgagaggcgaagaatcagccatggagtgcctctttctcagactccctcttgagaagtggatgcaggggtggagagaaaagaagactaggcatagtggctcatacctgtaatcccaacattttgggaggctgaggcaggaagattgcttgagctcaggagtttgagaccagcctaggcaacatagtgagaccacatctcttaaaaaaaagaaaaagaaaaaaaatgagccaggtgtagtgactcatgcctgtggtccccacttctccggaggcaaaggtgggaggatcttttgaggctgagaaatcgaggctacagtgagccatggtggcaccactgcactccagcctgggagacagagagaccctatctcagtaaaaaaaaaaaataaaaatatggctgggtgtggtggctcacgcctgtaatcccagcactttgggaggccaaggtaggtagatcacatgaggttaggagttcgaaaccagtctggccaacatagtgaaaccctgtctctactgaaaatacaaaaaattagccaagggtggtggtgggcaactgtaatcccagctacttgggaggccgaggcagaagaatcgcttgaactcgggaggcggaggttgcagtgagctgagaacatgccactgcactccagcctgggcaacaagagcgaaactctgtctcaaagaaaataaataaataaaataaaaaaataaaaaaggagggggcatatgggtgaagtatggacaaaatagtggggcaggcacagatgatctggacacaggagcccttggagtttattcttgaatctaactgttcatctttattaaatatttgtggcatacacctcacaacaacatagccaacacacctccttttggagcttttatcaaagtttcccactgttaagattttttcccgctttgtgatgcgggtggggtgggtgctgtaagcaggcttacggggtggcagtttctcacaaaggcattaactggccttgtcctaggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattggtgagcagacaccatccgctgggggtggggagcagctgggagggctcatcagatgatattctccaatgagaatcagaactttgggttttctccccaggcgtctttcccaccatccattctgcccatctcactgcctacgtagaggctcgaacctgtccccatagccatccttgacccagcttttcccgcgctgcacacatactattgacaggtgtgtttcgtggttttttgttttttgtttgtttgtttgttttgagttggaggtttgctcttgctgcccaggctggagtacaatggcgcaatctcagctcaccgcaatctctgcctcctgggttcaagcaattctcctgcctcagcctcctgagtagctgggattacaggcatgcgccaccacacccagctaattttgtatttttagtagacgtggggtttctccatgttggtcaggctggtctcgaactcctgacctcaggtgatccgcttgccttagcctccgaaagtgctgggattacaggcatgagccactgcgttaggcccactgacaagccttgtattggctagccaccaagattgacttgattatccaccttcgggacaactggacagcctgcttatgacttacgccatagtctgtctctactagctctcctgccctgacttgacccagcatacaacagccagagccagccttttcaatataaacctgatcttgctggcactgcttaaaccctgcaggggcctcgcactgctccatggcccagcctgtctacccttaccttctgcccaggctgtgctcatccattctctgcctcccacacacctgccctctgtgggctccagccataccatctctcaactcataagccagttttttcatacaggctccctccatctggactggcttccctgcgtgcagttcactcctgctctacctttggctctgcctccacccatcctcagccgtctccagcattacctccttggagaatcctgccttgacttcccagccacccaaatatcactacttggtctgcattctcgttgcaattgcagtcgcatgagcaattgctgtggttgaggcccgaactgcgcagtgcctgtctgccatgggtctcctgcttcctctaagcacagtgcctgacacacagtgagacctcagcacgtatgggctgaggcaatgaaggaatgaaggatcccatgacccaaaagagcgtgttggaaagtgcaggccagggtcccaggtgctggcggggctggctgctgggtgggggcagagaggcaacccctctgtttttttccctctcagggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtgggtgagtaggtcagaccgtgccaaggccaggctggcactccctcagtccccaggtctgcactgatgacctccataccctggcccccacactcacctttccttggggctcctccgaatcaagtcctttagggacgaattggcgagggctcatgggtgatgcttcagctgtgagccagctttggagctggtaggtggatctcttgaggccaggagttcaagacaacgtggtgaaaccccatctctactaaaaataaaaaagttagccgggcatggtggcacatgcctgtagtcccagctactcgggaggctgaggcaggagaatcacttgaacctgggaggcggaggctgcagtgagtggagatcgcaccactgccctccagcctgggcaacagagtgagtgagactctgtctcaaaaaataaaaaataaaataaaactcccctagtgattccaatgtgcagctaagtttggaaataggtggtatggggtcaagtcctcttgggcctccctcctccagtccttctccctaacctctagccctcaagttgcagagtgatcagccaaaccagtttgcccagaaatgagcagtttcctgggacacaggattttcagagtccagacaaggaaagtcttgggcagaccaggttgagttggtgcccttagctgatctgaccatgttgcccttcttctccaagccctcctgtggttgtccatagctacaagggcctgaccctcaagcccctgcctgtcctggcccctttggctctccagctcattgcatgttctgtcccccacttcaagacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacaggtgggaaagagaccctggagccatggccaccctggggaacagtcaggggtggagtggtcaggtgctggaacacctagcccctccctgccggctgacttcctctctctcttcctcactctatcaccagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgaggtagcccaactttttgtggaagcacagccctttacaatctgctgcgcacccattgacgtcccagtgaggggaggttgcttcatcctgatttgctgagtcagcacaagattgtgggtgtgcatgggacacagcagccaaaatgtggtcatagcttctagaagctcacagtgtggggaggaagacagtaaatggagatccctgggcatatcgcttgtgtgatacccagtacagaaatgtttggatggatggatggatggatggatggatggatggatggatggatggatgaggagagacacattttggttaactctaatacaacatgataagccccagtagcagcatgatccaggctttctctgagagagggtctgaggacgtgactgggatttgccaattaagaatggagaaagaggccaggtgcagtgactcatgcctgtaatcccaacactttgggaggccgaggcgggtggctcacctgaggtcaggagttcgagaccagcctggctaacatggcgaaactccatctattaaaaatacaaaaaagtagctgggtgtggtggcgagtgcctgtaaccccagctaagctactcaggaggctgaggcaagagaatcacttgaacctcagaggtggaggttgcagtgagccaagatcatgccactgcactccagtctgggtgacagagtaagactatgtctcaaaaaaaaaaaaaaaaaatggagaagaaggaagctggacatggtggctcgtgcttataatcctagcactctgggaagctgaggcagatggattgcctgagcccaggagtttgagaccagcctgggcaacatggtgaaaccctgtctttactaaaatacgaaagattagccaggcatggtggtagacacctataatcccagctactagggaggctgagccacaagaatcacttgaacctgggagacagaggttgcagtgagccgagatcgcgccattgcacttcagcctgggcgacagtgtgagactctgtctccagaaaaaacaagaatggatagagtggagccaagaagaggcaggaagaacaaagacacagaggtgcacagagtttgggggaattttgaggaatggtcttgcaaaagagtgggatctgggagaatgagtgggagtggaaagcagatgaatgaagagaaggtgagcgcatcagggtaacagagatgcgttgtgaacaaatgcatgttctaggaagagccctctggagtgctaggtgccagagaggtgggaggaaggatactggaagcagagaaaccagtgaggggcctgatcttgggtggtggggaatgagggacaggggaggccgggatggaagccaggtggtggggaatgagggacaggggaggccgggatggaagccaggtttcagctgagcaggtggcggtggcattgatggagatgaggacatggggaaggacaaagtccaggtgtccttgagggaagacaagaagacaaataatccaggctctctgtcctcacaccagctgcccgcccctttcttcctggcacagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacgtgagactcccacctcccagtcctcaccccacccaacctcacatgcctgataacagggtcacagaagagacggggaacagaggagagggttccctcgggagagacactggccctgcttctgcttctacctgctcagctcctttcttgcccacggtgttatggaaacagggagccataggccagcattgtcactgagagagcaggctttggaggcagagccccccagttggaatcccaactctaaccagctaggttccaggtaggcacccacaattcaccgaggagaacagttgtgccccttccctgcagggccagtgtgaagagtccaggagttagtacacatagagatagtggcatgtgctttttatatgtgcaaggtccagcacatagcaagcgctcaacacagcgttgctttcatcagagtaagaactgttttttgtttgtttgtttgtttgtttttaagagacagggtctcaatcttatcacccaggctggagtgtaattgtgcaatcacgtctcactgcagtctcgaactctggggatgaagcaaccctactgtcctgcctcagcctcccaaatagctgagactataggcacgtgccacacaaccctgggtaattttttttttttttttttttgagatagggtctctgtctgttgcccaggctggtctcaaattcctggcctcaaaccatcctcacacctgaggcgctcaaaatattgggattataggtgcgagccatcatgctcagccagaataataactggttttttttgtttttttttttgagacagagtctcactctattacccaggctctggaggcccaactcgtgtttgtgtatttgtttatttttatttatttatttatttcgagacagagcctctctctttcacctaggctggagtgcagtggcgcaatctcggctcactgcaacctccgtctcctgggttcaagtgattgtcctgcctcagcctcctgagtagctggcgctacaggcgcgtgccaccatgcccagctaatttttgtatttttagtagagacagggttttactatgttggccagctggtttctaactcctgaactcgggtgatctgcctgcctcggcctcccaaagtgctgggattacaggcatgggcctccgtgcccggccatgtatttatttaggcaaggtctctctctgttatccaggctgaagtgcagtggcacattcatagctcactgcagcctcaaattatccaagtaacagggactacaggcatgcaccaccacacccatctacttttttttgagatggagtctccctctgtcgcccagactgggttgcagtggcacaatttcagctcatggcagcatctacctcccaggttcaagcgattctccttcctcagtctcccgagtagctgggactatgggcatgcaccaccatacctggctaatgtttatattttgagtagagatggaattttgccattttggccaggctggtcttgagctcttgacctcaagtgatatgtctgcctcagcctcccaaagtgccgggattacaggcatgagccactatgcctggcccagaataagaacttttattttatttgagacagggtcttactctgtcacctaggctagagtgcagtggcacaatcacagctcactgtagcctcaatcttccgggctctgatcctcccaccttagcctcccaggtagctgggaacaacaggcatgcgccaccacgcttggcaaatatttttttaaaattttttgtagacatgggattgcttcatgttgcccagactggtctcaaactcctggactcaagcgatctacccaccttggcctcccaaagtgctgagataacaggcgtgagccgccgtggctggccagaataagaacttttattatgaaataagtttggccctatcctgttattaattacctcaaagaggttggacaatgtccttacacttgcttctcaccctgagcttagaatagtttgagaatgagcatgtctggactgttgtttgacaggtcctgtccatgatgaaataagatgaatgtaattctcatgttatcagtggggagtccagcccagagaagttgaatgccttccaccaggtcacgcacaccacagacttctcccctagaatcatgggcctatctctgtccccagtgggagttcctggaaaacagcatcctgcatccagggagggcccacagttggttccttcgggtcctctaggctagagaatctcagaccggagaaatgcaaagactcctctgaagtacaaacattctcccagaccccaggttaagttatttcttctataatatcacttagatgtgtactgataattttattaaatataaagtctttggccagagctggtggctcactcctgtaattccagtgatttgggaggctgaggcaggaggatcacttgagcctaggagtttgagaccagcctgggcaacatagtgagactgccatctcttcaaaaaaatttttttaattagctgggcatgatggtgtgcacctataatcctagctacccagaaggctgaggtgggaggactgcttgagcccaggagttcaaggcggcagcaagctatgatgacgtcactgtcctgtagcctggatgacaaaactttttttttttttttaaaagacaaagggctgagtgtgatggctaacacctgtaatcccagcactttgggaggccaaggtgggcagattacttgaggccaggagttcaaaaccagccgggccaacgtggcgaaagcccgtctctaccacacacaaaaaaagtcctttctctttctagctctagacagctataaatccccaacaactttataaattaaatagaaaagtataaaaaccaataccattcaaataaggatgctctgcggaggtgctggcctgcactttagcacctccctgtattcaagctgcagtgaagcctgggcactcctggcctggctcagccacttcattcactatgagggccacctccgtttccttcctgtggcctatggcacataacgcaatgctgctgggcaccagcgcagtcactgatggccacgcataggctgagtgcccttgggagggctcagacccacagactgagattacccagaaccagctggtattcatgtttgaatattgtcatcaaaatgaaagacaattagaatttaacgtttttattcagagctcggggatctctgggaagacactgtggactccagtctgagaaatggttctcttgttagtgtgcatggatgcctcaactgggttcaggcatgaagactatgtttgaggcccctgaatgcacagcagagaaagctcaactgcagacacagatagacagatgtggagagaggtagccctgtgcagccacatggccctgcagagttaaggaatgggaaaagggctactctgtgacattccttagaacagtagtttcccttcgctaaagtcaccccaaatagggtggtggttgttgttgttgttttgagacggagttgcattcagtcgcccaggctggagtgcagtggcacgatctcggctcactgcaacctccacctcctgggttcaagcgattctcctgcctcagcctcctgagcagctgggattacaggggcccaccatcacacctggctagtttttgtatttttagtagaaatagggtttcaccatgtgagccaggctggtgtcaaactcccaacctcaggtgatccacccacctccgcctcctcaagtgctgggattacagatgtgacccaccgcgccccacctgtgtttcttaaaaccaaaaaaatccctctaagactgcaaccatcgataacttagggctgtattaccccagagagcactttgtagaagatgcgtttgttcacatcacttccctgttactttgacggtctcacctccttttcagtcatttgcattctcccagaacctgctcatttgttgttttttgtttgtttgcttggttttgtttttgagaagcagtcttgctctgttacccaggctggagtgcagtggtgcgacctcaggtcactgcaacctccgcctactaggttcaagtgattctcctgcctcagtctcctgaatagctgggattacaggtgtgcaccaccatgcccagcctaatttttgtattattagtagagatggggtttcaccatgttgtccaggctggtcatgaactcctgacctcaagtgatccacccgctttggcctcccaaagtgctgggattacaagcatgagccacagtgcctggcctgaccctgctcttttgaaagaccattcccccaaattctgtgcacctgtgtgcctttcttctctctgcctcctctcagctctgccccgctctcctcccttctcctctggcaaatcccactcatctcttgaagcccttcttccaggggaagccctgatcatgctgctttctcctgtgggagggatgaaggacgtggcccacggagtttgttttgttttgttttgagatggagttttgctcatgttgcccaggctggggtacaatggtacgatctcagctcactgcaacctctacgtcccgggttcaagcggttctcctgccttagcctccccagtagctgggattactggcatgaaccaccacacctggctaattttgtgtttttagtagagatggggtttcttcatgttggtcaggctggtctcgaactcccaacctcaggtgatctgcctgccttggcctcccaaagtactgggattacagggttgagccactgtgcctggcccaggcccacggagttttaagaggcttcctgtggcagtggcatccagacggagtgcagaaactcaaagttgaaggccagaagctcagggaagggggagtgtgagttgaggagtctcttggctgccagggccagaaaccgaactccaagcctctccacaacagcgggtgtagagcatgtagaatcagagaggaggctgagccatgcagccccgagaagaggggaatgccactgagccacagagacccagtgccactgccaggtgtctctgcctccacttcccatgaccctgcctgtctctgtatgcaggcttcaccctctctcgttgtacattgtacacattctaggtgacaccagcagcttctgattctcatcccccataacatcagccccccagagaggggacaactgctgagctgataacataatagatgcccctttcctggaggccatggtcatggtcagcgtggagaggatgaagcctgagcaggcaggatcgggggtctggaggggaaggaggtggaagttgagatcacagacctgtggccaggtggcctgggaagggtttgacgagtgtcggcccaaagagcttggaagggattttgctgctgtgggtgagcactgcctctccccttagggacaacagccacctcttctctccccatttgcctttcccttctgtagatatgaaacacaggcctccttgtcaggcccctacttaacctccgtgatggggaaagcggccggagaaagggagttctggcagcttctccgagaccccaacaccccactgttgcaaggtgagtcatggcctgacactctggatgtgtcccctaccccaagcttactcagccaagaggcttcatcaactcaccccagctttccctagcaccctcctgggccacaccttcacaaaatcactgatgctcaaagttggatataatatattgaactgaagccttagaatttttatgcaagttactgtggaaattctaggaaaccagacagattacaaaaaaaaaaaaaaactagaagaaaattaacatcacctaggatatactacctaggaataacgtcttttattttgagatggagtttcgctcttgttgcccaggctggagtgcagcggtatgatctcggctcgctgcaacctccgcctcctgggttcatgtgattcttccacctcagccttcctagagcccaagtggtctgcctgcctctgcctcccaaagttctgggattacaggcatgagccaccgcacccagccaaaattacttaacttttcttctagatactttttaaaaatatggcagtaagtttttcataaaaaatggagccatgctatccagtggaaatttaatgttgcccacatgtataacttaaaaatttcatatatgtgtatacatatatatgaaatatatatatatacagacacacatatatatgtatacatatatatacacacatatatatgtatatatatatacacacatatatatgtatacatatatacacacatacacatatatacacacacatacacacacatatacacacacatacatacacatacatacacacatatatacacacatatatacacacatatatatgtatacatatatatacacacatatatatgtatacatatatacacacacacatatgtatacatatatacacacacatatatatgtatacatatatacacacatatatatgtatacatatatacacacatatatatgtatacatatatacacacacacacacacacatatatatatatatatatattttttttttttgagatggagtcttgctctgttgcccaggccggagtacaatggcgaggtctcagctcactgcagcctctgccttctgagctcaagcaattctcctgcctcagcctcccaagtagctgggattacaggtgtgtgccaccatgcccagttatttttgtatttttagtagagacggggtttcaccatgttggccaggctggtctcaaactcctgacctcaagtgatctgcctgcctcagcctcccaaagtgctgggattacaggcgtgagccaccacgcctggcctgcaaacagacccttaaaagtcatctgttcctactcttgttatttaagttgctttgatactccacccctgaagaacttttatggggcacttaccatgtgtcaagcattgtggcgagtgcttatagagaaggtgggactttctgagggagcccacaaaaaagcattcttttcttgccctcattctgaataaattgaggaataaaaaataggagctacagatggagaccccaagtctggccagttctattactgataaagacaggagggtgagagctaggtggacccagccaggaagcagacctgggcagttgtagcctctatctccttccccctctgcccttgagtctagaaggaagcccgctcccaggagaaaaatagcgcccaggctacacatgcctagtttattcttcccaaatcaaccagttgcataaatcactcctctatcttccttggggtggaaagtggatgggagttataatttgagttctcttttgtcttagtccattgaagctgctattacaaaataccataaactgggtggcttataaacagcagaaatgaggccgggtgcggtggctcatgcctataattccagcactttgggaggccaaggcaggtggatcacctgagatcagtagttcaagactagcctgaccaacatggtgaaaccctgtctctactaaaaatacaaaaaattagctgggggtggtggcgggcacctgtaatcccagctactcaggaggctgaggcaggagaatcgcttgaacccaggaggcggaggttgccgtgagctgagatcacgccattgcatttcagcctgggcaacaagagtgaaactccatctcaaaatgaaataaaataacagaaatgtatttcttaacagttctggaggttgggtgggcagtcccagatcaggacactgacagattcagtgtctgatgggggcccactttctggtgttacctgctggctgtgttctcacatggtggaaggaacatggcaactttctggggccttgttttttaatttaaaaaaaaaaaatattttcctggcccttgcctgctgaaggaacctcttttataatggtacttaaaaatttttttttttgagatgggggtctcactctgtcacccacgctgagtgcagtatcacaatctcagctcactgcaacctctgcctccctggcttaagcgatcctcccacctcagcctcctgagtacgtgtgaccataggcccatggcacaaagcccagctaattttttgtatttttagtagaaatgtggtttcaccatgttgcataggctggtctcgaacttctgaactcaagtgatctgcctgccttggcctcccaaagtgctgggattctaggtatgagccaccctgctcggcctataatggcactttcctatcccattgatgaggctctactctcatgacctaatcatctcccaaaggccctaaggcctcctgataccatcacctttggggttaggttttaacatatacattttggggggacacagacattttagaccatagcacctccattgaaaggaaacatttctgacacctggctatctcaaagggccctttcagttcccctgcaggctgcattcccacatcaccaacaagagcagcgacactcactcagaggttaaataacttgtccagagtcacagcagtaatgaatgacagagctggggcttgaatccaggcgtcctcctagagcctggattctgtgtagtgagtgaaagctgactcctgggagacttctgcgtggtcctggttctctctccagactgcactgcgcaagtttctcttcctgatggtccctagggtattacaaagacagtggccctgcctgtcaggtgtttttattaccagatgaggtcatggcctcaggaaccctgtgggaagctgagttcagagtctttgagcaggctttagggaggttccagcttcccaccaccaagccccaggtggattcttacagactctagcctcagggtggggggtctggaagatgaggttgcggggtgcgatattctgcccaattcgcccctccttgctcaatctgtttctgcaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgc

SEQ ID NO: 2786 - DNA, 19978 bp, Homo sapiens; identical to SEQ ID NO: 2785
  source 1..19978: mol_type = genomic DNA

SEQ ID NO: 2787 - DNA, 121026 bp, Homo sapiens
  source 1..121026: mol_type = genomic DNA
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggtaaggtttggctttattttttttaatttagtattttaaaaaacagagttagtgatttctgggtgctctccccaaatctcatcagtgctgatgaacaaggggtggctgtagcaaaggcaccatttctctgtgagtctccagtcaatatgtgtggaaggattgaaatgcaaaggctctgtggcatgaactgattttgctagtttgtcttctgggtgattggcccctgtgttagaaactctttgaggaccgattaaatcatcttatttgaagagatccccttactatcatgcattattttcctgctcctcattctggagtgtttttcttattgattttttttttaaagaacaaaccggttttacctgctttaaagaaaatcttcagtaaaaaatgaaattcatgctgagaaatacaggggcccaattaaggcagtgtatagattgtcactgttaaaagggaacaaagatgcttttctgtaaaaagattttatatctacatcctattttaagcaaagcaatgaaattgtaggcttttttttttttcttgtagttagggtcagggagattggggctattagaatttttgttttattttaaaaaatgtttgccatgtagtaattcataaagggtttactggcccaatgaaacaaaaatttaggcagttaccaaaatctttaacacaggagagtatatgaagcctgttgtagagtgaaggagtggttggccagtgtgttgggttcagcgtgtttattgcttagatactccagatagtggtgtgcctctgtagctcactcagcctatgtgacataggtagaaggcagtatccaaacctgaactacatatcacaaatacatttatcattgccatcagtctctccccttcggtttgaaaacattctaattttaataacgaaaatcgaattgatattggagatgaatttgggaaaattcactaaacttcatggatatagggcatattaatataatttgattcgagtatacataagtatctgctatattttctaggtgtttgaactattttattaaatattcaaaaaacaaatccaatgaaataactgagttgaatacagtttgttttatagctctcaacaaccaatattttgagaatttaataatattctttaagaatgtgtaacacaagttgctaaaaattaaaagattttaggtggcttcagtatttatgtggaaattgtttaaataatgttgacttctccaataatatgtacttcaaataattatcatgattccatttttgatttttttttttctgagtgccattatttaccagtgacatgaaatctggaacttactctataccagggattatagtgatgtgaagcccaggtgtctatagtttctctgaggtactttgtaggttaatacacacacaactgttttcattcactttttttactcctaaagcaactgtgttatagcactttgcaatacaggcttagaagaattgtcataaaatcaaacaaaaaggtatgtagccaaaatacttgttccatgtctagacctcagatccctggaaaaaacagcactgcctttaaaaggcagaggaccaaggagaggaagtaggttcatgttcttgttaggaagggtgacactagcaaggttagtttctgaggtaggtctgttgtcttgatcgtagcttgcattcctagtctaagcctccatgagcatgactgctcaaggcttgataattgcaacaagaatccagctagataatgtccacagccataggagcccgttcctctagtcaaactcctggtagactaaagcagtggagcaaggggcttatggcttaaaggtttatctctctagtccagtgggttgtttcttgtttcttttttctgaacccacagactgaaaaaaaaaaaaagccacttttttttagtgaaggtggctctggatgacagagttgtttacccataagagggctggaggggatgtgtagctctcagaagctccttacaaatactcctagattctgttgctttccttttctgaattgagaatcattgctaacttcagctttcaaacaggttctattatattagcttttccctactcttcctcataaaaccaggctgttctctttaaaaagttgtatatgtagaaaactaacaaaaaaatcactgtgatttatcatagtatcttctacgtgatcaacaatgatctaataggaagtctctagtctcatgctttcatacctctttactgtgtcacttgacttttttttttttttttttgagatggagtctcgctctgtcacccagactagaatgtagtagagtgatctcagatcactgcaacctccgcctcccaggttcacgtgattctgtgcctcagcctctcgagtagctgggactacaggcgtgcgccaccatgcctggctaatttgttgtatttttagtagagacggggtttcaccatgttggccaggctggtctcgaactcctgaccccaagtgatccgcccgcctcggcctcccaaagtgctgggattacaggcatgagccaccacgcccgcccttgtcacttgacattttaaataacaactggattcagagatagcagacatcttgtctggggtggcagaggaaacagttgtaaggtcagggaagtgctcccagatgaaacccccttgttagggctggtctcagaaggctagtgtcaagtctgagtaatcaagggtggaggtctgaaagctgggatcggagacaccctttggaattattctcagagggaggagcttgcttttttcacagatgctcccttccaagcattgtctttattgtttgttaggtctcagcatttccctttcagccctgccctgggagagcttcctggaagagtctagttcttccaaggcgtctctccaggagggaaggagtcttctaagttcatctcaaaagactatgtgatgttctctggggaatttaggtgggtgggctctaaattcttctgaaattatcagtttgcctcctgagcctctatctccccaaaggatatctgtgtgattgtatcacctgcttattctctgtagatggcttactggtgagctcacagaatcaggatttaaatagattgttctaggctggaagggtggaaaaccaaaacaaaaagataccatttcaaaataggtaaatgtctggttctgtgtttgggttcaagaaataagttatgtatatttaatgtgggagagacctggtttgttgaaagttcttgtgaatgacacctaggttttggggatacacaaaagtcatggaagacaacataggctctgcttgctaaaaaggtactgcataagctgtcatatgttgtattagcagaaatatgaagtccaaatcagaaatggtaatcacttcactgaaatctactgctaagagcacatccatgaagcactgaagacctgagaaatttaacagcgaacatagcaggcaaactgaaggaggaaacatggattacaaagtcaaagcccaacttggataaccataagcaagttatttaatttctctaagccacatttttctcatcttttatggatgaaatacccattttccagggttgtgatgagaatcaaatgtgataatgcctgtgaaatgcttagccagtgagaactctcttaataaatgaagcttggggcctggtgctgtggctcacacctgtaatacagcactttgggaggcccaggcaggtggatcatgaggtcaagagatcaagaccatcctagccaacatggtgaaaccccatctctactaaaatacaaaaattagcaaggtgtggtggtgtgtgcccgtagtcctagctactcgggaggcttagacaggaggatcgcttaaacccaggaggcagaggttgcagtgagctgagatcacgccattgtactccagcctggtgacagagtgagactccgtctcaataaaataaaataaaataaaataaataatgaagctagtataatcaaaagagaagtgttgctatgagaaccactgtgctagtcaagactgatctaatctgccccaggatgtaggagaaccacttaatattcatagatgctgtctctttctacaaaacctcagtataatcctgtctctcaaactttgtgctggccaattccaactgaataaacccaaacactttgccaactacccatctaccctcccctcacttatccatttatccctgtttgtatcttgtctgcttcaaccaggcccatctccacaatctacacattctttcctcttggctcttgttcatgctgttccatccatttagaaatggcatctttcatctctactctgcaaacacaattcaactcaatttgcccaggccaactcttcctcctgatgttcttcccctaagtttaggctcctttaccatgcagattgtgtctttgagctttgggcagccagatttagcccaattagcctctaaatctctcacaacagatattatttcttttctattctcattagtacatgtatttaatgtttagtaatttctgttgaatggagttttatggtcacagtaagaaaatgttggtacttcacagcggagctgaaaggaaaagagaacattgtagaaaggatctcagtaacatcgaaataataatattacattgggccaggcacgttggctgatgcctgtaatcccagcactttgggaggccaaggtgggcagatcacgagatcaggagtccgagaccagcctgaccaacatggtgaaaccttgcctctactaaaaatacaaaagttagctgggcatggtggcatgtgcctgtaatcccagctactcggaaggttgaggcaggaaaatctcttaaaccagggaggcagaggttgcagtgagccgagattatgccactgcactcgagcctgcatgacagagtgagactccgtctcaaaaaaaaataaaaaaaaatttaatattaggttggtgaaaagtagtggtaaaaactgcagttacttttgcaccaatctgataatcaattttatatatcttgtaaatgatattcactctcatcttaaaagtttagcttatattaaatgtttgatgtaaataaagttgaaagaaagtttcttctgttaggtgtgaaacataaaagatatactcataaaagtggttctaaccagggccttacttaagatgaggtattgtatgattgttgaatattacctataacatagtcgtattttctattcaatagatatttattgagttactgtgtgccaatcattcattcattcattcactcatctatcctttcaataaacaaagacttattgagggtttcctttgagccatgtactgtcctggaaactaggaatataaataaggataaataattttttccctttgctaagctcacattttagtgggaaaaatgaatataggcggatgaattgtaaaatgttgtgataaatgatttaatagagatattacagcaaataaaggtatttacaaaatctgagcttttcaagggctgtaaaagtttttattgggtccaatgatacaaaatgaaatagcaatatctgaattgagcataaaggtctggtgcagtggctcacacctgtaatcctagcattttgggagactgaggcagacaaatcgcttgagcccaggagtttcagatcagcctgggcaacgtggcaaaaccccatctctacaaaaaatacaaaaattagcctggcatggtggcacgtgcatgtagtcccagctactcgggtggctgaagtgggaggattgctggagcctgggaggtcaaggctgcagtgagccatgatcataccactgccctccagcctaggcaacagagcgagacattgtctcaaaaaaaacaacaaacaaacaaacgaaactaaattgaacataaatatttaattaaatgtctaaaaacgtggaatgtcaactaaagaaaatgagtagtattttgaaaacaacttgtaggttgatttttctgtctttgcaagaactcctaaatagttgtgaatattgccaaaagtcaggtccagttatagttataacttgctcatagccaaatgattttgaaaccaagatgaaaaggaaaagggaagaaaggacatagagggagcaacctatacaaagggggtgtgtataaaatagcagggcaggcttaaggaagctgagtgaagctgtaatgtaggatgaaggtagagaattaaagttggggtcagatcaagaagggcctcacaggccattttaagtaggttgtccctcattctgtacatgttgaaatttagcagagtgtttgttctatcatgtcatatatcagatttatgtcttgaaaaattcactctaataatagttttcaggatggattaacatggtagagaccataggctgggaccaagttggcttcctaacattccaggcaagaggactgtgaggataacagggggcttgagagagatttaggaggtgaaactgcaggagttagtgattggttgtatatggaaggttgagagggagggaggagaataagtcattgctccagcattctgatttggataatggtggtgccattcagtgtgctgaatggaggtgggctgggataaggcaaataattattttgttcatgttgattttgaggctacatgtaaaggaagtttttttttttgagactgagtcttgctgtgtcgcccaggctggagtgcagtggcacgatcttggctcgctgcaagctccacctccccggttcaagtgattctcccacctcagcctcctgaataactgggattataggcacctgccaccacacccggctaatttttgtacttttagtagagacggggcttcaccacgttggccatgtcttgaactcctgacctcatgatccacctgccttggcctcccaaagtgctgggattacaggcgtgagccaccgcacctggccataaaggaagatatttatcaaaatttggctgcccacatctgaagctcagaggaaggggattgggcaagagattgagatgtagaaatctttggtatatggtaagtgaagccacgggcatggctatatttcaagattgaaatgaaggaacgagaaagagcagatacccaaaaatttgatgaagaagaaacaggtaaggagctgacaggagaagcaaaaccaatgacattcctatcctgggactttagagaattgctgctgtagcagccatggaaagaaattttttttttttttttttttgagtcggagtctcgctcagtcccccaggctggagtgcagtggtgcgatctcggctcactgcaagctccgcttcccaggttcacaccattctcctgcctcagcctcccgagtagctgggactacaggcgcctgccaccacgcccagctaatttttttttttaatttttagtagagacgtggtttcactgtgttagccaggatggtctcgatctcctgacctagtgatccgcctgcctcggcctcccaaaatgctgggattacaggcgtgagccactgcgcccggccggaaagagaattttaagaagacagtaagatggggcagcagagtaacagcctccgggcctgacactggagcaccagcctgcaggtgtgttattttacagagagccagctgcaccggcagcatcaccaaaccagagctggaagagagcagctggcttcactcctggctttcaggaaagggaatgtctaaagttgcctcccttatttttggaattttgaactgataaccctattcttacccatctggccagacgattccttaactcgtgttacacctgcagaatgagttttagatctagctgtgacctcttcccccagccccacccccattgtccccttgtgtgccttcaggaatctgatcattcttctctcctgctccttcccaaaggctgcaggagcaggtgtgaagacgtggatgtgccagatgcagagtcctgacacttttcaacacatctgcatattagaggaagtacatacccattgcttggtggtttcatgtctaatgtggtatgagtgtgacaaagagagggagaaaatttggactagccaaagaagccagtcaggcgtggggtttgaagggcatcgtgggcggctgtcatttgctctctgcttgtcacagccccttgcccagggcttgaccagtgaggtgtatgtgctggtcacacccatctcagcagatctgtcagctttcccgcttttgttaaagggtgatatcatgcttcctggggggagcactggaagacaatgctcggccactttcctccagatacaataggcggagtcaggaaggcagtattgacattgctggggctggggaggcactcactgctctgcggccgtcagatggtgaaccagcttaaccttggcacacagggcctgggttgtgcaaggcgtctggctgcagagccaaaggggactccaccctggggacaggagtgctttagacatctgggaatctgggatgggcttcaaattctgatccctgtgtcagaaacaaccacaaaacaataagagtaccagtaataacaaaaatgactaccctaggttgaatgcctttatgtgccaagtgttaaatatgatttttaatatttcacaactttacactataggtattattatttttttaatagacagggaaaccaaggctcacaaaggttaagtgacatgtccaaggttaaaatgtaagtgaccagccaggtgtggtggctcgtgcttgtaatcccagcactttgggaggccaaagcaagcagattgcttgagccaaggagttcgagaccatcctgggcaatatagggagacccatctctacaaataatacaaatattggctgggtatggtggcacacacctgtggtcccagcaacccgggaggctgagatagatggatcgctttagcctgggggttttaggctgcatgaatgtcgtgatcatgccgctgcattccagcctgagtgacatagtgagacctcatcttaacaacaacaaaccggaaaatggcggccatccattattttggatgcctaacatttcaaactttcaagaactgccgtgctttccctctaggtgattctgatgggtctgccaatcactggtcacagaatgtcccagccaactaacaacagcagttggttcaaacagaagatgcacaacccaacagggccagttagactctttccctgggaatttatgagcactttgaaagcaaaagcctctctttcttcatagaggacactgtatccctggagctaccaacttcgctgaccacttgaaggaagctagtctttagtacgagagaatgaggccaataacaaaagatggaccaagacaggcactctgatagcatttgagacgtgggtccaaggattttcaaacacgcagccctgcctctttcagttctgtgagctagtttcttttatttgtttaagctattttgagttagcttctatcccttggaagtgaatcatcctgactgaccacatgtctcagtaggaaatgatggagacaagagttacactgaaaaatgacctgaacccgaatcctgggctctttaaaacacctcactgtgctgccttcgaactagtgtttcatggtcacctcaggttagttcctagaaaatgaaggtaacagcatttcttcatgtggttttggggaagaccttttaaaaaaaataacttaaaaatacttagaacagtgccggctcatagttagcactcgataaaaatcagatgttattaagatttggttataaatgaaactggtgtctcatatgttaccttatgttactcctttcaaagcacatttttatccacgagggcaggcaacccacattccatgcagatgaggctccctggcttcccttggtgtcctaagtctggccttatagtggggacaaggtgagagaggcttacacctgtgggttcttgggcttctgctaaaaatgtggagagtcgggtggagagtcgggtggggagattcctctctgttgctcaacgagctggcaacattgggctcccaacctttttcctgccagcccccagtttcctctcatttctgggtcgtgactgatcacgggctctaggatgatctgtcatttgaaggttcccacctcatttatcccaaacctattgattcctatttcttgacaatttttttacttctagtggaatctgcctcacttgtgactaagcttgttgcatttttggacccatcctggtgtctgtgtgcacatgcgtgtgtgtgtgtgcatgtgggtgtggatgcacacgtgtgagagaaagaaatagctctccccccatttcagcacatatttgctctaattccaccttcctttagtctccattctactttgtgtccaataccccttgcatctggaaaggatgttctaatcttctggggttgatttaaacatccatctattttattaatcattgctaccacttcagaatcgaagaagacggtggtggcagtggtgattgcttgtggtcagcagcttttcaggagacagtctttgcctgcctcaccagcctctcgtggttctcagtcccacatactatgatggaagtgtactcaagtcataccagactctttgcagtttccaaacattcatgttcaagcatttatgcctttgtgtatgctggtttctctttctagcatgcccttgtcacctcttcttcacctgctttacttatttatgattagaggtttagctcaggtgttatatcttctaagaagtcttctttaacctcctcgcatggattagggccctgccttagcctgaggcgaaaacatggcctgaaggccaaggcatatgtgcaggtggattatgtgggataatgatcccaggaagcaagagtgagggactagtggaatgaaactctacaaggatgcattgtcaagctggctgcagcgacagaagcctggtgctccagactttctgaggagccttatgaaatgagacttagaacttcatccgcaaatgaaaaggggaggcattcatctattgctattccctttgttcaagggttatgtagacctaagaacctagcaggttaccataggtgaggaagtaagatatactcgactgggctctaggtgagctactttgagactgcacctgctcaaggatcagaagtggcccttgcaggagcagccagggcaaaagctgggatgaggagggtttgcactggtgcctaagaggtttcagatacaggcaccttggtacttgcctttgtcataatacttagaaaatttaattacaatgtacagtttactggttggttttgcccgctggactatgagctgtgtttggcatttcagtatttccagtacctgacttgatgtactagctgacgaagaaatgctttaataaatagctttgctggctgggtgctgtggctcacgcctgtaatcccagcactttgggaggctgaggccagcgaatcacctgaggtcaggagttcaagaccagcctgaccaacatggcgaaaccccgcctctactaaaaatacaaaaaaaaaattagccaggcgtggtggtgcacacttgtagtcccagctacttgggaggctgaggcagaagaatcacttaacccgggaggcagaggttgcagtgagctgagatcgtgccattgcacttcagcctgggcgacaagagtgaaactctgtctcaaaataaataaataaaaaaaatagctttgctttgtattaaatgttctgagttagggttaccttaagtgtgttgtatatattactgctggcctgcaagatgatttgtatatatatttcataaataaattttttttttattttataaatatattttataaatttatatacatattttatttgtatacatatgtatttttatatgtataaatatattttccatattatatgcaatatgcaaaattatttacatatataaacatttatttgcatctgtttatagatatatgtatatatgtgtgcatatgtatcatatcagtcatgtgatttcatgattagtcctcgttaatatgaggataagaaaaaaagttaatttaaatataatgattgatagaaaaattgcacaggtgatatgtagactcagtaagaatcacaaaagtgatccatgaatgaatgcaatttgagagacactgctataaccagatgagttagccactcgaatcctgtcctttttagaactgtgtatgtgcatgtgtatccaaagaaataacaaaagcattttgggcgtgtaattaatgctatcctagtgacataaacaaagtgaaacagagtttcacagtgatcgacctgtctcaaagcaccgtcacggattctaattttgtttctcccaggaaacctggaaagtgggtatttgttaataaaattatagacaagaccttgggcacagtgggcttcctcacaaaaggcccagctaacgagcaggcaatgcccgtcagtagagaaatggttggtcagttctactcatccattccagctagcatctactgaaccctttttatgtactaggaatctgctaggcattggagttccaaagatagttaagagagggacttgaactcaagcagttgcagtctggtgggtgagaaaccctgccctaataaaggcagatggaaacatggaaactggagtgagcaattctgagagaaaacagggatctcaccaggagggtgacatttgagaagggagaacaggattatggaagatcaggagtggaagtgaggaggaggggcattctaggcagaggggaaagcatgaaaatttgggataaaatgtttaagagacttttatgcagtggtttttgcggctacacaatgggttcattgaagaaggtggcagggattaaaagtgggaagatgggttggagaaaaggtaatttggtttgagattggccaagtgggcagggacagagacacttataagagcctttagggtataggatgaagcggtgtgaggtagtgagacgtgtctggagataagaggaggacagcaggtaggtctgggaacctacatcgagaggtaatacgggtagagaaagaggagactgatgatcctgaaaggatgtgccaaggaaggaggagcttcaactatatcaaaaattggaggaaagaggccgggcacagtggctcacgcctgtaatctcagcactttgggaggccacggcagctagatcacgaggtcaggagatcgagaccatcctggctaatacagtgaaaccctgtctctactaaaaatacaaaaaattagccaggcgtggtggcatatgcctgtagtcccagctacctgggaggctgaggcaggagaatcgcttcaacctgggaggcagaggttgcagtgagccgagatggcgccactgcactccagcctgggtgacagagcgagactctgtctcaaaaaaaaaaaaaaaaaaaaaaaaaactggaggaaagagcaggctaggaagagagactagagaattagcagctgggtgctgttgcgaagcatttttagtgaatgggcagggcttgggcttaggagaaagtgggaagggagggagatggggcgggtaagcatagattcctttctgggagatgtctcacatcctggtaggttcctatttccatgtgctttctgtaagcttaattatagggtgagctgctgaaaggggttaggtccttctctctgccgtcataggctcaaggtactaaaaggatatgcgggggtgtaaagggagtaaggaaagagctctgccatcacaggtactctccttcccctgcatgtggtcccttaaatcacctgaattaggcgatattttagttttataaatacactgtaatgagggtaggtattttcatggagaggccacgcacagttacctggagtaacagaatactggaactgtcagagacataaaagattatctagcccagtgtttctgaaatctcttaacagaataccaattctaggagacttgcataatcttttttattgtttttgagtatcacgtggagctaatgttctatattttgaaaaattctggttcagtttaacctgctcattttacagatgacaacactgaggcccagagaagtcagcattttgttcagattcagtcaactcaatagaggttaaatttcttcattttatttattcttttgagatagtctcactgtgtcacccaggcaaaagtgcaatggcatgatttcggctcactgcaacctccgcctctcaggttcaagctattctcctgcctcaccctcctgagtaattgggattacaggtgcacaccaccacacccggctaatttttgtatttttagtagagatggggtttcgccaagttggtcaggctggtcttgaactcctgacctcaggtgacccaccctccttggcctcccaaagtgccgggtgggtggcgtgagccaccgcagctggcgaatttcttcactttaaaagagcatggaaggcaatgtaaattacagcttaatgcacgtacagtgtagtcagacaggctgagcttgcatcccagccttactactgtatcagttagttgttgccatgtaacaaactactcccaaaactcagtggctaaaccaacatttataattactcccatgtttttggctcattcaaggttcagctgatctatgcttgacacagctgagtagctctgcttcaggttgcagcagctggggcagctctgctccttgctgtaggtatgtgggtttcctggatgactctgcgcacatatcatctttcttggatcagcggatcactcagggcatgttttactcgtgatgttagaaacacaagagagctaagtagaaacaagtaaacaagtggggcttcttaaggccttggctcagaactagcatgttgtcacacccaaagtgatgtgcccaaagtcaagggacgggaaatacactctgcccacaacgaggccaaagcagaaatgtggaagcaaggaaggatggagagttggggccaataattcaacctattataacaactactagctttgcactgtggtgcaactcactcggcttcatctgtaaaatatgcagcatgatagtacctacctcatgggttttttttggagggaggagcaagtaattcaggtagttcttataaaccatttagaacaatgcttaaatttagaaaacacaaagaaaattagtgacagtactaatatttaatccatctaaccatcaacacctgtgcatatgaggtctatcccaccagagtggctataggagggttagggttgacttcgcagattggcctagtgtcagctgattctcttccagcagaagggcttgaaggagtgaccttcggaacagtccccagtcgctcatttataagtcccctttttcctctctcataactgcatcatagccacaaactcaagacccaaccagcatgggcttgcattgtgttgcctggtctccccacccgcctcggccctgtgtatctcacacccagagtcagcagtgcttttcacacaaaccatctgccaagagatgtggagctggagccagaaacacacaacagctgcagaagctcagccacattcagaagcctgtagtaatcgcctaacaggcttggatacagctctgactgctgagtaactctagagtatggaagcccatcagtaaattatgattgcagcatgagtaatacatgagttctgccagctgcttctggaatcaaacaaaagacagtgctgttgccagccaggaaaaagtcacctttaagtgcatcactgtcttctttttcaggctaggagagccggtgactaagactagcttctattagaggccccctttttctctcctagagatctttctaatgaaactcatggcttataacccctaccaagcccatcttttcaccttatgcccaggcagttgagaacacagactccggtgccagataaatctgggttggagccccattcaaaaatgtgacagctgtgtgaccttgggtaagttgtttcacctttctgtagcatgaggataacaatattaccctttaatgagggttacatgatttgaagcatgtcaaatgcttagcaaaatataggtgtataacaaatgttcaatataatattaactatcattatttttttgtatctccctgtgctactagggtaattgctcctaagagtaccctgcctccaagaatctgtataaatgttgttccattccatcccacctctctcaacacatctcatttctttccaactctttctattctatacatattttttgagcttctactctgtgcccaacactgagtcaggtactcagaagatataaacagaaaaaaacacagaaacttgcagctaaggaggtttttgttggggtcacagctagacatgcagtagattgttgttattcatggtgcttatgttctgtaaaccacgaacacgaggttagggtcactgcaagcttctggtcacgacattttcgtcaacacattaatacataaccctgctttatttgtgtcttggtgtaaagacaaaccatttggtctccgtggctgattcattaacattgaactcatagccagaggcactcctgcctgaacaaagcttacctaacacataagttttctcctaaggcatatcacagctttgtgatgtttaagaagtagatggcacttcagcactagacttgggaccattgtaaatggtgaaaatggcaataaagagcacaaaaatattaaaaactaatgcactaaatatatcacaaaaaggacacttgtttatagtatgagggctgagcagaagttctgcttcacctgggaatgtgtttatccagggactctgtgcatgtattcaaatgactgggaaagtgcttttgaggttacaaataaattctagccagtagacaaatttacacatacagaatctataaatgatgaggatacactgtatataaaaatgactatgcaagtcagactgcaataaagtttccatagaaatacagggcaatatagcacagaccagagagaaactgctccagtctagggtaatcaatcaggctccactaactgaaatgagacttttaaggacatttctgacacagaggagacagtagtgatggaagcaggaggaattaaaatatgtggctaaatgcagccagattacccagattggggccagaggatggaaggattttggcttccatcactgtacagtgtaacccagatttgactggattccccgaagcaggcctctcctcactcacacccattacaagcaagagccaacacttagagatgccaaaacaacataaaacagatgcaactccgtgatgttagctagtaacacaactttttttgttttattatactttaagatctggggtacattttgagcagaaagtgcagttttgttacataggtatacatgtaccatggtggtttgctgcagctatcaacccatcatctacattaggtagttctcctaatgctatccctccctcaacccccaatcccctgacaggtcccggtgtgtgatggcccccgcacccgtgtccatgtgttctcattgttcagctcccgtttatgagtgagaacatgcagtgtttggttttctgttcttgtgttagtttgctgagaatggtttccagcttcatccatgtccctgcaaaggacataaactcatccttttttatgaatgcatagtattccatggtatatatgtgccacatattctttatccagtctatcattgatgggcttttgggttggttccaagtctttgctatcgtgaatagtgccacaataaacgtgtgtgcatgagtctttatagtagaatgacttataatcctttgggtgtatacccagtaatgggatggctgggtcaaatggtatttggtatttctagttctagatccttgaggaattgccatattgtcttccacaatggttgaactaatttaaactcccaccaacagtgtaaaaacgttcctatttctccatatcctccagcatctgttgtttcctgactttttaatgattgccattctaactgatgagagatggtatctcattgtggttttgatttgcatttctctaatgaccagtgatgatgagcattttttcatgtttgttggctgcataaatgtcttcttttgagaagtgtctgtttatatcctttacccaattttgatggggttgtttgattttttcttgtaaatttgttgaagttctttgtagattctggatattaaccccttgtcagaaggatagattgcaaaattttactcccattctgtaggttgcctgtccactctgatggtagtttcttttgctgtgcagaagctctttagtttaattagatcccatttgtcaattttggcttctgttgcgattgcttttggtgttttagacatgaagtccttgcccatgcctatgtcctgaatggtattgcctaggttttcttctagggtttttatggttttaggtctaacttgtaagtctttaatccatcttgaattaatttttgtataaggtgtaaggaagggatccagtttcagctttctgcatatggctagccagttttcccaacaccatttattaaatagggaatcctttccccatttcttgtttttgtcaggtttgttaaagataagatggttgtagatgtgtggtgttatttctgaggcctcttttctgttccattggtctaggtatctcttttggtagcagtaccatgctgttttggttactgtggacttgtagtatagtttgaagtcaggtagcttgatgcttccagttttgttctttttgcttaggattgtcttggctatgcgggctcttttttggttccatatgaaatttaaagcagttttatctaattctgtgaagaaagtcaatgatagcttgatggggatagcattgaatctataaattacttggggcagtatggccattttcacgataccgattcttcctatccatgagcatggaatgtttttccatttgtttgtgtccttttttatttcattgagcagtggtttgtagttctccttgaagaggtccttcacatcccttggaagttgtattcctaggtattttattctctttgtggcaattgtgaatgggagctcgctcatgatttggctgtctgtttgtctgctattggtgtataggaatgcttgtgatttttgcacattgattttctatcctgagactttgctgaatttgcttatcagcttgaggagattttgggctgagatgatggggttttctaaatatacagtcatttcatctgcaaacagacaatttgacttcctcttttcctacgtgaataccctttgtttctttctcttgcctgattgccctggccagaacttccaatcctatgttgaataggagtggtgacagagggcatccttgtcttgtgctgattttcaaagggaatacttccagtttttgccccttcattatgacattggctgtgggtttgtcataaatagctcttaatattttgagatatgtcctatcaatacctagtttattgagagtttttagcatgaaagggtgttgaattttgtcggaggacttttctgcatgtattgagataatcgtggtttttgtcattctgtttatgtgatggattatgtttgtaacataaaatttttagcaggtcaaaggaaaagatgatttgtgctgtacagtgtgtaaaataaaacttaatacatgcacaagtagatatctctctgttcttatgactaatttcctttccagttcccagcctactctttctcttctcttccacagcccctactattcctggaaattccagttttgcacatacatccccatgccacttcccccttgcatatataccacttggcagaacaaaaaccaggtagttatctaagcccatctcctctggaaatcttagcaggagctctgtattgttactcaagcatggctttcagtttttactccatccttcattgagccccttccaaggggcttatgcaaatattcacccaataaaatatttccttcatattttggcacaagcaataaagaagtacaaggtcccagatcagttgcccctccctatcattgcctctgcctgttattcctgacagaataagcatttttctcatcttaaacgcatgatccatggtttctgcaatttctaaagaccctagaccaggctctggccacactggatattcaataaatgaatagatttccactaaactgatggctttggggaaagagatattgtataatattttcttccataaaactcataggtaggtttaagtattgttttcttatatatttcacagcaaagtttcataattcgtatcacataagttctaagcattgccttctaataactcttatccaatcacctaaagatattggttttgaaatttaacaaaataattatacactttgtcttgaagaataagcaggaagaatagctgaaaaaattctgaaaaagaaaagtaatgtcttgagaatagttttactggatcttaggtggaatatgctactgtaataacagtgttacagttccaggaatttggatgcacagatcaacagatgaaaggccagaaccagacttgagtttatataaaatttaaataatcttataaagcatacaaatcaatggagaaagaaataacaggaaaactaattttctgtttggaaaaaagggttgtttaaaaaaaccatctcttaccacacaccaaaataaattcaaaatggattaaaatgttaaatgtaaaaaaactcaagccatcaaagggagaagatggaaatgaatatatattgaattttcatatgggaaggactttttaagtttaaaacacaatagaagaaaccacaaaactaaaaatcagcacacttggctatgtaaatatttaaagtgtcaattcaagaataataaaaggcaaagaacaaaaagagaaaaatacttggaacaaatatggtaaataaaagattaaagtacttttttttttttttttttttgctcactgcaacctccgcttcctgggttcaagcgattctcctgcctcagcctcctgagtagctgggattacaggtgtgcaccaccacgcctggctaatttttgtatttttagtagagatgggatttcaacatgttgatcaggctggtctgacctcgtgattcacatgccttggcctcccagagtgttgggattacaggcgtgagccaccgcgcccggccaaagtactttaaaaaacaaaacaaaacaaaacctcattgaaagtgatagaaaaaaataaaaacatcaatagaaaaagagaggaacaagtaattcacaaaaggaggaaatacaaatggcttataagcatgcgaaaagtttaccctctaaaacaaatttaaatcaaatcaaaacaagataccaattttccacgtcaaactagcgaagattaaaaacaagtgaaaaggctcagtaatacatggctgaggttggtgaaatgttcactctcttacatactacacctttttagaaataaacttggcagtgtagaccaagagcttttaaaaagttatgataggccaggcatggtggctcatgcctgtaatgccaacactttgggaggccgaggctggcagatcacttaaggtcaggagttcgagaccagcctggcctggccaacatggtaaaaccccgtctctattaaaaatacaaaaatcaggtgggtgtggtgctgtagttccagctacttgggaggctgaggaggttggatcagctgagcccaggaagcggaggttacagtgagctgagatcatgccactgcactccagcctgggtaacaggacaagaccctgtctcaaaaaaaaaaaaaaaaaagttatgataaaattaagtaaaaattcgaatatgaaacagtatttggccaggcgtggtagctcatgcctgtaatccccgcatgttgggaggatcgtttgagcctaggagtttgagaccagcctgggtaacataaggagaccccgtctcttaaaaaaaaaaaaaaaattagccaggtgtggtggtatatgcctgtagtcccagctactcaggaggctgaggcaggtctcttgagccctggatgtagaggcttcagtgagccatgattgcaccactgcactcccgactgggtgacagagtgagattttgtttaaaaaaaaaaagaaagaaatttgataaagctatatatgtttgtttctgtagtttcccctctaaatagtctaggaaagaaatgaaagttatgcatcaaaatgtcagcaagggttaaaatgttcctttctaaccatttcgtactgtgtttagatagaatggatctagtgtttaaagaaggatttcacaatgatggtatatatttctaaataatttatatttggaatgttctaagacctctgtattatttttgtggttttggagacatcttttatttttattctttttttttttttttttcttgagacggagtcttgctctgtcgcccaggctgcagtgcagtggcatgatcttggctcactgcaacctccatctcccaggttcaagtgattctcctgcctcagcctcctgagtagctaggatcacaggcgtgcaccaccacacctgactaatgtttgtatttttagtagagacggggtttcaccatgttggtcaggctggtcttgaactcctgaccttgtgatttgcctgcctcggcctccgaaagtgtgatttttttattcttaaatcagtaccaattaacaggataaaaataattatagaagaacccatatttatcaggactgctattttgagtacataaaatatctaagactatcatacatgaattaatgcagtattattatggaaaaagattccagagacagtgtctttcctggatatttttattgggacaccggggcattcagatggcctattgaaatgagacaaggagagacagtgagaaatgtttctttcatagtattcagttgatttttaaagtttgggaacaaaaactataaaatgagaactctgagttatttcaaactatggcatttgtgtgctttagcttccttaaaatatacatttttctgattataaaaatagtttatgttcaggtgggaaaatgtagacatacagaaaaatgtttttaaatgtatggtcaccagagttaacaaatgtgcttctttaatgatacaagaaatctatatctatagcaatcaagagggaggtagaaagagagagagacagagaaatagagagatgacagagagagagacaggtttggctgtttggtttaaacatttggtaattattacctttaaacataaacacaattgtacatgttctgttgtatgatggtaggggtagctaaaaaagaggaaaacagtttcaaccataggatcattgactataaaccagagagatctcatggaaagtaaagtcacagaactaatccaggtcttccgaagctgccatattgttactgagtaatgcctgaaataaatacttccttcttttctccggacctcctctcatcacttagacttaaccctgaaggatggagtgaggaatggcagaagtgtgagggtaaataacagaaatgggattagaatgtcatatatacaatatttgttaatgaaaaaaatctggacaagtcatggcttatttttaggatcattaaatagttggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctattttttagtatctgtatccaaatcaattgctagtgcatgcctcatctttccgtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataatatttaatttggtaaaacgatgcctctgcttaaataaaaacacattggggaacccctaacataagttgcaggatttgctcagacaaagacagcccagagctggaagtgatggataggtgtcctgtgtgaggagttactggccaagccaatagtcgttagaggtacaggtttgaaactgaactgtgaggcatgggaagttgacttgtattttccactggctgtagactggaaaccagataatcatgctcgtatgtagaggctggtaatgcttagatcgaaggtttgagtgacaggctgttctagtagaggggatggattttaagtcataagctttatgacattgatttttgtcagtggtatggttaagcatgtttgctagaaagcaaagttttaggtagatgaactgttactgtattcatattaacattgtatgtacttggattagagagttaacatcagctcatttactctgtgagatatactgcccacaaactcaaggatttgtaggagtttagggactctattgagtgtacacagttatttccttctaaattgacattaaaaatttaaaattcgccactcaaatctcagcaaccaagttttcgtttcaatcacacaacagagcaaaattttgcttttctttgaacacattctacgttacacagtctaagaactaaaatcaatttaacctagtttctatctcttttatgagccaaaattaggagtatcaaaaatatgatttgaagcctagggctcttgctgactagtcatattttaaaattctgaatctagagatcttagacttcagttcctagagtacatggcaaacttcattttccagtgtaaccctagatgatacatgtatgccatccttagaaggagtcagatatcatcattaaataatccataaactaaaacttgttttcatgatcccctactagaagtcaagtccatttaaagatctaataaaaagaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgtgtaataaattgttataatcccagcactttcggaggctgaggcaggtggatcacctgacgtcaagcgttgaagaccagcctgcccaacatggagaagtcctgtctctactaaaaatacaaaaattagctgggcatggtggtgcatgcctgtaatcccgctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcccacccttagacctcattttctctccatataagataaaaaatgccaccacaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtctttgtaatcatttattgaatattccactatttgccacatactgttaatacagcctccataaaatttacgaaaattttttttcgtatgtatgtatacattgatacatcctcagggaaatgcttagaaataagtaccaccagcttcattttacagatgaccaatctgaggcacagaggctaaataacttaacttgtaagtggcagatctagaattcaaacccaggatggcttgaatccctggactctgaccatgaagcttcctggtctatctcagagcagaccttaatctgatctgagataggcatagcactgcacaggcacttagaagcagagaggacgcctttaaaacatcaccatgatgaaggtgctaatataaattccaagactaaatgtgcagagcccaagtcacttgcattcctgccaaaagattcaattttaaaaatgtttatctttttgttctgtgtgtaccgtaccgtcattctgagatagccactgttaatattttctagataagattgaattttatatccttttctgcggaattcaaatgccctctacgaggtttcctctgtgaattcccagggcagttattttttttttttttgagatggagtctcgctctgtcactcaggttggagtgcagtggcacgatcttggctcactgcaacctccccatcccaggttcaggcaattcttctgcctcagcctcccgagtagctgggactataggtgcatgccaccacgcccagctgatgtttgtatttataatagagacgaggtttcaccatgttgcccaggctggtctcaaacacctgaactcgtgatccacccacctcggtctcccaaagtgctgggattacaggcgtgagccactgcgccggtccctacttacattcttgtagttacctctgacactgagctgcggcttcaattgactttactttaattcactcactcttatgcctctctgttcaaattttgtcaacccagatgtgcagctcagccttctacctcaactaaaactaagaacgggagcaatttctccacccccagacagacacacaggtacagatggacatacagccacaatcataaatacagagacacggggactgacatacatttgtgagtattgtgagtacaacacactgaactgacgactggagacaaagaagcagtttctacagaggcaatgcaaagaacttcacaagtatcagtctcccctatctgttcaagtccttcagctgcatactgtattgcttggccattctttttttttctctttccttttgtgccatccattggaatttcaatttggattatattaaatttatgaattaatttaggaagaattatcatctttccaatgttctacctttctgctaaagagaaaaaaaatctctccatgtttttaaatctttgtttatttatttatttttgaaatggagtctcgctctgtcaccaggctggagtgcagtggcgcagtctcggctcactgcaacctctgcctcccgggttcaagcgattctcctgcctcagcctcccgagtagctgggactataggcgcctgctgccacgcctggctaatttttttgtattttcagtagagacggggtttcaccatgttccccaagatggtgtcgatctcttaacctcagttgatccacccgcctcggcctcccaaagtgctgggattacaggtgtgagccactgtgcctggcctaaatctatcttttgataaaacttcacggatattttcatatgtaccctatgcatttcacattgtgctattacaattgtgatttactaatcagataccctagtatctatggaagataaatcatttaataagtcgctgaaataatttgctaatattttatttgggatttttgatttttcacatgtaaggagtagttttcttttttcagctattttaggttagctaacagaattctactagcttaaaagaatagatacctaatttaaaacaaagttcttatattacataaactcattagcaaaaccagctggccctatggatttttggtgagataagttaggctttttactttttgagttcaactttaggaatttatatttcctaataaaaatcattttatatatatttttaaacttacctgaaaattgtacatagttcccgtatgattaaagcatcttcttaacaagatttacttcgttttactctcaattttagttacaaagagatcccagaggctcactattgtgaattctacccacacctaagaacatcttttagacttctcatttttctctttagttaggtttattttttctctctgcctttcctggttgtattagttcttttgtgtccggaatttattcattccggtgggttcttggtctcactgtggacccttgcggtgagtgttacagttcttaaagatggtgtgtccagagtttgttccttcagatgtgtctggagtttcttccttccagtgggtttgtggtctcgctgacttcaggagtgaagccgcaaaccttcccagtgagtgttacagctcttaaaggtggcgcatccagagttgtttgttccttccggtgggttcgtggtctcactgacctcaggagtgaagccgcagaccctctcagtgagtgtttcagctcataaaggtagtgcagacccaaagagtgagcagcagcaagatttattgtgaagagcaaaagaacaaagattccacagtgtggaaggggatctgagcgggttgccgctgctggctcaggtggccagcttttattcccttatttggccctgcccacatcctgctgattggtccattttgcagagagctgattggtccattttacagagtgctgattggtcctttttacagagagctgattggtccattttacagagtgctgattggtccattttacagagtgctgattggtgcatttacaatcctttagctagacacagagcactgattggtatgtttttacagagtgctgattggtgcatttacaatcctctagctagacagaaaagttctccaagtccccacttgacccaggaagtccagctggcttcacctctcacttttaaaactgttgagcagagttcttgatttatttatattcagtagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcgagactctgtctcaaaaaaaaaaaaacagtaggattcttattttttattgtctaaaaatcctgtctttttacttttgatttttttctgagaattaataattatttggaagacagctttaacaatttttttttttttttttttttttgagactgagtctcactctgtcgcccaggctggagtgcagtggtgcaatctcggctcaatgcatgctccgcctcctgggttcaagcgatcctgcctcagcctcccgagtagctgggattacaggtgtgcatcaccatgcccagctaatttttgtatttttagttgagacggggtttcaccatgttgccaggctagtcttgaactcctgaccttaggtgatccgcccacctcggcctcccaaagtgctgggattacaggcgtgagacaccatgcctggctgacagctttatgatttttgagaagttggttttctttttttttgttcaacaatatattgttaaacttgatttactgtgttgtggtgtgggattgttttgttgtggtttgagagtattgtatggaaaatttcttttgttgggcttcagtgagttgagagggagaggaagagagagtgtgtgtatgtatagtacagcaggagtaacaacagggttgatattccacagttgtatactagtttgtctgtattagttgttaaaagagtgaaataattgtgtatgatttggtaaataactgctgcatgggccgcctatgttccccctgtcctgccaccttggcttccccagtcccgctaccttagactctctagacttcccagtaatttagcaatgaaagggttaatgctagcccattagggtttttcagatccatttcctggtgctcagatcagtgtccattttaatcggttggtccaggttgaatttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaaaaaaaaaaaaagaaacattaatctcttccaatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatctgtcaaaatgggagtggtgtggtgctatcttctaaaactattatgttttccttacatttttttgcttttaacagtttatcctttatatatttgatcctatatgatttggagaacaaagatacatagctgttatgcctctactgtggattttactttctagcaacataatatgagagactatgttctactttatgccttcaatcttgagttttaccttgtctgaaactagtattatttttgctttcttttctttcttcattcttttattggtccttttttcttttaatttattcgttaagttctctgcctatctctgtttttaagattttatgatttttgttctaagtgaatgttccacaagcatcatcttggaagatttaattttcttctgctgtctgaaagtatttgtctttctataggtcacttaaaacatttacctttaaatcataaatgctagtcaatcttaacttctaacatattgttttatactttattttttacactttcctgtttttcctttttggtttttgttttctttcttttgcttatttggcttatattttgtttatatttatcttccctggttattttgatgtatacaccctgttttttattttattaatggccaccttcaagtttttcaaaagtgttatttaacctgtacttctctatttctagtattaaatagtgaaagtatattttgaacactcatgtgtcaatgaggaactctgcatactgtaactttctctcatccttccttttcccttccaagtctttgctaatttaccatgaaatctgagatatatgttactttttgcagtagttattttcaagaggaactttgacttaaaatatactttcatgatgaaaatacatttttcagtctaattccattggcctttatggttactagatgtgacaataagtctattgactacttggttagcactgtagttacaatttttaaaaaatattttctcatctttagtgggaagttggaagagactgacaaggatgctagtcaaatgacattttaaatctgaggtccggacttcagaattaagtggatatacttccattacatgatgctgttaattaaatgtgacctaacattggtgtgttttaaaatcctttgttttctttaattaaaaaagaaacaggtataatgggtttggatttttagttataacagtctgcacatttaaactttatttttttgaattgtgcaaagtaacagaacataaatctctattaccattgagatttcagctgcatcttggaagagattggacttcagcagataaacatatgtagagaagggcatccttggcaggagaaataatgtcacaatgtccaggaaaggaaagcttgcagggagtttggggctaaaaagaccaaaggtaaaaatttgcagtagttgaagtgagagaatgaggatatgaaaaggaatgtgagggacaatacagagctagaatggacagacaatggactggatattagcagtgaaagagttgttgacaataacttggagtttttaagcatctgtacttgtgaaggtgaatctttacgatacaatgagagaaagagtgaaggttgagaggagagaagatactaagttcttactggacatgttgcatttgagatgcctatgtaggtgtccagcaggcactttcataacatgcatttattattgggaagacagaattagagacctagatttggaacaggtgctaagcaaagtcctgaaagttggtgagatcactgtgaaaacggaaatggggacttccgtagcactggtcaggccataatttctgggctaaggccatagccacttgctgagttttggcaaggagggtgaatgggaaatgagatccaagagaaatctgctattttagattcatagtcttacatgtggtccagagagtactcgtgtttctactgggatgatcaaagtactaaggcaaaggggttcccagtcaaacaatggatatggagaagctactgtgcccaactttgttaggaaaaaggaagagttatgaattctatcactgttccggatgttttacatttgagatctcctttagtcatcgctgttgcttattttgtctaagccagtttcctcatccgtggtatggaggtataatgtctaattcatatggtggttgtgagaactcattaaaaacaatgcacgttaaagtaactagactgtggaagttacttaataagttaaagctattgttaatgatttttgtaactattcgtgtgtcattgaaacactgctattgtgaaacacaactagcaaacacttgatagtagtgatttgcacactgctctttaaagagccgctctagggaggtacccaaagggagtgcttcaagattgagggagcatgtacaaagctgggcttctgtttctttatcaacccacaggaagcatggtgttatctgtgtgcgttgcttgaaatgagcgtaggtagacctaaaagcaccaggggagggagcggtgattgaaactagagagagcattggcaagagagggttgtccccaagaactgtggcttctgtagatggctcaacagagacggagctgggaaaataaatagcctgaccacactgtccttccacccttgtatgtcctgctggcactttctgctacctgaacccagtgggacataggtagccatcatggatccagggttgagtggagaagggaggagagcagccagggagggggcacaccttgtcagaatgaagagaagaaccgagaaacagcctggttttagcaagtgagactcatacactgtgatgttgaaatttgtgtactaaatgtgacttaagaatagagccagcccatgaccagaatatctgatttgaacatttaatgaaattgcctctctggctttcatgttttagatggcttttcctcaagtgactgcagagataggctgtgtctccttacttccagaacaacatatatatatatgtacacacgcacattgtctacataggaagataaaggagaagttgttttcctaagccattagtgtcatgaaatgcatggcagctgctgtatataggatcatggcctgtcatactgccatacctactggctaccaggtttatatagtcagtaagacataaccccttccatgtggcatctggcaggtttcccagggtagaggaaagcatgagccaagtcttgaaggctgagcaggagttagccagttgaatgtggagagaagagaagtgttggaggaaggcaatgcagacagggagtatagctcatgaaaaactggaaaagaggttgggcgcggtggcttacgcctgtaatcccagcactttgggaggctgaggtgggcagaacacgaggtcaagagatcgataccatcctggccaacatggtgaaaccctgtctctactaaaaatacaaaaattagctgggcgtggtggtgcatgcctgtagtcccagctacttgggaggctgaggcatgagaatcgcttgaacccaggaggcagagcttgcagtgagccgagatcacgccactgcattccagcctggagacagagcaagactccgtctcaaaaaaaaaaggaaaaggagaatatgtaaagagcgtagctcatgcgaagatgctatggatgattcataaagaagagctcccagtgtgtttggaatgatgttactgccatcggaatgaatatggggactggtaggggcccatggggattacacttaatacatttatacctaaagtttctcaagaactctctcttaacgaatgcgcataggcctccgactcttgagatatttaggcctgcagtttgatagaggaaaaacagacataaaatccagttggaatttcacctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttcgagagggaagaaaagcaacatatagggagggaaaagagaattcttggagcaaaatattgggagagtatatttcattgtcaggttgaacaaacagaattccacaagacagtgttgccaggaatagaatatcgactgtgcacacacttctaaagatgaagaaaatgtaagtgggggttcttgggcttagagacacatatgtgggctctttgggttaggttaggtgagtggtctccctgaggttcagctggcaaagacccaagaagcaacttcttaagctcatctccaaatagccccctgatctccccaaggctgccaccacattgccaggctggttgtgaaactgcttttccagaattgcttgcacgtgcagagaactggtctcctgttaaggtcagccctgtaaaaaagggggcaagaatcaaaggactcttgaaggaaacacaggaactcttccttagctcttgatcggcctgtttcctgcccatgtgggtttgaagtgtgagggagggtaagcacacagcaggacacaaagccatgagccgtccttccttctaagggtgtcttagctccaagatgactttaaaaacagtcttcctctggggatgacacaggccataatttcacacagatttacttgatcaaactggctttgtgccatgataataccaatagtcctttacacagaaatcaatgatttagaagctatcaccctgttttacacatgaggaaactaagacagaacttcaagaccaaagttcttaatgactccactgtcctgttaatcatgtcaggcaattagtaattcacaaaatagtcacctgggtttaagatgtattactttcagttactgctagaattgttccagttcaactcatacatatttaaaatgagtagtctgtcaaacacagtgcttggtgctggggcgttgaagacagaaagctcattgtctaaggaagaagacagacatgtcaatatttaattagaacaatgtcattagattgattagttgtgtgtgccttcctataaataaaaatctttattttaaaattatagaggaaatgaaatacaaaactaagcatgcaaagcaataagtgaatatcttctatggtgctgcttctctcagcccccatgtgcctgccagttttatcagcaacaggtaacactgttatcaggttggtgtatgacttctaagcttagatgtcatcgtactgttctacatcttgttttcttcactttatatttcaaggctcatgcaaacttataataccctattacatgtatgtaccgttatttatttagagatgcttctgttgatgaactttatattgtttacagtttgtggctatatgctgcaatgaatatccttgccatatctttgcatatttttactggtaaatatgaaagatacatttttattataattgttaaagttaatatacagtataattggcttttgtgtgtatacaactctatgagttttaacacatacactcatgtatctgccactaagaacagcgatcaggatacagaatagtaccatcaccccaaaaatcttttttgtgctgcccctttgtagtcagatttctcccagccctaatccttggcagccactcatctggtctcatccctacaggcctgcctttcttagaatgtcatataaatgcagtcggacagtaggtagaagatgattttagcttcttcactcagcataatgccatgttgctgcaagtagcaataggttttttcttttcattgttgagtagcatggatatactatagcttgtttatgtatttatccactgaaggatatttgggtgcttccagtttggggtgattatgaataaatagagctgctataaacattctattttttttttttttttttttggcgggggggacggagtcttgctctgtctcccaggctggagtgcagtggcgtgacctcggctcactgcaagctccgcctcccgggttcacgccattctcctgcctcagcctctcgagtagctgggactacaggtgcccaccaccacgcccggctaattttttgtatttttagtagagacggggtttcaccgtgttagccaggatggtcttgatctcctgaccttgtgatctgcccgcctcggcctcccaaagtgctgggattacaggcgtgagacactgcgcccggccaacattcattgtatgaatgtacattttcatttctgaagggtaaatgcctacaagtgggattgttgggtgatacgtaagtgtatgtttaactttataagaaattgttaaaccaatttccacagtggctataccacccattttaaattacttccatcaatggatgagaattgcagttcctacacattctctttagcactgggtattatcaggttttcttttttctttcttctttttttgttttttgatctgttctaataggtttgtagcagtatctcattgtggtttcacttagcatttccataatgtttaatgatattaaacatcttttgtgcttatttgccatctatacattttctctggtgaagtgtctcaaatcttttgctcatttaaaaaaattgagttgttttcttactgttgagttttgagagctttttatgcattctagatgcaagtcatttgccagatatgtgattagcaaatattttctcccagttcatggtttgtccttttattttcttaacaatgtcttccatagactaaagttttaaatcttaataaaatttagcgtaacaatttcttttttattcatggtgtctatgacagctaatttttggtgtcatagctaacaatcactttctaactccagtgtcatgaagattttcttctatatacctaaagttttgtattttaatgttttacacgatgtatttttagtgaatttttgtatacatgggtggttttaggttagggctctttttttgcatattgatgtccaagtgttccagtattatttgttgaaaacaacttcattgaattgttagacatttttgacgtgagatggtgtaatatagtttaattgttgaaagaatggagtgaaaccagtccacctaaatttcagtctcagctctgctacaaattagctgtgtaacaatcaccaagtatttaatctttctttgtcatagtctccttttctgttaaatggaaacagtcatagtacctactgcctagattgctatgaggattgagttattatgtgttgacacacttagagtagtacctgacataataagtgatgaattagggttagcttttatataacttttcagttattgtagatattgcgagcacgtcctgtaaacatgttttactaattacactgcccatcaacaatatagatgtttctattcaacagccagcaccagatattatgaccctctccattctttgacaatttgataggcaaataatgagatgtctttttagtttgtattttgagatctgtggtcaggttaaacatcttttcaacttttcacatgttgtgagtatatcagcttttgatgagtaacaaggcatccaaaacataatggtaaaacagcaaacatttattatgacttatgcttctgtatgtcatctgggaaactctttggcttaagctggattggtctctcatcctctagcgggttagtcttggcgtctcctcatgatggcctcagggttccatagagcagcagcaagagtgcaagcccagtgggagagcccagtgggcaagcacttttcaagcctctgcttatgccacattggctaatcctccattgatcaaaagaagtcccatggccaagcctagattcaagagatggagaaagaaactccacttcttgatggaatgaaatgcaaaatattgtgaccactttttcatgaatctactgcgactggctgtttgtgtttccttctctgtgaattgctattggttcaacgacttatgaaatttctttatatgttatacatattaactccttaagttttacatgtaacatacgttttacatgtaacagtatttttctacttggtcatttaacttcatttatataatcttttgctgtatagaaggttttggctttttctgtgataaaatctatcagtgttttttcttcatgacattggatggccagaatgtaagctttttgaaggcagaaaccatattttattttttattattttcttgacccacagaaagcagcacagagcccagcccatagtaataaaggtttattgaatgaatgcattcactgaaggccaatctcactcactcatttatttatttattcattcatcaatgtttatggaatacctattataaaccaggcattgtgctcattgttagagatacagcgatgggcaaaattgacttttagatggtgtttagactaaagcatggtaggtagtaatggaacttattatcaatgagacataggttcaaattgtatctttctacttatgtgaccttgggcatatccctaaacattcctgaatttcagggttttttaacctataaaattgagtgtaaatgctttccttcaatagtgtgagaattcaagtggacaatgtttgtaaagcacttagcattgtgtttattatgtattatataataaaaattgtcagcttccttttctacatggtataatctcaggcctactaggaaggctaggtgacttcttttgtcaatctcctcttagcaaatataatcctgaatttcttccattatagactcgtttctttgatttgctcctccaatcgttctccgtgaattgtcactttgagcaattcttgcttattctcctctttgtgcaggcaagtcagtcaaattgccttctctgttgggagcagaagaacagggcactgaggagacactgaattttgttcagtgctgtcttggaagatagatatgcttggttgtgggtgtgggtatgtacgtctttgagcagcataagggtagttgggaacttggcaggtaattgaatcaggagaagagcccagaaaaaggtggtctggttccaaagatgcatttttcccataccgggtatcctggtgctgataaacacagtgcatttagagagcatcccactcctgagacaaagtgagtagggaagatgatgaggcagcactgccaggcttaagggaatctgtaaggtggccaaaactcctctctagatattctcaatttctctgtcctgtaccctttctagctttttagccacctctcctcaaaatcttttttctcttcccccaatttctaccaaactccaggattctccaggcgccctcctgccagatgtatatacattccatattccctcacactaaggacttggctgttaacactgctactctggggtgacagaaagggccctggagagaaatcagcacttgagggctggctctaccactaccctttgtgcaatcaccaactggtctcttttctatatgcctcagattgcctgttataaagtgtaaggcttggccaggcatgttggcttatgcctgtaatcccagcattttgggaggccaaggcaggagcttcacttgagcccagaggttcgagaccagcctaggcaacacagtgatacccccatctctacaaaaaatttaaagattagctggggggaggggtgttgcatgcctgtagttctggctattcaggaggctgaggtgggaggataacttgagcccttgagttcgaggctgcagtgagcagtgactgtgccactgcactgcagcctgggtgacaagagtgagacactgtctcaaaaaaataaggtgtgaggcttgcaccaagcagtctgtaaaacctcttccggtgtaaacaatccttgatttgatggaaccatgcttcctgcacccccactgcctcacagaatggagtttgcatataaatgaatgttcagtaaagtctcgttgtgtggatgctctgtctgttccctggaaataaaaagtttcctgccagctgactgatcctcattctaactaacacatgtgttatttggcctagatggaaaatttccggcgtttgaaggtggcgagaggatgtcattccctccagcagacagacaagggtgccatttggctggaaagcagggatgggaaacgggcatggcctttggggaaactggcttggtacaactcctgggtgagcacaggagtttgttgttagagagtcacagcccagtcacatccaggatgcccctggataactctgaactcccagctatacaataaaaatgttagcaacttcctttagttatttccagtcttgtatattttggtatcttcttgttagctgcccaatatcttcttggaaggaatcttgaggaagaagttattgctcagagacttactacatacacaaaaggaagacagagaataaaaaaggattaaagtgttggaaacatgcctgggaactggatttcttcatgggagacaagaaggcagaaaagatactgaaaatactttaacataagggttgacacagaggaatagtgctggtagttcttagggcccaacagaaagaaattaatagcaactttaagatagagaaagaacattctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctgtctgtatttatgtgtttatgtgattagttttccatgtctgtctcctacatttgcctataagctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgcttctttggctcattgccacggccttaattccagaaatgcttttgactcagaccttttcagttcattgccagttccctgatttctgaaatgcctttggccaaggaagtgctaattggtatttcaaatatttagaactttaagatacctacttctgttacaaagatgaaattaccatgaacaccttttgaaaaatttaaccatagctaataccaaatttccaaaaaaccatacagtgaccatacagttagttgttctgaagacatgacgcattattccaaacacaccttagcagaattccacccaatactacaattctgaggtagtaagaagcacaagggaataagcctgcgatgcaataatttaatctgcctaaaattgtctcctagcttgccaacacttcgaagatcagggaactgggtaaatcaggacttgatttcatctgcagctgtatgtgaactggaatgtggaaaaaaaaaaaaaagctaattggagcaagcatgttgtgctgcagtggagtgtattttcattgatatgtttaacctttcatccccttcatctgtgaaaaaatgaaaattgctgacctttgaggttttatgtttttaattaagcaaaatttttttctttcaaataaaatcttatatgaagcccccccgccgcaaaaaaataaaataaaataaagttgagtagctcactgggagtgggtgagggtgtgggtctagagtccattctgttgatttcacctcttccactctcagaaacttctggagcacctttttagaacatgagaaattacagtttctttaaacacagtttaacatggctctgtctctaatttctaatgtaattaaattctataatatgggtgttgattcaggcccacaataatttccataactatttttaaataaaaatattcccatgtcttagttaatggctcattattcatagcaatattgaatacaagaaaatgtaaatataaaaactagagttaaacaacattttgagttcaccataataagatttagtgagaagacgctactaagaaagattagatactgttcaatatagaacacagaaaatacagtgagcaaaacattttagaggattgttatgcttcacttgtgatgcttggttgttaacttggtagacgtcatgccacaatgccaagtagttccttataaacaaggacacacttttatgcaaacattgaaaaagtgtttgaggctgggcgcatggctcacacatgtaatcccagcactttgggaggccgaggcgggtggatcacgacgtcaggagttcaagaccagcctggccaacatggtgaaaccccgcctctactaaaaatagaaaaaaaattagctgggcgtggtcgcgggcacttgtaatcccagctactcgagaggctgaggcaggagattcttttgaacccgggaggcggaagttgcagtgagcccagatcgcaccattgtactccagcctgggcgacagggcgagactccgtctcaaaaaaagaaaaagtatttgagagatctttgttaaggaaaaatagcattaatctctaaaacttataagatgtatgatattaaatatgcatcttgtttcagcaaattattagccttcatgatagaagtatgaattaaactattaatgaatttgatcagagccttttagatatggttgtgatgaaacaactcactatccgtccccaacatgatttggagaggatagcgctataatgtaagaaagggtattaagcagagagattgatattggtatgagcccagataggatctgtcttctggcaatgattctcaggaaatgtctctattagaaaatgtcttgagtggcaccagatatgcagtggcagccatgcctttcatggtgtcagcagcagaactctttcaagaagccacggaccacagttgtactcgttgtcgtggagcctctgctctattctttctgaaaggctgtttggctactttttttttcagcattaagttttaactcctttatttttcagcattgtgagataacatcacatttcctattattagttcaaagaagagagaaagagaaaaatgcattatttggatgtaatttgaaatttggagtagatatagggctgaaggatgagacataaagggacatatatgtccatggctcttgattcttttccagctgccatttttttctctctctctttctgtctctcttttatttatttatttatttttattacactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacacttttttttacgtttaatttttatgtgtgaataatagtcaaattgttcaaaagccagtacacacaagcatatagggaaaagtcttccttttaccattgtgccccaactacccagttcccccgaataggtcatcgttgttcttctttttatgtgtcaccttctagaaattctttaggcagatactagcaaatacaactatagattctcattttaagaaaactaagcaggtgattttcaagactcatcctaggaagctggtaggtatgtcttcttatacccaaagctcacatagaagatccttctggtactgtaaatggggttacaaaggacagagtactggctggtggaagaggtcttccttaaccggcatgctgaacaagggtagcgaagtatagtcaagtccagactcccagaggccacaatttccttttccgtcactgaaagtaaagggagatctctgaaaggagcaagaggaaaaagaaactagatacatacctagaaataatttatacatagcttggttgtcttttcaaatcaactgcattttgtattatttcctaaagctattaaataaaccacggccactgccaccgctgggagctcagagcagatcctgtggttttggcaagactcttgactggccctagaaatggggctggattgaactggagttgaaagaattacagtgtttccttcctcttgatgactctttctggaacatgcctggaatgtgtgagtgtgagagatgaagtggtgttcactcagagtcaggcctgggtatgtacgtggaaggggaggtgtgtgctggtgttatttttggaggctgtaattccactgttaggctttgtagctcgtcgtctctttcaatgtttttactatcctaacttgtattctctgtcctgagatcttaaaagttaccaatgaggctagaagtaaaatggatgcttcaaggccaggcttgggaactcattctagtggagattttctccctcaatctcatgtaatgagttaatattacaataaaatgcaggtgtaactcctgcttacacgaagacttgactttgaaatttttctttctaatcattcagataaaggtttaatttgtaccaagattatcctcaaaacatcactgaatacagtaaacactggcaattgccattaaaaacaaattatatgaggactttatatcaggtacaatgcttgacataagtaggtgctcaaaaattctggtaaatgaatattagccttaaacgctcagcagtcattggtcacttttctttggcattttgtaaaaattgtaatgtttttttccccaaaacattgggaataatgtttttttgccccaaaacagttaaatatgggcaaggaggtcagttcagactcgggggagcacttttgtttttttttttttttgagacagaattttgctctttgtcgcccagtctggtgcgcagcactggaacctctgcctcccgggctcaaatgattctcctgtctcagcctcccgagtagctgggattacaggcacccaccaccacacccagctaatttttgtatttttaatagagacaacgtttcaccatgttgaccaggctggtctcaaactcctgacctcaggtgatccccctgcctcggcctcccaaagtgctgggattgcaggcatgagccactgtgcctggcccgcactttcatttttaaccttattattctagaattggaagccgagcaaatggatggacttcagtcaggcagatctgaaataaaatttgcccatccatccatcccattcatccatacactcatccaacaaatacttaagtcctctatatgttgagattacggagaatattccattgtaaaccaattcctaaattcctcttcctatacagaacatttggagtttatcatttagagggagagtaaataaaataatcacaaattatggtaatctgtatgaataaaacaggaggccaaattagaggtcaatgggatgagagtgtataggtattatagataaggcaggtagagaagccttctatgagaaagtggcacttaagctgagacccaaaggacaagcagaaggtggccatgccaagagtggagaaaaacattccaggcagaaggaacagcaaaggctttgaggtaggaaagagtatcttgtatccaaggaatcaaagaccagtgagcatttgaatcccagctctgccttcaatagctgtggaaaatgaaactagctgctcaatcttttgagccttcatttcttcatatttaaaattgagataatggtgcatacctcacagagttgctgaatttaatgggtattcaataagataacatgtagcttatttgaatcacttctacacaaaggtctctgagactctagttgggccctcatcactcaattgatttttctagtctcctgattgttttatgcacatttgagagccaaccatcactggagctagagaacattttccatccctgatatttccacatttaaagaggagagaatagacacagactctatctgctcatgttagaacctttagaaatcaaaaaagggaggggtggggaggggagagagagaaagaaagagaaatagtgagaaaataacatgagaggattttctttttaaaagtgtacttcctcatttacagaacaaattcataaaatttaaagtttgggtaaggttttgtttttgtttttacatttggggagagggtaaggtttggggctaagtgttcaggaaacagaataaagagaaatgaaataataatcactgagtatgcaatatataacagacagagtggttggcaagttatgtattttatcttatttaatctttacaagaatcctgatggagtaaatgaggccctgagggaaatgaagacttcacttagtcactgtctgtcacttatcttgaggtatttaatgtggaattgtgcaattctttaaaaatgagaatctataaggcataagtttatgtagttgatatatttctttagaatactttattattgtgacagtatcacattagcatcaattgataactaatagttaaatgaataatgataatgtcattattattaattcatcttaatactacatacatttcctgaatacccagctatgtctagtgcatggcttgttgggggaataatgggtagtccattgcaactagggtatgcagtggggcaggagaggttagcagggtctagctgatgaagggtcttgatgccttggtaaagagttttggattttgtccagtggaagataggcacatggtcagaatagcattttagaaagaatcctcacacaactttaagacaaggctttgtgagcaccagtttacccaatggggtcatgttaataaccttagtcatacattattgtctctctttccttttaggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaaggtaacatgcccctaagttttgggcaggtgaggcccactgaggaacacacacaccttttgtcttggcagctgctccctcaggggcagggcatgcactacctgaatgtagagcttgacgatcttgcctgtctctttccatgcatcaccgtgtctggtacatggaatgttagagataaaggagactacccagtccaaccccttaactagatactgtgcctactttgtgagatgaaatatttcatatgttctaagggcatcatggtacttatggatagttgactgttacatgtatgtaatatgaaaatcatagcaatgaaaacaagtgttcattgccaaactactattttgagctttcttatttgatttttcatgtgatacattgctttgcttgtccctaaatacccttaatggaagttaatattttcaggagaaaattaaatataaataagaattttagaaggggaatatccatcagtaacttaatttaattagttatttggtatatcaactttcttttcctttttttttttttttgggggggtggagtctcactctgtcaccggactagagtgcagtggcatgattttggctcactgcaacctccgcctcccgggttcaagcgattcttctgcctcagcctcccaagtagctgggattacaggcaagcaccaccacacccagctaattttttatatttttagtagagacagggtgtcaccatattggccaggacgatcttgatctgtagacctcgtgatctgcccgccatggcctcccaaagtgttgggattacaggcgtgagccaccatgcccggccagtgtatcaattttctattgccacaataatgctgtgtaacataaccacaaaccacagtggcatacaataatgagcatttatagcttgtgagtctaagtcagctgtgttgattagatggatgtattgaccttggttgggattccttacatatatggtgttgcctggctataggcttagtaggctggccttggctggggcaactttgctcagttccttatactatagcaggctaaggtagtataaggtcatagtgtacaattctcagcttaggttgccaggagcctcatgtgtttctatttttttgtaccactgccatctacatttcatgtacatgagatgtagacatgaggctctttgcaacctaggctcagaattgtacactatcacttctgcttcattttatcaacctaagccagttaagtagctgagcctagtatcagagtgagagggcactacaaactgaaatgacaaagagtcagggatacagggagggatgaagaattagggccctctttgcaggctaccatttttggaaaaggaccatgatttaattttagcagtcgagtacccaggtccagctcagaaaacaccagaattttgccggaggattttgaaagcctcctctaagggaggattattaagacttgctaccaccccacaaggtgatgatgtgatgaagtcttcctcccaaaataaaagtgggccttaagctaaatctttagaccagtccacctgtgtgatggcagttgaaggagatggtgttgcaaatattatttaataattgtattataaggttccagtcctggacaggcaggcagacttctggtgctcttgatgctgtctgctgggaggaaggtacagaattccagctaaggtgacctctctttgttctgcctggaatgatctggcctctcccctatcagccactttgtctgggctgctgattcctaaaatgaaggagtcttttccaaattagtatcatcacaaccacaggagctgtggactgaggacttgtcattacataaaataatgacattgtcagctgtttagggttttttttttttttttttttttttttttttaaagacaagggtcttgctgttgcccaggctggagtgcagtggcacaattacagttcactgcagccttgacctcccgggctcatgctgttctcccacctcagcctcccaagtagctgggactacaggcatgcaccaccatgcctggctaattaaacgaatttttcatagatatgggggtcctgctttgctgcctaggctggtcttgaactactagcttcaagccatcctcccactatggcctctcaaagtgctgggattataggtgtgagcccaccaggcctgacttttagaaagctgatccagttaagtaacacacctctgcacattgctgattggctgtttcttttataatctaaccatctgtagtctgcattttttttagatcaatgctttttaaagttgaacatgcttacagatcacctgtagttcttgtaaacatgcagactctgatttaataggttgtttgggacagtcctgggattatgcagttctacccaggtcccaggtgatgagaatctgctcgaccatggaccacgctttgagtagcagtttagagttagcctctaacttgggtccagctgaaaatatttctttgaatttactaatggtagtaatgaaaagatttgaaggcagcaaactcattttaaggtcaaaagtaataaaattgctgttcattccaaatgaaggaaagggttttcttagcaaaactagaatgttcacctttaaatgacagcagggcaagtgggaaaagtgcacaacagaaattcccaggaatgcagctctccgttgagggaagagaggttgaacaaagggatgtgaggtgtgccaaagctatcatggctgaaagtcagctctattatttttcacatgtgtcattttggatttgacttgtataaagactaatattcttctgctgatgtttccacattctaaaggaagatgatctgagattatgccccagtcatttcgtgggaacaaaatgtgaagtgccactgtgtccttgctgtactgtcctgaggtcatccttgacaatgtataaataagaacatgtaaagcaaactggaccagaacattgggagttaaaaacccgctgtaatgatccccccaaactgagaggctaggtgatcacaggtaaaggatggcttaacttcagttaaataaggcaaaggcagacctggatagtgagaaacactaacgagaagatggcttttagaattatgctcacttgagttttaattcgttctccatcactcaccagctgtgtggcctttggcaagttatttaacttctattggtctcatttatcatcatctgtgaaatgggtataataatacctacaaaattgttttgttttaaataagttggtatatacaagaagcatcgatttacacagtgaacgttgtccctaaaagcttaggtaaagcaatatattgcagaataaggtacatagtaataagaataatagcagcttgtaaatggtgggaatggcatttgatgccgagtgatctgacttcagagccagtatttattaccactacgctaccctttggatatcattctcacttaatgttagcaactctccctgattctgagctcttgttttataaagtacaatgatcctacctgaagtcctaaaaagcaacccagggcacagagtagaggtatgagagtggaagtcagacagatatgggttcgagtctacctctgcaactgagtggtgtggctcaggacaagttacttaattgaagtcatattttttcctcatgtgaaaaaaaataaggatagagattttatcacacatatttggaaattaaatgaggcacttaactattaccaattacattatctgcttcacagtaaatgtttaacaactgattattgtaatttctttgagtaataggtgagataattttccgactcaattgtagaaatttttactatgcattcacatattatggagttttacacaaaatggaaaaataggtatgttctctcctgtattttaacaataacagcatctcaggctgatgaacaggttctgtttttcttgctgaccatccagtgggggaaatctggtttgaggaaagtgaaatcctttatgatgaatcaggaaaaacctccaaaactatgttttcatgtcactattaattcgttattaaaacatcatggaaactcagaaatgcctgcctagggacacagcaggataaaataaacatcaatatattcctgcttgctgctgactcgtacatctgtggaggaagtggaaaatccatttgagatgtgccaaaacacagcttaaattggctcacacactccaaacagacaaactggattttatcaatggcatcatccaaaatagtcaacagcagtttgactcaaacctccttggtgatttcatttgggggtaggaaattatatataaagtttgaaacgttttcagatccaaagacctgtttcaaactgatccattagaagaaacagagggttattttattcctactttcatttgagaaatagctttatattaagaatatcaaacttcccaaacataatttacgaagttgttagagaagagccatttgcacctaaataaccaaaggaatatgttaaaagcatcaagaaaatgggaaaatctgaaacagtttagttcatttatactttcattccacaatttttcttttcttttttttttttagacggagtcttgctctgtcacccaggctggagtgcagtggcgcgatctcggctcactgcaacctctgcctcctgggttcaagtgattctcctgcctcagcctcccgagcagctgggactacaggtgcgcaccaccatgcccagcttgttttcgtatttttagtagagacagggctttaccatgttggccggggtggtctccatctcccgaccttgtgatccacccacctcagcctcctaaagtgctgggattacaggcgtgagccagtgcgcccagccaccacaattattcttgagcctctatttttgccacatgttttcctgaatacttgtatgcctgacattcccctagcaacttcatatgtattactaacttagtctttatcaaatatatatcagatgaggacttttaagaccccactaataatagatgaggcttggctattgtaacttaacgtgcatttactagctagtgagtgttggatctgggaaggtgaagtcaggcccgattctagaagcctggctttaaccatcaccctgtgctacctttcaaaacagatgtgatcttgccctcctggaacacccaatctagtaggggatatataccatgagtggggctataatgaaaaaatgcagggtatttagggagtagctatgagggcatctaacctgtgttccaggtgttgtgtgaggtctctgaaaattcctaaatggaaactgatgaatgagcaggagctggtgaggctgaggagaaaaggaggagaaaagaagaaagaaaactcatgacttggacatgagtgatgagatctggctgaggaactgaatacagttcaaagtggctggaattgagagctaaggatgtggacctggagaatgataagtctggagaactaggggtggaggtcttgagtttgtgtctcaacttccacatttattcactgttgataggccttgggtaagggacttagtcttccttaactccatctcccatatggataaactgtagctatactgtcttcacaggactgtggtgaaattgcacaaaataatcacagatatgaaactacattatttcctgtagtacttacacaacaattaaattgaaaggagatgactgaaattgagctcacttgtttttcatctgtgttttcacttgtgtataacttttactaccacctactttcttctccagaccttatggaataaggaattatatttttagttaagttctgcccatgaattagcccatccaaatgatcttaagcaagttatcttccaacctaggcctcagcagtatcaaatttaaaatgaggtggttggaccttaaagccttctgagtgctaacattacataatctatgaaagcatccagagcgagattccttggttcaaatcctggctctcccatgtatatgctgtgtgatcttggacaggttacctagcttctctgtaccttaatttcctcatctgtaaaattaggataattgtagtacctatctcatagggatattataaaaagtaatttttatttagttggagtctcgctctgttgcccaggctggagtgcagtagctcattacagtcttgattttttttttttttttgagatggagtctcactctgtcactgaggctggagtgcagtggcgcaatctcagctcactgcaagctccgcctcctgggttcacgccattctcctgcctaagcctcctgagtagctgggactacaggcgcccgctaccacgcccggctaattttttgtatttttagtagagatggagtttcaatgtgttagccaggatgatgtcgatctcctgaccttgtgatctgcccaccttggcctcacaaagtgctgggattacaggcgtgagcaactacgcctggcctacagtcttgatttcttaagctcaagtgatcctcctgaacagctgggactacaagcatgtgctaccatacctagctaatttttaaatattttttttgtatggagcgggggtctcactgtgttgcctaggctggtctcaaactcctggccttaagagatcctcccaccttggcctcccaaaattttgggattagaagcatgagccaccgcccccaggttgacaattaaatttgtgtaaagtgcttataacagcacttggtccatagtaggtgctattaaaaggtatttatcgtttttatggcctagtcaagtcacataacatcaatatatgtgtactgaatacaagccaggctcctgtgtcatcagaaagcccaaagtagaacatgaatgttggatttccttcgttagtactcaacagagagcaatcagcctagagacattcatgcagaggtaaactctggacagcagtgaaactctggtgtgataatgcccctaagaaaacaggaggttaaaaagcacagtcctaaataataaagagccacagagtggtggggggaaagctacttggaattgagcctactggggaaccttggttcctttcagaacacaatactgagtgagaagtcccacggtcagctaaacaattctcacacaaaggagcagaaaatataaacaaaccatatagacaggaacaacagcatgaaatggtcagaaaaaaattctcgtaggagtccaggagcatgccacagagagcaagagctgcatgcatttggaggtctaaatgaagcacttggcaacgtgagcagaagccccacaaagacagcccccctcaccatccagtcccctgtctgctcttcctttatggctggctcattttagtgctctggagaaaagtgtccctcatgctcatatcacaaatgtcagcacagcagtgttgctgtttatattagaaggataccgacctcttctaggcacctcagggcttagcctacatcacttaatattactaacaacctttgaaggtaggtatcattacttttcaattacacatgagaaaactgagatttgcagaggtgaagcagctttcaaaaagggtggcagagggtggatccaagcccaggaatgtgtctgattccagcgctcgcactgctggaatgatctaccccgtgctctctctgggtttgcccccaggtcatcatctgcaccaaaggcattcacatacctgaccaccaggggagtctgtgcaaggcacccatgctaggatccgcaggcacagcccacagccgatgaaagcaagcaggcaaacctaaagcccaggtccttctgagcatggttcggaggcatcttttgccctcacagggtagttgtctcagccagtggcgcgcacagcgcttgattagtctttctcaaaccaccatctgaaagccacggatgagatgagaatgagggcacagcgaccagctggttcatcacaaggtcctcagcaggatccctatgatcccaaggcttggtcctggtctgaatctttataggaattcttactttgggggacaggatgttttgctattaatttctaatttaggtgcattctggtcagagaattttgttattaacagagatgtgctttgtggataaacaggcaatgttctggtaaataatgtgtatttcaataactgagcaaggggttaatgaatattcaacagatctctaatagtgttattaaaatcttctaaatatttccttagtaattttcagtctttttgattaatttctgaaagtttccaccgtgttcacggatttgtcagtttctttaattctgacactttttgtttcatgagctttgaaattctgttgttagatgcatatataatttcaggattacaatatcttcctgaacatgacacgtgaataaaatctaacaaggttttatcagttagtagatggttctgttttatcattacataatgaccatctatatccctaatttttagctttataataattttttctgtataaatgttgcaatactagctttatttagtattagtttgctatatatttttatatccctttattcacaatcttatgtgccattatgtcgaatgtatacttcatgaaagagcacacagttttatgtgtgtgtgtgttttagaattgagattctagaatctaagattttctgatctgaatttgatgtgagctcctgtcttttaacatacatttggcataatgtctgccaccttatcctatcttttccacaccatgattttctctggtcctttttttctcattttatgtcttttgtttccttatcttctctcttgccctcttgttgaggaaagttagatagactgtttctcttcctttagtggtgatccttatattgttaacattggcttaacttaaagcctaaagctaatgcctccttatgtcacagagtttggctttctgcagattatgatataagttaagggaattcagaaactcttgttgctggaagaaagttagaagattttattcccatatcttgtccaataagccaagggaatcagtcaatgttgcatggcaagcttgacacagtaacagaaattttcaatcaattggcttattttattttattttatttttgagactgagtcttgctctgttgcccatgctggagtgcagtggcatgatcttggctcactgcaatctccgcctcccggattcaagcaattctcctacctcagcctcccgagtagctggaattaaaggcatgtcccaccgtgcccggctaatttttgtatttttagtagagatggggttttgccatgttggccaggctcgtctcgaactcctgacctcaagtgatctgtctacggtggcatcccaaagggctgggattacaggcatgagccactgtgcctggccttggcttatgattttgtaagtcaaatataaaataattttcccagttacatgtcagtactgtccagttccataactgtgtcagttcatacatatataattaaaaggtagaaggcaagatattagattccatccttgtctttattcttcaatcttccaatatttacaccataagtagtaagtccagcattttgctcattttatttgagcaacgcatggggcattctaaagcaattagaattatttggaacaacagcaacacaaaaggaccaggggaaaagccatttggtaaattttttttctctttcactttggggaaactcagatttcattcatgttttttttttcccactttaagaatacttgggattggagaaggatggcagattcatagttaatatagtttattgttagtatcaggacttagtttgataataggtacagtttgagtgttccaaatccaaaaatctgaaatctgagatgctccaagatccaaaaatatttgagagccaatttgatgctcaaaggaaatgttcattggagcattttggatttcagattttctgatttgggatccttagctggcataatgcaaatatttcaaaatggaaaaataaaatctgaaacacttctggtcctaagtatctgagataagggatattcattctgaactaatcaacacaaagtcctcatctccccaaccactgaatagaaaaattgtgtataggcatattgtttgtatatatttacactcttataaaggaagtgaccatccctttcatcagattcttagaaaggtacataatgttaagaaaggttaaaacgcattagccaccactgtttttcaccttccaaaaaccatctgacacctagcaagtgccagccctcattttctgagtctcaaagctcaattgctcctggagaaaatgtgtgatcccatttttggtatttgttttctctcttttaaaagcttccttcctaccagctactttaactatgactgtggacaagggagataacgtgaacatatctttcaaaaaggtattgattaaagaagaagatgcagtgatttacaaaaatggtgagtatgtgtttcattgctttccccagtatgatgtgagatatcagataacatacaacatattgaatcattttcctattgtggtcttgtgggcagatgtttgaattaaagctgctatgatgcaagctttcaaattctgtgtatgatagaagccctcttaggtgacatatttggttacttaaggatattaaagtggaattcatatatatgaatgtacatggtgtatgtacatacaataaaaccccatcataatgtgagatcccaacttcagccatataaagtgtgagtttctttgattgtgacattgttgattgcaaggtttaggaaattaccacagtaaacatgggaagccaattgttagcagttctggcagtccaactgtgtaatccaaatgtgtctaggtcctagctatggtttcgtaccacccagtgtcagttgcctgatccagctggaatattgatggggatcattctgaagtctgtgagtggataggacttccagattggagtagcgattatagatatctcctggttaattggttagttgacagggttacctatcatttttcacctaactttgcctgccaactatgttcgcctctccctgtagaatgtaagaacttagaccacccccatcttcatgtgtttggtggtagatcccacagactaacctatctgttctatcactatgactttcttgactattgagagagtactgaatagttcagcattttcattcttctcccacatccaatatgtgagagcacattttcttgaccatgtcagggaaagctaattaagtggagaaaccagacaaggaagcaggtatgtttcagtgtgacctacggttcttcactcttccctcttactaggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagtaagtgatggagaggccaccatttgtgatggtgtagttgttaggttgttaggatttttagttgcaaataacagaaactaaccatggcttcttaagcaaaaaccaggcattggttggaggttgtattagtctgttcttatgctgcaaagcaaatgaataagagatagcaatcattagaggaatgacagagaaacccaggtatttagacctgaagacttaaatatttaatattacaaatacttgatacagctggggaaaactcagggcaaatcattttcttttctcagggcaaatcatttctaatttcacatgctctttattgagacatacctgagactgggtaatttattaagggaagaggtttaattgactcacagttcaatatggctggggagacatcaggaaatttacaatcatggcaaaagaggaagcaaacacatccttcttcacatggcggcaggagagagaagaatgagagtgaaggagagggggaagcaccatattaaaccatcaaatctcatgagaactcactcactatcatgtgaacagcatgagggcaactgcctccatgattaaatgacctcttacctcctactgggttcctcccacaacacgtggggattatgggaactacaattcaagatgagatttgggtagggacacagccaaaccataccagacggggacactaaggactcttaataaactgatgggaaagctgaaaagtggctgggtacggtggctcatgcctgtaatctcagcactttgagaggccctttgagctcaagagtttgagaccagcctgggcaacatggcaaaaccccgtctctacaaaaaatacaaaaattagccaggcatggtgatgcatgcctgtagttctagctatttgacaggttgaggtgggaggatagttcaagctcgggaggtcgaggctgcagtgggccaggctggttgaaagagcaagaccttgtctcaaaaacaaaaacaaaaactataaagcaagttccagaaaagataagcttcaaggaagagctgaggctcagttgtggtgggtgtggggaggtaagggagtgggctttctctctaagatgctgcttttaccatgtctcagcttcagcaatgtttctttcacttccaaattttgaatttccaggataaataatcagattggcctaacatatattagatgtctatcagcctagaccagtgagctatagacaagggtggagtcacgtactacacgttacaggcactagaagctcacatttgtacagcataatcatccatataaaaagggggatcacaacgagtaaagcagtctcactgaaacgtgtctgctctagggggatgagttggacctcttgggttagactaacatctgcttaaacattgcctcctgtaaatcccacacttcccaggtcatttaactcttatgtgtgatttttattttcagttttgaaaaatgtaagagttagaactagtaaaaactttttttctccattataactattgaagtgggggcataaatatcaccattacattttcctgtaatttttacaggaacttcacaaatagaaagaaaatgatttgccctgaattttccccagctagatcaggttttcataatattaaatattgaagtcttcaggtctaaatgcctgggcttctctgtcattcctctaacgattgccatctccaattcatttgctttgcgttatgttcccccattcatttaccaaaatgtgttggtcataactctgtgccaagaattgtgttggtgttgagaatacaggatcataagataaatccgtgtcctttgggtcattcccaatcagagtaggcacgtgtataattagctaaataaatattgaaaaatgacaatagaagtatgagaagtgtggttcctctagtttatgctccatgcttagccacctctatggacataaaatatagcaaggtgttttataggcaggactatttgggcttgagtcgaggggaatctttccacgtacccaagacctatttccttctggatgactactgtgcttgacttctattaaatgtcagagcagcctttttgtaatatgaatcttaaaaaatataatttatgatgatagcaaaactgcaatattcagcttctagtagcttgcctcacagctacctttacatgaagtttctgtggacttgggagaagcaagtgacatccccttttattccactactcaggagagtctgaatgtcaaggaagcaatttgcctttatttcatttagctagtttctctggagtctgatataacaccatgtactaggtgtactcagagggtaaatggggtacatcttctaggaaggtcagacatacctatacatgttgatatatagttgtttgagataggaaaaccaaagtgtttttcctaatctctgctctcactgaacacaacacttctgacaccaatgtgcacagattactacgccacttctagaatttctcattcagtaggtcgtggttgggtgggatctggggtttgcatttctaacagattcccagatgatggggatgctactggtcagagaccacactttgaaaaccacagctccagcctgtaaccatacctgcagctccctggacatgccatgctgtcttcccatgccttgtctttgcctggaagacactctccagccttatcttctttgctacttagttggtcctgcagattcagcttgcataccatatcctctgggaagccttcctttatgccctcttctatccaccagacagagttaggtactccttgtctttgtttctgtcgcgatttcctgtttacatgtctgtctcccatattagatgatgagcttttagagagcagagcctgtattttatctttattcaccattgtccactgaatgactgacacacagtaggtgctcaataaagatgtgttgagcgaatgcgctctactcaccacagccttgttttccttaacaaaaggatgtgaagcccagaagtggggacctgaatgcaaccatctctgtactgcttgtatgaacaatggtgtctgccatgaagatactggagaatgcatttgccctcctgggtttatgggaaggacgtgtgagaagggtaagtaaagagacttgataagtaagctgtggatttaaaaagccatcgttgctggatctagaattttagatctcgacacagatgggaatggacgctaaatggcctctgttaggtcagatggtacctgtgtgtgaattagaaaaaggtgccttttcctaaaggttctttaatgccaaccactggaaagttataataaatatacagatccgtgatgtttacagtgtgaatgctgccccctaggtttgtgcactgcacaaacctgcatgattgtgagtgatgtccctgatgtctgctctgtggggcagtttcattatcagtaaaatgggccataagggtatgttcatcctaccatgccacagctgagatttgactgtttcccatattcactagactaggagaaatgaatctaaagaattatgtatttcaaggggttgcatatttgactctgaatcatcttttcttttcctcccaaagcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggtatgcaccaatcacacccttggacagaggatgttctagcaggtatataaaggagatccagtttgctgtcaatcacaacatcggatatacctggactgcttagctacccactactggacaacaggattttgaatcatggatgtttacatccaatgttaattatactttcacagtaaaaatctagaccgcatagaaagtacttctcataactatcatctggggatctttactaaagcacggattctgatttggtaggcatggactggggcccgaggttctgcatttctaacaggctcccaagtagttccgatgttactggttttcagaccatgctttgagtaggaagaccatagaagacttgttttttttttttggttttttttttttttttttttcagtgaatcataaaatcacagctttagccaggcatggtagcacatgcctgttgtcccagttattcaggaggctgaggcaggaggatcccttgagcccaggagtttgaagctgcagtgagctatgattgcaccactacactccagcctgggcaacagagtgagacctcgtttaaaaaaaaaaaaatcaaaatcagagcttttatgtcagatccagacaggatttggggctcaaaaattgaagaagttaaaatcttacctgccgtggaccttatgcaagtagtactaacatcatctactcagagtccctctgccctttgtaaaataagctttcccatttgaccaggctctgtggagtgcatctgacatccacttttcagtatgcatttcacatctactgttgcatagtagctcaacatgaacctgcagacaaatgtgacagaacctccctaatgtatattaatactgtgaattagccagagctcaaaggcttttcagtgtttatctcacaaagtcagcttttcccatatccggcactaaaggtagctacgatggggtcccagcaacttgataacaatgctccagggcagagcagttcagtagaaatataagccatccacatatagaatttaaaattttctagtgtccacattaaaaaagtgaggagaaataggtgaaataattttgatctattaacccaatatgttaaaaacattatcagttcaacatgtaatcaatagaaaaaagtattaatgagatattttacattccctttttcatagtaagtctttgaaatttcagtttggactagctatattttaagagttccatagccacacgtggctaactgtactggacagcatagctccaggggcttggaggaggaggacaaagaggagagttacacaaaagtaagcttcagccacctgcaatacctcattcagttccctctaaatgctatgtctgccccccggaacatgcagtgagccacagcagtggagaaatcccatctggcctctgaagtgtgtatgttaaggtaaaaggtgactccaggcagggggcagatcccttgtattttaaaaaaaattaaaatgttacgcaaactatgaacactttgctaggacccaggaagcggtgcatgccagcagtctctagaacataaacttcatcagctttgtagtgaatgtgtctctgggcccaggtttttttgttttttttttaattctttttattattattattattattatactgtaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgttcatgtgttctcactgttcaattcccatctatgagtgagaacatacggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcatcatgatttataatcctttgggtatatacccagtaatggggtggctgggtaaaatggtatttctagttctagatctctgaggaatcgccacactgacttccacaatggttgaactagttttcagtcccaccaacagtgtaaaagtgttcctatttctccacatcctctccagcacctgttgtttcctgactttttaatgatcgccattctaactggtgtgagatggtatctcattgtggttttgatttgtatttctctgatggccagtgatgatgagcattttttcatgtgtcttttggctgcataaatgtcttctttagagaagtgtctcttcatatcctttgcccactttttgatggggttgtttgtttttttcttgtaaatttgtttgtgttcattgtagattctggatattagccctttgtcagatgagtaggttgtgaaaattttctcccattttgtaggttgcctgttcactctgatggtagtttcttgcccaggtttataagagtacatttcatgaactcatctcagcccattcctggctcaagaaatcaccaagattttatgaatagaactgttctaatattcttccagactcctttcaacaattactatcctgttcattccatccaaaaagcagtaggaaagcaaggagacatttctaacagtaactacttaaggacatggtctcctttaatagtccaggatttagaatagtcaacaatagattgtacactggcaagttttatgtatcagggctggtttctatctgaggaaataagcaataatagaaatttttgaagcaaatagtggggacaataaagagaacaggggaattccactgtgcaaatatgtgataattcaaagtcattcagaacactttgccaggaagaaagttctagtgtattctagaaactaaaaaaatcaaggcttcatgatattttaaggtcttctgccatcccaacagaaacttgatttcagtagtcagatttcctttatgcttattaatagttcttaacctttctaccatctgctttgagtaagaagttgtgattaagtttttttccagctttatcaaggtctaattgctaaataaaaattgtatgtagttaaggtgcaaaatgtgatattttgatatatctatacattgtgaaatgattactgctgttaagctaattaacatatccatcacctcacacagttatctgtgtgtgtgggtgtggtgagagcatttaaaattgctcagcacatttcaagtgtacaatacagtaatattaagtttagctaccacactgtctattagaactccagaacttacttatcctactgtgtaattaaaagtttttgccctttgaccaacatctccccatttcctccaccctgtagtccctgggaaccactatgctactctgcttctataagtttgactttttcagattccacttatagaagagatcttacagtattggtctttatatgcctggcttatttcacttagcatggtgccctccaggttcatccgtgttgttgcaaatgacaggatttccttcttttcaaaggctgaataatatgccattatatatgtgtacacaccacattttctttatccattcatccatggatggacgaatggtcaagtccatattttggctactgtaagcaatgctgcaatggacatgagaaaacagatgtctctttgagatagtgatttcatttctcttggatatataccagaaatgggattgctggatcatatggcagttctattttgagtgttttgaagaacttccttattgttttccataatgactgtaccaatttacattcccaccaacagcatacaagggttccctattatctacatccttgccattctagcaggcgtgatgtgatatctcattgtggttttgattttcatttccctgatgatcagtgaggttgagtatttttcatagacctgttggccatttgtatgtcgtcttttaagagatgtcggctgggcacgatggctcatgcctgtaatcccagcactttgggaggccaaggcgggcggatcacctgaggttgggagttcgagaccagcctgaccaacaacgagaaaccccgtctctactaaaaatacagaattagtcaggcacggtggtgcatgcctttaatcccagctacttggggggctgaggcaggagaatcgcttgaaccagggaggtggaggttgtggtgagctgaggtcatgccattgcattccagcctgggcaacaagagtgaaactccatctcaaaaaatgaaaaagaaaaaaaaagatgtctattcaggtcctttgtccatttttttatcaggttgttttcttgctattaagtggtttgcgttccttatatattctggatattaacctcttatcaggtgtatactttggaaatacattctcttgttccatacattgtttcttcactctgttgattgttttctttgctgtgcagaagcttgttagtttgatgcaatcacatttgtctatttgtgcttttgttgtctgtgcttttgaggtcatatccaaaaaaatcattgcccggatcagtatcaagaagcttttcccgtctgttttcttctagtagttttacaatttcaggtcttatgttgtgtctttagtcaattttgttttgagttttgaatataatgagatgaggttctaattttattcttctgcttgtggttatccagttttcccaggactatttattgaagagattatcctttccctgttgtgtgttcttcatacttttgttgaatctgttaactgtaaatgtgtaaatttatttctgggctgtcaattctgttccgttggtctatatgtgtgtttttatgccagtaccatactgtttttattactatagctttgtaatatattttgaaatcaggtaatgtgatgtctctagctttgttcttcttgctcaatattgctttggctattctaggccttctgtggttcaatataaattttagtatcgttttttctatttctgtgaaaaataccattgcaattttgatagtgattgtattgaatttgtagataacttagttgtgattgatactaaaaataaagactgcattttagctgggtgaataaaatacaaaatcaaaacaaatcatcatagccccaaaagacaagcttttgcattaatttttggttagaagccttctagtaatgttacagttgaccaaaataaggacacccagttaacagaatccatttgccatgtaccaaattctaagaattgtcctggcaggtttagtgagctccaagggaaaataatgcttctaccctgtcttcccaggagcttattacaagtatcaaaacataatttgaatggcttaaatattctactataaagaaacagtcttaaaaagctaacattttaaattatcttgatttttagtttttagcagtttaaccatgatgtgcctatgcatagtttactttatatttattctgctaagggcttaacaaatttttgaatgtgtaaatttcaacaaattgggataatttaaaccattatttcttcaaatattttgtctaaccctttctctctggtccttcttggacctccagttacatgtgtgttagatgttttgtctcttgggtccctaaggattaaaaatcatttttttccaacctttttcctacttttcttctttagatgggctatctattgatgttgcttcaagtttattgactctttcttttgttatctccattctgttgctaagtccatacagtgattatttgatttcaaatattgtgtttttcagttttagaattccttttgctttttaaaaatagtttctatttccctgctgaagtttctcattgttgcatttgttatgaacatatcttcttttaccttactgagcatagttattatagttgttttaaaattcttgtctattccaacatctgagtcatcacagttggtctctatttattttcttttcctttaaaaaacgggccttaattctccatttcttctttggattgtatcttgaacattgaaaatgttacattatggagactctggaatatgatacattccttttgggaatgttgattttgttttgttttagcaggcaattaacttggtaggattcaaacctcaaactctcactgttaggaatcaggtcaaactcagtttagttcttttatctttagctgggctgctttgagtctatactgagcatgcatggatcaaggatcagccaaagatctgggacttttctctgactctttctgggttttccctctctctccagtggctgtggttttcctgactctgtctctgatgcatcaggccagtagactgcaggttttctttggagttgtagcttccatacgtggtgtcaactgtacctaacagttaggctaaaagctgaaaattgggaaacacatcattcccatcttccaaatttcaattcccctccagaatcttccaggtcttttttcttcctatcccactcttaagtgctttcaggaagttattttctaaatgtagttgtacctacaagaaagttggcatgataggagctcattcaactttttttggaagcataactccccagctttttaagttcctggtaattcagataaattaccccctaccttacacaaatcagcaaagttgatggcttagagagaaaaataaaactaaacacctgcagtcttagtttcctctcttcccctggattaatactggttttttgatgtctctgtttacagcatgccaccctggtttttacgggccagattgtaagcttaggtgcagctgcaacaatggggagatgtgtgatcgcttccaaggatgtctctgctctccaggatggcaggggctccagtgtgagagagaaggtaaagcaaggtaacactgtagtcagggccatgttcagcatgtctgaactgagctttggtagtgtaattcttgtgccggcattctaagatcctcaagcctcttttgtttccatccagaagttgggaatagtttatcctaaatcctaaagcacagcattttaattctgctctactgaccctaatagtaggctttatttgtctttgcactaggcataaaccacgtgctctttgtagcagcttaagtgatgactggccagctgagagctctcctaccttttctgctcccttctctaggaccaaccttttccctggacatgcgtaacagagaaagagcaatttgggatggatttagacaggggatatttttaaagcaatagaaagaataaaacaaatagaaaagattatgctcaaaatgaaattttatgtcattctagttcagaagttactcttcagcaggagtcagcaaactttaacccacagactaaatccagcccactatctttttttaaacagctttatagagatacattttttatattataatgttcaactttttaaaatgtaaattcagtggtttttagtatatttacagagctatgccatcattgccataatctaattttacaacatattcatcataccaaaacaaaccttgtacccattaatagaaacttccattttccaatcatcctaatttctgacaaccatttatttgcagttgaccttaaacaacatgggggctaggggtactgacccttctcgcagtagaaaatctacatataatttttgactctccaaagacttaactactaatagccttctgttgacgagaagccttaccaataacatagtcaattaacacagagactagtatctgtatatattttatgccttcatgacatacctttttcttaatttttttggtatttctaggctacacagtttgtctgtgagttttttcaaattatcctaaatctccaaaaaattttccaatatatttattgaaaaaaatccacatgtcagtggacccatgcagttgaagcctgtattgttcaagggtcaaccatatcttctgtctctgtagattgcctgttcttgacattttatatgctgtaaacaagattgtataatacgtcgtcatttgtgactagcttcatttgccacaccttttttgaggtttatctatgttgtggcatgtatcagtacttcattccttttttatttctcaccatctgttattataaagaaaaaaattttggatcacagccacctccattcatttatagtatgtcgtctgtggctgcttttgtactacaagggcagaaaacatggcttgcaaagctgactgtatttgctctctttacagaaaatgtttgctatccactgtcgtagaatatactttttaaaattaaaagaagcagacatatgtattttcaaacttaataaatatgtattgctttttcaatcatataaatataaatgccattgaaataaatacatatccagtgaaatctacactcacaataatacagctatggcctttttttctgttacttttggaaatcagaacaaatattgggagtgggggtgggatgccagtaagtgttttctcaaagtccttaaactttatattttttcttcttttgccaagcctggactttactacagggcaggaatcagggagtggttagaaagggaaggaaatgccatggggctactaggggattgtattgaacgtgggcagctaacaagtttaaggatttgaattttgtgctttgttccttcccgtctgttcccttctgctgatgctgcaaaaggagtgcattctgatgggagaatctaagacaggttaaccagggtgtcactagggctttcagagagtagctcccttcccagattccactttagcccagcacatccaccttcacccccacccagcttcagaaaatacaaggggacgatgaaggaaagaaatgctttaaaagtgtcaaaacatgtttttcaattcctattcaaatagctacttaggctgaaaaacttggcacgttttccataatctttccaagtttacagatatatcaaggaataaccttgtaagtattagacctctttcccttctcctccacacctttacccatttcattctaggcctgagaagtaggatatcagtataaaatatcattattgaccccgcctcttcccaccaccgataagaaacagtctgtagttactgctgctctgagggcacctctatcgcctacattgtttactgagtgttggacaattttcaaacatgtctcacattcaattacaaatagtccacagttccctgagtccctatggttcagaataaaattggtatatttcagggttattcattctctactgtgtagatgttaggcaagaaatcctgacaccattacctttattgacactacagacatttttccttctttcaatattggcagcaacatttttgatttggctgttgagtggatactgatttggggaagttatatttcacttctttgatgtacttcttttgtgagcaactttattcaccttttcctcttagttatctgctatttgcagacttcccaatgaatgagacatctctcgtatatctaaactgaggtcaatgctgttgaacagcaataccatggggttatttgatgagtggaggaagaactagttttttgtttgttgtatttttgtaatcattcatgtaaaaagaaagagggggattgaacagcaaagtctaggggagatatggccatgataatcattttaatattgagactgttcctccctggtccatgaaaggagcacagcctcatggcaaagagcgtggactctggatttataaagatctgagtctgaatctgggctgtgagcctctgtctcctcatccataaaatgggagaccacaatatcatccacatcacaggtgtcttatgtgatgacaaaacagtaaaatatttgcaaagttcttgcccggtgcatgacttactaaagtagctatttttattattactactgctgctggctctgttaaatattagatttcacagtgctgttttcttccttcaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatgtaagagccattcttaatttgcccttcttaaagcatgagatgcttcagtgtagtaatcaccccactaaatgatagataccattcagtgcttttatcctcctaggctagtgtgttgttggctttgataaaatgccctattcctggagaggcagaactgactcactgcagcctcactgatttcttctgttggccagtactgctctgcatggttgggaatatgcctcctggggaactgacagagctgggtgccaaggatggcacacatcctgcaggactgtccagctggtatggggagaagtacgtgtcaatctgtgcaaagctttgctctcgcagtgtccccatatctctaactactcatatcaggagagtaaggtggtgttgcaacccatgaatcagcagatttacgtgctaccaagtgcaaccaggacatggagttttgatgaccggtccactcctattacgctctttggagcagcagtttaggggagcatagaagaggagagttccccagttctgaaactacaatccacgggatcccttaggtctgaatgcattcattgggtttctacccacctcttccctttgccttcattgctgatgctcacccatggtcaggtaatatcacagcagttattttttgtttaaaaggatcaagctacttttcgaacatgctttccttctctctcccaactataccaaatgcagcagagacaggagccaccccaaatttctcttgtgttgaaagtgatccttaggatattgatgtattttttaatctaaaaatttagaaatacttattatcctatttttctatcaaagatgaccaaaatcagcttgaccagaggcaggtatgagtgaccttctgagggaggaatatgtagaatgtaccattactagggtccacgtttcaatgtccctgattccactcaaacaacccatcaggtagaagaagccaattgatggcttccaaaatcttattggctttttcatgagttaatgaaagtaatggctactatttagtaaggttggccataactatatgtaacttcttacttaacattgcctagtgtctcttttttttggcggaagtgggaactggctgggtgaagttaagtaactaaggaattggtcaaaaatggcaaagaggccagatacggtgactcatgcctgcaatcccagtgctttggaagcctgaggtgggaggatcactttaggccagaaatttgagaccggcctgggcaacatagcaagaccccatctcttaaaaaataaaaaaagaattagctggacatggtggcatatacctgtagtcccagctacttgggtgaggtggggggatcacttaaggccaggagtttgaggctgcagtgaactatgatcactcaactgcactccagcctgagccaaggaacaagactttgttgtctctcaaaaaaaaaaaaatggcagaggtccatctctcttcagaaccctggatttttccagtactccccacttgacagcctctcaaacacttaggaagtcactttgtcctcccacgcagccatctctgtgttagataggaaaggaacaaatcttatgaggaggagtttaaaagaaatcatgcttcaggtgtcttgcttgtaagtgtttaccccgtactcctaaacacacaaatacaacagcaggatctgacagggcatcaatccaaaataaactttcagggctactacaatagctttggaaataagccaataattatattagcattacatttagcttcttgatctctcctaggaaacttcttattaaacaatgagatggggtcaatgttatggacctttgcgtttatgcctccctagaagtttttatttttttgtatttgaccttttcagccaaaagactttaaccatacggatcatttctcagtagccatattcaccatccaccggatcctcccccctgactcaggagtttgggtctgcagtgtgaacacagtggctgggatggtggaaaagcccttcaacatttctgttaaaggtaagttcatttcccagaaaaagggattgtgtccttgatgcattatgtttttgtattgctgcttctagacagaaatgtatgcgaccactaaaatacctttggggtaatttccaggatagtaagcctttaaaaaattatatgcatgaaactagagtgaagaaattaagagtatgaactgtggagtcacacagccccaggtttgattttgtccctaacagctcataatcttgtgggtggccttgaccaaatgaagttacctttttgagtgtctctgtatttgcaaatgaagcataatttaggtacctcttagggttattgtgaagccttgttaaacacatacaatacttggagttgtgtcaggcacaacatatctggtagtgattatatttcacaagaaggttagcattgccgttgtgacttcctgttcattattgtagagaattatttggagaatccctattttgaggattactcacttaataagaagcccaggctatgctatataattaacatgaatgtcttttcacattcagggctgtgggcatttttcctgctataaattagtatttcaaaattcaaattaatctgagtgtttgtgtgtagatttgtggcttgagtggaagaactaaaatggaggtaagtccacgttaacttggctggtgtacgtagctacagcaaggaattttaaatccgcaagttacttaatcacctgtttagacaagaatacctaacagctctctggcatatattctaggaaagatactaggctaagattacttgtaatttctgatacattgtaaatgctctgtaaatagttgctatcctgtattgtttagagaataatgagaagaaaaaaagtctgtacatgttcagacacaatttgttttctgaatatttttgatccacagttggctgatccacagatgtgaacccacagatacaaagggtcaactttatacagtagcacacattgtaagcacaaatcttagtattaaacctggatcttctgactccaaacccagcactatctcttctggaccattttgctttctgagtctcttgtgttacagaggaggagactgtgaggtgaccaaagttgatttgtatttggccccctttcgttacttcattagtaatctcttgggagatctcagaggtaacttctataaatgaaatgctgtaaatactcagaacataatctgttttttaaaggccaataacaacagtagcgtaaatgcaaccccatagatttggattctgtgccctgagaatccatatgaaccacctcagaatcctccttcttattattacttttggttataggaaagagcccaaatctgttttatttggtagaacattcacgtgattaaaataatttcttgcatcttgaatgttcttggaagaaaggaaatgatatgcagacaagaaaaattaccctacttttaagcttctgggaatgtttgctacccatggacatacgtccaaaacaaaccatgtggtgaatacacagaagagtcactgggtctagtttttagtttgtagtgaaagacacggcacacaacatcaatgtgtagaagcttctccagtcctaagtcactgctgtctctttgctgtcacattgactggcagccataaaatgtaaatagccattagggaatttaatcaatttaatcagcatcttttattatagtatttacaaaaacagatactaggctttaacaccagtgtacagattgatacagtcactttggaaaactggcaacttgtactaaacctaaacatttacttagcctgggaaccagcagttccacccctaggtatatgctcaaaagaatggctgtattatgttcaaaaaagacatcttcaagaatgttcagagcagttgtattcatagtagccccaaactgaaattaactcaaatgtccatcaacattagaaaggatacactaatcacaaattgtagtatattcatatgtattagtttgctagggtgccataacaaaatactacaggctgagtggcttaagcaacaggaatttattttctcataattctggaggctacaagtccaagatgaaggcatcagcagagtttatttcttctgcggcttctctccttggcttgtagatggccactgtctccctgtatcttcacagggagattaaattaggacacaggtacagggtcttccctttgtacttgtgtcctaatttaatcctcttacaaggacaccagtcatattggattatggcaaaccctaataaacttattctaaattaattacttctttaaaggccttatgtccagatacggttacatcctgaggtactaggggttaagactttaatgtgtgatttggggggaatacaatttagcccataaaatcatgcagaggaatgttaaacagtaataaaaaagaattaatttccgcaacagtatggatgaatcttgcaaacatgataaccagtgaaagaaagtacatgctttatgattccatttatataaagctaaagaacaggcaatactaatcttcagtcacagaagtcagaatagaggctacctctgggtagaggatattgactggaaaagggcacacaggtgccttctggagggctgggaatattttctatcttaatctgagtggtggttacatgggtgtacacataggtaaagtcccttgagctaaatacacttaagatattcacgctttacaatatgtatgttccatctcagtaaaaatgattaaaaggcaaaaaataaaatagtagattactaagaggaagcctttgtagcaatttttaaacccttgtagaagtatcacagactgacattaatggctgtaataaaatgtgcatctgctggtttaaagaaaggggtggccttattttatcatacaaggaaagcattacttgaacaaatttacttacagcactgccctcctttctagcctaagtgaaatgtgtactcagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgagcaaataaataagtagaatgtacagttcacgaaaatgctgagtgtcttggagaaaattaaagcagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaacgagttatgcatttctaagaaggctgggccaagggaactatagagctcattggaaattcacttcacaaacaataactcagcacctagtcggtgctggtgaacaaactacacagtctttgccctaatggaatttagagtgtagtgtggtgtttcacaacctttttattatcatcccactaaggagctcttttagaaattgtattccagaactctccctcatcaccataagattttattatcacagatgtactttatatctctttatgtactatggctctttggcgggctgcaacccattgtaatatctaaaatttttgcatcctccaagaaccaattttcattgtttctggggcgctgtcatccccattgagaagatgtggtctttgagatggggagattgttctagattatctgagtggacccattccaatcccttgagtcattcaaagtagagaaactttcctgacaatagtcagagatgtggtggtcagagaaggatcagagaggcctgatgttgtagactttgaagggataggaaggagccttgagccaaggaatgcaggcagtctctagaagctagaaagaacaaggaaacagatggtctcctaagcctccagaaaggaacacagccttgctaatgccttaattttagcacagtgagatgcatgtctgacttctgacttctagaactataataaatttgagttgtttggctgaaagagagagatatatatatatagagagagaatgaattatgatctagaagaaagaccaatatcaaataatcaaataatcatactacaaagagtaataacccctaaaaatcaccatgaaggaaaagtagaggttctgtgaaagtatacaataccttaattcagtttctatgatagccacctgtgaaatattcacatcagagctaagaattaactgggagaataatgggaggtggagcattccttgcagaagagagacatccacaatcaatctaaagaaaggaggttcgtgctttgttagttggatgaagtgaaaggtcagtgggactggagggtactaggtgaggggaagaggaggctggagagtgggcaggggcttaatcactcaaggcctggctggtcacgatatgaatttttggttttatcctacatgtgatgagaatccattgaagggtcttgagcaaaggggcacatttattttaaggaagcactttgaggataatgggttggggaagcaaaagcaaagcagagagcttagagagcaggtgatctcactgagtctgagcagaaaactttaagaggactttgttggacatgtaaaacatatcttctacctctacctaagaacaatcacaaaacctcaaagccgaaggactaatctgccttctgaaattgtatttagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaaggtaagctttggacaggatagatgccagctggggatgtggcaccaggagaattatttttctccaaatctagaaattcccttctccctgcctcaatcctctacctcaaggtggtggctgttgcagaggattctgtttcagagtattcaagagagagtgcagggggcccctgagctctggggctaactttctgaagtcactgtgcgctctagaacacagaaccagctcacaccatgagttactatctatatcaatatttctttttggatctccagtcctgtttttagttattctatcttggctggtcatggggaaaggcacttgtttatgccatgaatatggtagcaggaaagtccagagcctgctggaagggcagagaggcttaatctgcctaaatcctgggggtgattgttgctgctgtattgagttgtttattccttttctcatttcatgtcttgccctgtcctgcagactcttaacacagagagatttttgaaggaatttgaacctgcaaagtttgggctgtggcagactggaatgggctcgggggaggacaaggacaggcaaagggagctacagacccctcccctaacttcctgaaagaaaaaaataattgaacaaaatgtgacaaaatgccaaaagttcatgaaaacagttgaatttattttgaaacacaaattacaattatatttgttgtatgataatgtaaaatcacaattttaaaaagcaaagagcattatcagtgaccatgctgcttcaattggactattctgtaaaaagacctgccactaacatgcttgtaggcagcatgtcctcctccgcccatacctttgtcttactatgcctatgatttccttaaaatgaccctctattcactatatggagataattaagaaaactatggaaaaaaaaaaagagaagaggaggagggttttgggctgaataacactagctgacctgggtagaccgaataaaatggtattattactgagtccttcacatactattgtagattctatcaaaattcagaattccagggatgtcaggctgatttgctgaattgctgtttccaacatcaatggctaggtcttttgctgtcatatggtggtaataatccatcacctttgtctacaagtggacatccacaaagtggtcttctaagaactgttaaacacatcccagttttttttcttaccaagtaggaatttatcatatgataaggcagaaatttatctttgcagtatccatggagaaacagaggctgactaaagcaaataggtaaggagaaaagagacagataccatttgtttatgggtgctattttcaaggacttcagaatgcttcattgtaatagtatgaccattgcaaatcagttttctggtcattttgagcaaacctcctaagcatctttttctctcgatagcttgattgcaatcagtgtacatacttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattgggaaggatgaggccttgaagatggaattgcctctctgtttcactaagacgtagttttgaaaacctaaaattagttcacatcgcaataacaacaaccccggcttaaggaatgtaagagaatgccaacttaagtttcctggacgttttctcttctcagtgacaaatgagattgttacactcaactatttggaacctcggacagaatatgaactctgtgtgcaactggtccgtcgtggagagggtggggaagggcatcctggacctgtgagacgcttcacaacagcttctatcggtcagtggaagccaacaggcatttattcatgagctgggtgggagggggaggaaggggaaagaggaaggaagaccaggaagggtggtggtgggtgagtgggtgggtggggatggaggtggcaggagttcgcttttgaatgggtgggaaagtgacaggaaggctagcaacttcaagccaaactgttcctttatttgggttggactcctggtctgtctccctgggggaggaggtctgcagcactctgtagggacagagaaggaagcagatgagccttcaggaaggcagggcctcccctaggagctgggatttacacagcagcaactgtgctgagcttcagctcctgcattttatcactggcttcctgtttccatcttaagggcccagaccaggctcttgccacaggcatattttagaagtcccagtttatttattttcaaaaataatttccaatttttcaaagtaattcatggtcagagtcatgacatcaaatagaataagaagcttttatctaaagaacagcattctcctgctccaccctccacctcccagtcctgcttcctataggtagccactttcatctccttaagctatttcttatatttacctcccttttctaaatcagtggttctcaaacctaagtgtccatcagaatcactcagagagtttgttaaaagatgtttctgggcctcgtccccagagtttcggattcaatggttttgaggtgaggatggggccggggttcaaaaatttgcatttctagtaggttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagctttctgttacccaggtaccctccattgaaatactggagtgatcttttgtaaggttccattcctggttctttgaattgttcactgtgtataaccattctgttactctctcttggtcagtactttatactttcaacttcatatatatttgatttatatcacctaggaaagtaagaattatcatcttccctattttacagattgaaaagtagagactcagagtacttaataacagtaagatgcatcaccatactaaatcttcgggcttcatatctttgtcttttagagccaggatcttgctctgtcactcaagctggagagtgcagtggtttgatcaacactcattacagcctctatctcctgggctcaagtcatcctcccacctcagcttcctgagtagctgggactacaggcacaccaccacatctggctacttcaaaaaattttttttgtagagacggggtcttgctttgttgcccaggctggtcttaaactcctgcctcaagcagtcccccagccttggcctctcaaagtgttaggattacagggatgagtcaccactcccagtccaggctccatatccttttgtttctccaattattatttctacctagaatcccaaaggcaccagcttattatcccagttcacatatttgcctgtgttttactccatttactaaaagtagaaggatatgttatgattgagtgaaaaaaccaggaagaacatccacttttcttctgcagagattgtgcacccttaacagaaacatccttccttcacaccacccacctagtttttatgttactagcagcatccttaaagaaccaaatgagactcaaaagctactctgagacttatagaagcattacacacaagtaagaaatggctgcttggggacccacctggttgtgaatataaaaaataaacccagaaactatatagagaggaaaaagggacctctacaaccatgacccaagggatccctgatatgtcatcatgttactgctaaaaggcaaatggtagttaattctctctcaagtcactgttggtgagtcaagaggggaagagcataaactgactcagatggaaagtatttatggaacagaacataaaacacttcacagccccacactgtactgtcttcagccctcagaatgtgttgcagccaggaggtctctcagaatatttcaaagtagttctcaggggtaggcgggaaggggattattgaaggttcttcttttcccatcatttgaattttgctgctgtttgcttttcatttcgtctggcagttgcactgtttatgtgtgttgattgagatggtgaaggccagggagtccgggaggggaaggaagagaacactttctgaacatagtgcagaaaggggcagacagggaggcgtatggggtaatcatgttcccaaagggcgggaaaaggggaaatgactatttattgagttactcttctgtaccaggcacaggattaggaggtgtaaatgtattctccaaaatatcaactccccattctcctttgtcattgcaaacctgcctaaaccactctgggtggctattttggaggttaaacttcagaggttaacaagaggagatggcatcacctctctccatttgcaaaggttacagagaaagggccatcagaccttttgcataatgccaagaaaatgcatgcctagctgctggttctcactagtctgagggtagtcagaaccaggctggtgggacttaattcccagtagatggaaacagacccttcctctcacctcgaaccaagagtaagagcagtgtttctcaacctttaaaaaaaaatgtattgctcatccccagtgagctgtttcagatacgtttatcctagtagatcctgcctcccgtgaaattttaataccacagatatgctctatatctgtttctgtattatggtcctctgtaaacaattgtagtaatctgaaattttctcatacactaagaacaaatttttttgccccataggagtgattgtgtccctactgagaatgcatgaattagaggatctctatcctacgttttggaaggacttcatatctggaatttaaaaatcaatttactattattaactgaaaacacactatttcctcctttgtccagtgacataagacatctcgaaagaaggaagggagggaggaaaccagtgttaatagagcccctaacaccttccaagcattttcacatccattttctcacttattactcctgagtctggaagatggatattttaattttattttacaggtgaacttggagagattatgaatttgcccaaggttgcaaaagtaaagtggcatgttcctgtctctctgattttaaaacccatattgtttctattcagtgatgtcttggtagcccaggctcctgtgggtgattatggccaggcatcacgtagtcatagcggataccttgatgtgatcagagcaggaataggcctggccctgccaccacagctgtatgatttctgaaaatcttgctaaggggaaggaacccctaaattgctttacaatgtattgctcaaaatggtaacagaaacggtaaatactctcccataatcccataaccttggcaaatctactgttttgatttttatcagtttccttcctatccttcaccattgtagacataacttttagcatgcctacatgtacttgaagtctctttattgggctttcatacttatcctagttatctatttttccactgaatggctatatcataatttattaaagcagtttcctattttgagtgtttaggtttcttccaattgtttgctgttataaataatgtaatgaatcattttggtagggaaaaaagtatcatatgggccacttgcttgtgtttctttgatagcttatgaggtggtatcttattctagaagccaaggttactcttaaaaggtgccctttagcgctgtcattgactccacccttgtattagtctgtacttgcattgctataaagaaatacctgacactgggtaatttggaagaaaagaggtttggctttttaccaagccaaacagtaaaaacagtaaccattggctcatggttctgcatgccgtataggaagcatctgcttttggggaggcctgagggagcttttactcatggcagaaggcaaagtgggagcaggcactttgcatggtgaaagcaggagcagaagagtgagggggggcggtgctatacactttttttttttttttttttttttactgtttcataatttatttatttttccatggaaattatttaacattttattttctgacaaagctcctgtttattttattttttattttttattatactttaagttttagggtacatgtgcacaacgtgcaggttagttacatatgtatacacgtgccatgttggtgtgctgcacccattaactcgtcatttaactttaggtatatctcctaatgctatccctcccccctcccccggcaattgaacaatgagaacatatggaaacaggaaggggaacatcacacactggggcctgttatatactttcaaatgaccagatttcatcagaactcactcggtatcaggaggacagcaccaagggggatggtactaaaccattcatgggaagtcacactcatcaaccaatcacctcccaccaggccccacctccaacactggggattacatttcagtatgagatttgggtggggacactaatccaaactatatcagccatatataaaaataatgatttttctggattctcctaggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacagtaagtaattcatgctgctccagcctcatctgagcaataaggggctaccgccatgcagacttagctaacatcactgcaggactattggaaattatgaaagaaagttagttgtgagagaaggctaattagtgccccccacctaatcattttaataacttgcaatatataacatatatttggatttgcaataattcaggcaggtctgtgctaaaatttaccttcccttggtgtgcagttgtttatttagtaaattagtaacaagaagtttttctagggcttgttgaaccatttatggggtagttttgaagaattatcatatatctacatgtacacagatgtcagttaattccagatgggtcttacctaaccataaaaaccaaataactttgcttgaaaccccttgaaaacaggtaattttaaaagttaaaagatttatctaggagtaataaaatcactttttttttccaaagtattttgcatttcaggcttctcaatttcagattggtcatttaaaattaatgggaatttcttgggtttctttgtagtattgaaagtctattcattactaaactaagcagagagttttattttgattcactgaaattagaactgtgtgcatttggaacccttggaaaggtaaactatttcttggccacacacaactaccactgaagtcaggatcatgtggtctatggccttaccaccctgaacacactggatctcattgatcctggaagctaagcagggtcaggcctggatgggagattatgtggtcccttgccacctcccagagtctgaggctgtctttgcagctggttctccacttcctcaggaacaggtgtggaagctggctcagtgtttctttggccactcttttattgcatcagtgacttatgaaagtctgaattgttttgtcagtgtttaggaattcttcatatataatgtttaattctgtgaaatttccaaggtgcagaatcatgctaacagtaacacaacgaacaatcacattcctcccatccagaattaacaactgttaacattttgtcatatttgctttcagcatttgttgttgacttatgtaataacccactacaggtgtatcagtatctcctgcaactgttatccctatctatttctattcccctctcccaagagacaaccaaaattatgagtttgttaagtatattttaatttaatgttgtatgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccacacctgactttttttaaaaatttttttgtagagatgggatctccctatgttgcccaggctggtctggaactcctgggctcaagcaatcctcccgccttcgcctcccaaagtgctggaattacaggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggaacaagtccggtggtggaactcatgggctatttccctctaaagtggttagtcagtgtgtactatgttcaggagtgtatgacagtgccattttccttatacccatctctatgtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctcttttttgatatacttattgatatcctttgctcatttggaataggttgtctttcttactgatttgtaaaaattatttgtgtaatctaaatactttgttatgtgtattgcaaatatgttctcctaatccctttattgtaaccttgtttgtggtggcttttaacccacagacacttgacattttgatgcagctggacctgtcagtatttgcctgtgtgatttatactttttgcattttggaattattccctatcccaaggtcataaacatattctctgtgtttttcctagtagttctagtgttgttttgtgtatttaggtctttaagatataaaaatgttattttggggtgcagtatattttaatatttttattttaatcttatttattcacatatggcatgtcagtggtcccaatgccacgtattgagtagtccccatggtgagttgtgatgatttctgtatcatatgccaggttctcatattcattttgcatctatttctggatgttctgttcccttccattgatctgtttgttcctgtaccatttccagcatattaactataaacttgtgaaatgtcagtaactatgggatgaatcactatttcctatttcaaaattatctgaggtgctcactcacctaaactacataagtttcatcctcattagaatgatacactctcaaaatcacactatcattatcatatttataggattaaacaaaaactagttaatagtcactgggagtcgacttgccttggatgattgtatgaagtttgatggagggtcaatgctggtggtggtagtagggatgtgagattggcagggtaggagttgatccctatagggtcaggaaatccgaggaaggaggatgtgaatgagaacatctcatttttacctgaaaatatttgttaatatgctgtgttgtcattgatcatgtatgttcataagtaaaattaatacttccagttataaagtttgtgttggtttccagcctagcaattacatctggtccaggggtaagaagtggagtgaattagatttggcgtatcaccccaatcatatgttaaaaataatatatgtgtgttatgttttcctgttggaaaacatttacatggggagtatttgacccttacaatgactttttgaggaaagtagagtaagaatgattatcacagttaacagatgaggaacctgaggcacagaggagggtaagtgacttgcccaaaattatggaactagtacggcatggggattaggattctaatccacattttagttctatttttccccccaccatgctacaaatgtcttgcacttgtctctttggatgggcgacccactgcttcaaagcaactatgcttctagaggttctttaagtagtgatatcccgtttctaaattgtttaaggtctgattagtgtttcctaaagcattttagaatctattgtagagtcacccagagaacctgctaaaatgtagattgctgggtccagacccgctgaatttaaatcaaaggtttattgagctatccctaagaatgactcctttcaggcataaaatggtaagttggtagatgcaaatttatgatttttagttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcatgtgggaagaaaggctattgtatatttttataaaaatatacaaaagacttggtactggatgtaaagaaagttaagacatactgttgattaattgtgatttttggatactgtaccatctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaaattgtttataagcagtaactttcatgtggaaaaacaatggtgtatggaatgaaacagcctatgtctactattcgcctactgggacaagtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgtggaaaacctcaaggcatctctttctcatcctgcccgtgtccctgaatggaatgtgattccacttttccccaaatccctataatactttgtctactaaaagttattagcacattttctcatgtatacactgacctgcctgctgctccataaattgagggcaaggactgaccacatgacactaagactatggactacagagccagactgccaggagttgaatcttgtttcttctacttaacagtagtgtcaccatggctaagtcacttaatctctccagacctcagcacttacagaaagattgctatgaagaggaagtgagttaatatatacaagagactagatcaatgcctgccatattgtaagcactatataaatgccagccctcagaagctttccattcttcccagcatcaagaatagtaagtacaggtttgtggaataacagaatttctaaggccttcatttagtgtcaagatgacagatagatgatatgtgttgccatttctctgtctgtgccactctttcaagtctgcgtggagtccagtagccactaccaattgattggggtaccatatgagaaaacatttgtttgccttatatgagctgacatgaactctatctcaaaagcataatgatctaggccatggtagtatatcttaagtgaatcttttttctttttaatttctagttcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaaggttggttgaatggacaagtatttacataggattaccgtgcagccctataggcagctggtttatcaggacaggcctgtgagatgaaagcctatgaaaagtcggtggttgaatggacaggcatttacagagaggtccttaatatcaaaatgcctctgagaaggatccctgttggtccgttttctattattgaaccttagaatagatcagtctatcagcataccccatccagcaatctaagaagaaagctctgaggaatatgaattttaattcctaggagaaagaagaatgtgggagctgcttatagaaggcaagctatgcaagagctccagtaggaggctccaagaaccatgctccattcttcctcaaacactcctttttttagcttggatgacattgtgcaattctgagtcttcttctactttactgatgcaggttattccatgtccaccactaaccccaaccccaggaaaagtatgtgatttgagctagatagagatcctctctggatgccatactgtgcccaccatttgtgattgataaagtctgttgagtgtaattaagtgaacaagggtcccatgtgggtggagctgcagcaggaggattgacttcaagtctgtgcagaggcacctcccggctctctgtgttgtgtacaatgtgtgccagagaatgtagatggaggcacgttagaggcaagttttgaaaatttatgatttggattacagtctgtttttaaagaaaatactataactaaatctgaaaacttcttggttctcttggaggattacctagaccttaagaaacaaaatcaaacaagtcgctttaacagtgctgattctttggaacatttttgaaatgctcaaggaatgaagagtctgccaaatatagaaaatcatggttttcaggtcacactcttagtgaatgccccatttttgtaattacttgtgttttggcgaaatgtaacttcctaaattcaagctatacataaaataccaagagaaaacttttaaaacaagacaaaaccaaaagtttctcaccattctagacatctctgtatctgtacatatatagagatagaagaaaagataaatgagaagagagggatacttttaagaggacgagatcatgttctatgtgctattgctaataaaaatatatcgagtttaattttatttaaataaggaaaagaaatagatttgaccatagtctttaatagtttattttgacctgagccctaaatttaatttttcctctgtcttttcctgtcttcctccctccctctctctcttcttctattgggtatcattaggttttcttcattaactcattaaaacaagacaaacaaaacaaaatacctgatagactgtaagctcttagcatcattgaactttaaagcatttctaggtggggaaattgaggtttagggaggtttagtcactctctcaaagttatacctgtagtaattctccctattattcaacattgttcatttgcttgggattctacttggaaataaaagttgaacaaatgacaactaatgattagcatattgctaattgtaacagcacttttgcatgttttttttttttttaatcttattacaaccctgtgagtcagactcatctccactgagtttggaatataaatgagtagcccgaggtcatatagtggttaggtggcagggttaaggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtggtagtgtctcatcttcctactagctaataagggcaagtccaagtacaggcagaaccttcactttaaagatatggaccaggaaatttacttataaagtaaatatttcccttaggcaagcctcatcttctctttggctttcattatgaaatgggagataaaaagtatgactttttaatttcttatccaaaccagaacaattttgagagtgaaaagggtgctcttagtaaattatgcaggaaactaggtctgcccctgcctgctgaaatgagacatatggtcatcctagtagtaagtccccagagatgatatcttgcaacagaataaattgaacatttttggtaaggaaggacagagggtaaccagacctcagtgagataggtaatgacgtaatatattagacaagttttcctcacatttgcctatttccagttcccatttctttctagtaagtccctcaatcttatcacccctcgtatgtgtaagaattgtatatacctgtgtgtgtcttccattcctgtgtaccctcagtctgaagtcagagttcctggcacttggtactgcctcattttttttttcatctaggaattctaaccagtagcaaaggcctataaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgagtccccgagtttcccttccacggaggacaagaggaacttcactatctgactccatgccagagctggctcaattcaggctgtcgctggagaagaagggccagcaagggggttgggagtgctgagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcatcctgtggctgccccacataggctctccaagttagtttccaaaccagaactgaacgcttgctcatttcacaacactgtagggaactcacgtacaactaacgcaaggatggcaaacacatggaatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttttttcatctggtgtggatgccaaccagaagacattatgccccttagaattatgaaaaatcctgacacaaaatgatgaaataattatttttccagagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaaggtcagtggttgaccagatagagtcagcattgcgtgagggtgtggagaaaacttgatttcctgctcattctttcctctatggtcttacaaaaaattggcatggtatcagacatagctgttatttgcaactgaaggttatgcttcctttgaagttgagcctgtgatagtcaggatatcaatacaaaggcaggagccatttaaacatcactgtcttgattcattgggatgagatactatagattcttggtcatatatggctaacttttgcggagcatcattgtttctcttaaagcagtgcttctccaaattgagtgtgcatcagaatcacctggaaggcttgtttaaaaacaggctgttgggccctaccccacaatttctgactcagtctagggcagggccagagaatctgcatttttcattagttttccagtgatgctatcttgtgggtttggggaccacattttgcaaaccacagtcttcataggttaactgtatataagttcctggggacactgttagaaatgcattcacttgggtttcttctactccttgactacatctgagtttcttgggtagcatatgaaaatctgtgttcttaagtggctttctcaatggttcctctgtacactcaggtttgcagagaaaaccactgacttaaggtcataagaactaaatcttttccagctttgttcatctcaagactgtttggtacctacccatctaataatatttgataatatcttcagagaaagcagcatgactagttcactggcaaattagctagctgtcttctcttctgcatgaaagagcagtttgtataagacttgactgtgaggctgcactattgattttacaaaatacaggcttggaatgtggtgcattaaagcagagaatatgatgaactattatcattgtgcagctccatcttaagagctctctaaggatgctggcagatttttctttttttttggaccacactattgaatctatgaattacctctaaatcttattaaatcatctctgctttctgcattgttaggaagactaacaaaacaaaatattatctatgattagaaacagcaatatgtttctttaaaaacaatacaaactacttgcaaaacagccacaaatcccttttctgttttgctactttagtcacagggagttttggggagcagtgaggatagtgagaggagaggggtgtagaatcttatgaaggcagtttttattgggatctattgtgagcctgattttctaccttgtgcccatgtgaagagggaaaatagcttaataaggcaccagggcagataaatcctgcaggcaaagcagtgcatccaaagaagggcagttactgaagtggacaacctcactataaagaactttaaaaaaatattcccaagatattgaccctccatgaggcttctgtagtatgaacagagcacttgacttatgagtaccattattccctcatgagatgattgtcacagtttctaagcatgagcagccatgtttatggccaccagcacctcactcctttccttgccacccaatgtgtgtttttttttttaaagcagccatagctcattgtccctgactcaagactgatcagtttatgcaccaaccaatagccttctcttcattctggtgcctgctgtgttctccctctggttaaagtgctagtggagagacaaggcaaaaagaatagaagcagatgcaactcagtttcctgattcccatgcaacttccataagataccatttggatttgatttgtttagctcaatcaaccagattgagactggtttgtaaaaaataagttacagttagtgaacaaagaggcatgcattattggtgatgtttcatggaaactttggttctattcctcagttgtctctggatggtagatttagctggaagagctaaaatctaaaagatgatacagctccacctctaccaagtcatttacctgaggatctgggagcttcaacaagaaaactttagagtagtggttctcatccaggggtgattttgcccatgggggcatttggcaatatctggatacatttttgattggctattggcatctagttagtagaggccaggatggctgcaaaacatcttaccatgcacaggacaggcccctgcaaaggaattatcagcccagtgtcaatagtgccaaggccgagaaactctactttagagtaatctctttggttgtatacagttgatggtgactgagggtagctgaaggttcttagggggcaggacgggacagctgattctgaaaaggtgtaacaaagaagaatcacaacccttgactttcttcccagaatatgcctccaaagatgatcacagggactttgcaggagaactggaagttctttgtaaacttggacaccatccaaacatcatcaatctcttaggagcatgtgaacatcgaggtaagatgctcttttcctgtctttcctgccagagtttttataaaacagacaaattccatatggatataaggaaagataatgatcttaagaatgttgcctattttttttaaagttgcatcttctatctgaatgtctgtctagtcccatttatagactgtgctgtggtttgccttgtttttggagggaggtgccgaggctggactatttagcctctgatgtggttcagccattactgcccaaaggtattcatggctcctacctgccccatccttggccatgcagaggttttctccactaccactactattatagtaggggagcccccaccatcagcttcttaattgcctacctttacatttttcctggaaacccagggaattggtattctgaatgttaaaagccatgaatgccagcaatctagtgtaatatgaaaactaaggatggttggattttaaaaataattataagaagctttcatgcgatagtgctttgtttttatccagaatgctttcatgtacaattacaatggagctttacaactatcctgtgttgcacatgcatttaaagttaaatttatgttattaattcaaatgtttattgagtactttctactgtaatgcatgtaattactggtgagtgagtaggtaacaacaaaaatcctctatgggtttacctctgcatgcagcatggccttgtagttctgaatctctgcttaaacttcacttctcgtggaaaagtttgctcccacaaaaagctccatgcagtaattatttacaaacttgacagcctcttgttgactttgcagcacaaacaccaacaatagaaaagagactacttccatttcctcaatttattaaactaaaaatactggtgcttcaaacaatttatcattctatgatccaataagggtgtaattctgaaagccagatcatgtcccttaggttaaataatgaagtaatgacatttattttttgagctacttcctgaaaacagtaatgagcatggcacaggagtgtaaatgaaagttacacacacacacacataccacacacacacacacaccctgctgtccttgctgatagcactcccacaaacatggtgagtgttcttaaaacccgcctgactttctgtacaaaccctacaaatgacacagtacaaaagggcaaggattctctggatgcccagggaaagtggtgttatgacaggaagccaagtggccgtggtggacagactaaaccagttttctggaaaaaggctaaaactacaaagaagactgtgctgaggctttagtgttgaccccactgcagatctaagagaatgctggctcttaagggatccaggcactttgcactaggaggagataagaagagaaatggccagttgatccagttctaagtttcagcttttgttttattctgaggacaataaaatcttgaggttacgtttacttcatctggttgcagttggtctttagggagagaataaaccatgatattaatgcagcttccttcttgggaaaaaaaaccacaacaacaaaaatatatcccttaaaattttgcttcgtcatcacattagcacatagctggctcttaaaattttaagataggccgggcgtggtggctcacgcctataatcccagcactttgggaggccgaggcaggcagatcacaaggtcaagatgtcgagaccatcctggccaaccaacatggtgaaaccctgtctctactaaaaatacaaaaaattaactgggcctagtggcgcatgcctgtagtcccagctactcgggatgctgaggcaggagaatcgcttgaacctgggaggcggaggttgcagtgagccgagatcgcaccactgcacttcagcccaggcgacagagagagactcagtttaaaaaaaaatatatatatatatgaatatatatgtatgaatatatgtatgtgtatatatatatatgaatatatgtatatatatgaatatatgtgtatatatatgaatatatgtgcatatatatgtatttaaggtaaattacctttatctttattaataaatacatatttaaattattttaaaataattcagtaaagatgtgagaaagcacatgtataccataatttaggtctaactttcattatagtgcaacaggtttcaatattacttttcttttttgctagaatttcaatttcttagaagatctttcaagcttttttttttttttttttttttgagatagatagatagatagatagggtctcactctgttgcccagtctggagtgcagtagcacgatgtcagcccactgcaacctccccatccctgggctcaagcagtcttcccacttcagcctaagtactcccaagtagctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcaggagggtgtcacccgtcttcctcctgtcccccagtgctccctgggtggtgttgctagatgtgttttttagacaaaatggagtttataggcaatttccacagcacatctcttaaatgtcatagctgttcagggccactgatgagtcgatgctctcttccttccctccaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacaggtttgtccggaggacttcgctttggatatctttcctgtggagttccctctaaagtcagtttcaatatgtttgtagggtctgtcaacctctcttctttaactccttcttaaaatctccctcattttaatctctctgtgaatagtccatctatttaaagaaaaattagtactgacaatatgtttatctagcaattttcataattatgaaaattgtataattttcttctatctaatttcatatatgcaaattttataattttcctaatacgtagcgaggtaccttaagctctcttagcctggtttgcctctaaataatgtgtaataacagagacacactacattacagctggaggatttaacaacctgtgttttttatttgttcgttttctgaaattcttctgccaagatgtggtgtgtcatttggcagaatccattaccagggaattttggaggggaactttaagggaactggattgtgactgtttaaaatccttttttatactattgttttctttcctgttccccaaagttttcagccctggggctttcattaggctgaaaatacataatgttttcaaaaatttcagtttatccacagggatctggctgccagaaacattttagttggtgaaaactatgtggcaaaaatagcagattttggattgtcccgaggtcaagaggtgtatgtgaaaaagacaatggtaagtgccagacacagacactgatcgcatcctttccgaggtactcccctgtctcctgatgttgcttctgagactgtcagtgctctgtggtgactgaagcatctgactgtatgtcccagtagatactgtgtgccctgggaaacattctttctaaatgttggttcctaacatgattgcagcatctgcattaattaataatgaagaaggcactgtcatgtgtgaccaagtgattgaatgttcaaacctagtggtttggggtcttggttctatccagtccagaccccaaggcatctcactcaggaacctctgaggagcttgcacaatcccctttcatgcacagctgacacagcaaggaaaaaaattaacatattttccaaaagtcaagaagacaaactaaatggtttctaaatcaccaggaggctctacagagaaattcataacttctacaggctcatctaagatttctctcttcactgaaacctcaatggtcactattcaaacccaaataaaatccactctcccaaacagtaatattttatctttaagtacaagattgcaggagaacctaaccatacagtcttagaggaagagagatactcattctgcttttggtgcccagtctagaatcacatagtcctagaagtaccgcatccctgcatgttacagctgtgtggatgaaatgtcaccatcctctcttttccttgggtgggcagaatgcaggggccttagggatgacaagccctgcagcctttccatgtgtctggcagatctactctggtggatggctctcccttttttaggtctgatgaacattacttggtcccagctttcctgggatggctccagttgtcataagatatagacaatctttttgcttttgtgggcacaccaaattgtctcttagcaaggctcaggttccggcatttattctcaattccaggcttctttttttcccatcatacttattttagttactgagaagataaagtaaaacaatactcaagaacattttgaaaggaaatcacccataattcaccaccttggcatatatatttttttcattttggcttattgcctttcacagcatacatccttttacatagctacaaccacagtgaacgtaatcattttggatctttccactctcctttctgatgagggtgtgaagctgggtccctttggctcttcgagggccctgcatgcttatcaacatcaacactttcagaagccatgtgtgcctccctgagggctggcttccaggtgatgcttttctccctaaccttttcaggcatactcaaagcagatgcttctctggagcaggggtgggcttgttttcttaaagaagcagaatccatcactcacctacctactccagctttcccaactcctccctcaccacctggtgtcctcaaatctccttcctgaaatccttttccctgctttactccagcacttgggggatgtgggtaccctgggtgagaaggtggagggataacacaggataactccacaatctacccattctatttggatgctctcctcagcctcccaagactagcactggtttgcttggcatttcataaagggcagtgatttctgcaatattggggttatttacagggggagagcacctatcaggtctcaactctatcttacaatagactaaacagggtaaaggtgttctttagcaccttggggctggggaggaaagggccaggtttgagggaagggggaagaaagaaggattggagaggagcaagttccctgcaagaaaggtgcagtgtggcaagacactcctagagaacacagtggctaccttctctggcagccaattttaaaatcagattttcaattctcattgtacttcaaagcatctgcattttttaaagatccccagatgattgagtcctatcctgtggatattctgattcaattggtctagggtgagaaccctgcattagggtttttttttttttttttaagttacccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagctgataaatgcaaagagcaaggaaagcatagatgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagtcctgaagggccttgaattccagctaaggatttgggatcttggaaccatagggacattaaagaattttaaggaatagaactacatggtcaaatttgccatttagcatgatcatcctgactacagggtagagaacagacaattagggagggagatcagttaggcagagagaccaggagagattgttgtcatcaggtgtggtatgatggtggactgaactgaggtgatacagtagacagaagtgacgagatccaaaagaagtcaaataaaaaaataaatgaaaaagtgcacaaggaacttaacaattaggaggtgtgaggttggaagccagcaggctgggagtgaatgagggcaaaaagaaaacagataacactgtagagagagttagaataacagctgggagatggggtggtgtggacagagagtgaagggaggaggtgtggatgtggaggagaacaataaataggtagatgtgagaaaaaatacttccatacttgaacctaaaagtacaaaattaccatttagaatttatgtttagaaatgtatgcatcagaatattgccactccacaaagaactgggagacaattgcacattcaggaatcgtccttgggatctagggcagggctggtctcataaatgcatgacctaggagaacacctgctctggagagctgagaaaggtccctcaagtgctcctggttttgttccacccactggctaatctaggtggagatgccactgtgaaagtctggacaaatctccgggagggagggatcaacctctcaatgaccaaccctatgattcttgaatgagtagataggaagggagccccaaatcatagagactttgaggaaactaggaataaaactttaaagtcaagctttacaatgtccaggcacatctgattttgcctagcctgggatcagtaaaacaagatatggggagagcctggaggcagtcaggaccaggcatcgaaaggatcagtatgtctccaaacccaacataaactacactagctacaaatcagctcaatctctactgttacacatgcacactgttccccttgtccagagatgctctttcctctcccatctacctaatgacacctaaacatcttatagaaccatgctgggatatcccgtcctctggagaatctccctccatcatctccaggcgtagttgttctcttcaccctaccccagtttcccttttccaccctgcttcccttttccatattattaatacagttaaattctcactcagtgtctatgcctgtctcccctttcaagcctcggagtgcctctgagggctataaggtgaataaggaatgaccgactaccatgcgtgcacactcacacttccattcatataacgctgctggaccccgaaagataaataggacttatactgtttgtttgcatgttttgaaatttgaaaacacatgtagctgggacatacacaaagcaatgatttctgagtctacccagcaatcatttgtggagccacagctcaggcaggctgagagcctcttaaagaccctgtcccagttaagtgaaatctcactttgttctctccagggaaggctcccagtgcgctggatggccatcgagtcactgaattacagtgtgtacacaaccaacagtgatgtgtgagtaaacttcttattgccaagggattttttttccctcccagaaacatatacatttgacagaggttttaaaaagatacaggaatgtcctgtagctctcgggaacaaaggtaactaaaaagctcaggaaataaattagcagaataaagccacagagtagacagtttccagaggagtgcagaatcacttgtggcaggttttgggtttccctctgcatactgaagttgtgtattcctcatgtgcttcaagttgcgaattctcggactcaacaggaagaagggacataccggccttcctgtggctcctctcccagacctagatcagaggaagcaacccagaatagctgctggggacaaaataaggccagacagtggcgggggtcgtctctgcttgcagcctgcagtgatgcatcagaggctggcggtgaaaggaaggattggcttgagatttaggtcatcttgccttgtaccccatttccaggaggaaaaaccaaggccccgagggtggtgacttgtccaaggggttttgctgatgtctgggcatgaggagggggtgggcaattgctgtgtcctcactgtatgcaaggtgctttttatgtttctctgcataattttgaggcagggattattgtccccacttttggaagaatacactaagaggtcccaagaggttcagcaactgtttccaggtcacataagtattgggtggcagagattggatttaactcagatctgtcaagctccacaacaaatttcatctgttttggacagtaccaccttgtagtctctagttaaagtgatttgggggctctggcaaagtgaacactgtttctttgttgtaacccttccattgagctaagaggagagaaacctacactgtgtgcaagggcctatcctaggatgtagacatttaacatctccttttctcagaaagggtgggtctccctggcttttggggccggaaaatgagcggtgactctgtttgctgattgttggtttcacacttgtccctcctgcagatggtcctatggtgtgttactatgggagattgttagcttaggtgagtatctatgtttatctaccaggtgagactctaggcaaagtgagtggaagcctctagcactcccttgctgcataattccacaggatgccgtttgtatgtggttctaccagatgtgacttggaaatagaaacatagtgtattaattcccatatttttctttttaaaagccttatacctaacgtcatatttaacactaatgacctggaggccatgaactttattatatattaattggctccgcttgtacaagttgccaggttaacttctaaaactcttagattatgcagctattaaaagtcacatttttgaaagccatttaatagcatgtgaaaatatgtaataatttcatgtataccctgatcctagttttatcaatattgcatattttaaaaaactggaaggcactacacagaaaggtaataacatttattcttcatgctttttaatgtggtacatatacaccgtggaatactatgcagccacaaaaaagagaggaatgagttcgtgtcctttgcaggaccatggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaaccacccaccatggcacatgtatctcagaacttaaaatttaaaaaactgttctacaataaaccaacatgcatggcttttgtaattaaaaaactggccataactatcattgataaaatatgagttataaaactatggacttccaatcagaaaaaaaggttaatcttattggtataataaaggttaatcttattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctcttgccataccatgtcttcctcctggccccttatatttagaaaccctggacaggaagcattgcttttcatgccagagaggacttagagtggcactgtttgtcttccaggaggcacaccctactgcgggatgacttgtgcagaactctacgagaagctgccccagggctacagactggagaagcccctgaactgtgatgatgaggtgtaagtcaggcctcatcctggggctattttgtcttaccttccccctgtgtgtttctggggccagctgactctagcaaagtcagccggtatacactatacacaaacacctacacacagagatcccaaataggaacccctccccttttattcacctaatactgttatataatacacaagaagtattagctttacaggcatagaaattcaggaggaatttaatgactcttgggaaggttgaaatgaggaagggcaacaaatgcagaaaagctctgaaacaaattctttaaacatacaacactatccttggggataaagatttcaaagctgttcattaagattaattaagaaggatacattttcgggctggcaagatggctgaataggaacagctccagtgtgcaactcccagtgagatcaacgcagaaggcaagtgatttctgcatttccaactgaggtacccggctcatctcatagggactggttagacagtgggtacagcccatggagggtgagctgaagcctcacctgggaagcgcaaggggttggggaactcccttcctagcgaaggagggacggtgccatgacgaatggtgcattccagcccagatactaagcttttcccacagtctttgcaacctgcagaccaggagattccctctggtgcctatgccaacagggccatgggttgcaagcaccaaactgggtggccatttcggcagacaccaagctagctgcaggagtttcttttcataccccagtggcacctggaacaccagcaagtaagaactattcactcccctggaaagggggctgaagccagggagccaagtggtctagctcagtggagcccatcaagctaagatccactggcttgaaattctcgctgcaagcacagcagtatgaagttgacctgggggaggacgctccagcttggtgaggggagaggcatctgccattactgaggcttgagtaggcggttttcccctcacaatgtaaaaaaagtcacagggaagttcgaactgggtggagcccaccgccgctcctcaaagccactatagccagactgcctctctagattctttctatctgggcagggcatctctgaaagaaaggcaacagccacagccaggggcttatagataaaactcccatctccatgggacaaagcacctagtggtaagggtggctgttggtgtagcttcagcagacttaaacgttcctgcctgccagctctgaagagagcagtggatctcccagcacagcacttgagctctgctaagggacagactgcctcctcatgtgggtccctgacccgacccctgtgctccctgactgggagacatctcccagtaggggtcgacaggacatcttatacaggacagctctggctggcatctggcaggtgcccctctgggatgaacccaggcagcaatctttgctgttctgcagcctctgctagtgatatccaggcagacagggtctggagtggacctccagccaactccagcagaccttcagcacaggggcctgactattagaaggaaaagtaacaaacagaaaggaatagtatcaacatcaacaaaaaggacctccacaccaaaacctcatctgaaggtagataaatccacgaagatggagagaaaccagtgcaaaaccgctgaaaattccaaaaaccagaatgcctctcctcctccaaaggatcacaactccttgccagcaagggaacaaaattggacgaatgagtttgacaaactgacagaagtaggcttcagaaggtgggtaataacaaactccttcaagctaaacgagcatgttctaacccaatgcaaggaagctaagaacgttgaaaaaaggttagatgaattgcaactagaataaccagtttagagaagaacgtaaatgacctgatggagctaaaaatcacagcacgaatacttctagaagcatacacaagtatcaatagctgaatggatcaagtggaagaaaggatatcagatactgaagatacacttaaagcatgaagacaagattagagaaaaaataatgaaaaggaatgaacaaagcctccaagaaatacgagactacgtgaaaagaccaaacctgaaagtgatggggagaatggaaccaagttggaaaaccctcttcaggatatcacccaggagaacttccccaacctagcaagacaggccaacattcaaattcacaaaatacagagaccaccccaaagatactccttgagaagagcaaccccaagacacataaatcgttagattcaccaaggttgaaatgaaagaaaaaatgttaagggcagccagagagaaaggtcaggttacccacaaagggaagccaaacagactaacagtagacctctctgtagaaaccctacgagccagaagagagtgggggccagtattcaacattcttaagagaagaattttcaacccagaatttcgtatccaaccaaactaagctacataactgaaggagaaataaatcctttacagacaagcaagtgctgacatattttgtcaccaccaggcataccttacaagagctcctgaaggaagcactcaacatggaaaggaaaacccggtaccagccactgcaagaacataccaaaatctaaagaccatcgacactacaaagaaactgcatcaactaatgggaaaaataaccagctagtgcagcataatgacaggatcaaattcacacattataatattgagacccatctaacgtgcaaagatacacataggctcaaaataaagggacagaggcatatttaccaagcaaatagaaagcaataaaaaaaagcaggggttgcaatcctagtctctgataaaacagactaaaccaacaaagatcaaaggagacaaagaaggacattacataatggtaaagggatcaatgcaccaagaacagctaactaactatcttaaatatatatgcacccaatgcaggagcacccagattcttaaagcaagttcttagagaactgcaaagagacttaaagtctcccactattattgtgaggagtcttaacaccccactatcaatattagacggatcaacgagacagaagattaacaaggatattcaggacttgaattcagctctggaccaagtagacctaatagacatctacagaactctccaccccaaatcaacagaatatacattcttctcagcacctcatcacacttaaagctgaccacataactggaagtaaaacattcctaagcaaatgcgaaaaaacggaaatcataacagtttcttagaccacagtgcaatcaaagtagaactcaggattaagaaactcactgaaaaccacacaactacatggaaactgaacaacctgctcctgaatgactactgggtaaataacgaaatgaaggcagaaataaagatgttctctgaaaccagtgagaacaaagacacaacataccagaatctctgggacacatttaaagcagtgtgtagagggaaatttatagctctaaatgcccacaggagaaagcaggaaagatctaaaattgacaccctaacatcacaattaaaagaactagagaagcaacagcaaacaaatgcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatggataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaacctggcagagacacaacaaaaaagaaaacttcaggccaatatccctgatgaacattgatgcgaaaattctcaataaaatactgggaaacagaatccagcagcacatcaaaaagcttatccaccatgatcaagtctgcttcatccttgggatgcaaggctggttcaacatatgcaaatcaataaacataatccatcatctaaacagaaccaatgaaaaaaaccacatgtatctcaatagatggagaaaagccttcaaggaaattcaacaccccctcaggctaaacacgctcagtaaactaggtattgatggaacgtatctcaaaatattaagagctgtttatgacaaacccacagccagtatcacactgaatggacaaaagctggaagcattccctttgaaaaccggcataagacaaggatgccctctctcgcccctcctgttcaacgtaggattgaaagttctggccagggcagtcaggcaagagaaagaaagaaagggcattcaaataggaagagaggaagtcaaactgtctctgtctgcagatgacatgattgtatttctagaaaaccccattgtctcagcccaaaatctctttaagctgataagcaacttcagcaaagtctcaggatacaaaatcagtgtgcaaaaatcacaagcattcctatacaccaatagcagacaaacagagagccaaaccatgagtgaactctcattcacaactgctacaaagagaataaaatatctaggaatccaacttacaagggatgtgaaggacctcttcaaggagaactacaaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtactaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaagaaaacctgggcaataccattcaggacataggcatgggcaaagacttcatgactaaaacaccaaaagcgatggcaacaaaagccaaaattgacaaatgggatctaattaaactaaagaccttctgcacagcaaaagaaaccaccatcagagtgaacaggcaacctacagaatgggagaaaatttttgcaatctatccttctgacaaagggctaatatccagaatctacaaagcacttcaacaaatttacaagaaaaaaacaaccccatcaaaaagtgggcaaaggatatggacagacacttctcaaaagaagatatttatgcagacaacaaacatgaaaaaagctcatcatcactggtcattagagaaatgcatatcaaaaccacaatgagatgccatttcacaccagttagaatagcaatcattaaaaagtcaggaaatgacagatgctggagaggatgtggagaaataggaatgcttttacactgttggtgggagtgtaaattagctcaaccattgtggaagtcagtgtggcgattcctcagggatctagaattagaaataccatttgacccagccatcccattactgggaatatacccacaggattataaatcattctactataaagacacatgcacacgtatgtttattgcagcactgttcacaatagcaaagacttggaaccaacccaaatgcccatcaatgataaactggataaagaaaacgtggcacatatacaccatggaatactatgcagccataagaaaggatgagttcttgtcctttggacggacatggatgaagctggaaaccaacattctcaggaaactagcacaagaacagaagaccaaacattgcatgttctcactcataagttggagtttaaggatgagaacacatggacacagggaggggaatatcacacgcctatcggggggtgggggctaggggagggatagcattaggagaaatacctaatgtagatgacaggttgatgggtgcagcaaaccaccatggcacttgtatacatatgtaacaaacctgcatgttctccacatgtatcccagaactgaaagtataataataaaaaaataaagatacattttcttgcctagaaccttgcttctgctaagattactttcaaaagtaagatttattccaagggtaagaataatgaactgtagtgataccagcattcccagaactatccgtggtagaagctaactggcatgtttgaagactgcaaggctctaggttgagcagataatttattgtctaaatggagctacttctaagagtgaaggagggtgttaatctcactggagcaagaagcatacataccatcctggaaaaacctggacatagttgaccatcactagacagtccctaaaattccaccttttgagattcacttcataaggggtgagaagattttttagtctttaagaaacttatgttaaagtgtaagctgttctgggatctgtgacaccctaagccaatggttgatagccttccatgcacataaggttccccagagtcatttgttcagcatgtgggctcttggtccccactgtcagtcattgattctgtaagtttagggcaggttccagaattctgcattttaataacagagtagttctgagcacaactgagtaagcactgtcttaggtcagtgtttcccaaactatgttttcacgtgttgtgcaagatataaatacatgatgcaaggggaaaggagttctgcggtcaattactttggaaactttgtgttaaacctgttgtcttagtcatttccggctgctgtaacaacataccataaacatggtggcttataaacaacagagatgtatttctcacagttctgaaggctgggaaatccaagatcaaagcgctagcagatttggtggccatgagccatttcctagctcatagatggccatctttctgctgtgtcctcacgtggcactaggggcaaaagagctctttgaggccttttgtgtaagagcacgaatcccattcatgagggttctaccctcatgacctgatcacctcccaaaggacctaccttcaaacaccatcacatggtttcaacacatgatttttgggtggcatgaacattcagtccatagcacctggttaaacaggcatttttttgtttttaatgacagtgcttctaaaagtcctgcctcttaaagggactttatgtgggtggcattttacaagtttgagcatgggccctttaagagacactaacattttgaaatatgcagcattccaaggcaaatgctgctctagacacatacccagttctttctagatgattgcaatagctgagaccaaggtcctgcagaaacagtaccgagggtaggaactaaatctatgaggagttgaaatgagactggcttagggaggtgggagtcctcatagaaacttcctaggggctgtactttggttaagcttcataaccatgcattgggtggcttcattctctcctctcttttcctgccgtgcctaggactgaagcacagttatagaattaaccctttaattctttgctttcgaaggtatgatctaatgagacaatgctggcgggagaagccttatgagaggccatcatttgcccagatattggtgtccttaaacagaatgttagaggagcgaaaggtaagtattaaagtcaggcaggagatctttaattggaatacctgatgtgcccagggtggttcataaaaaacattgaaataattgaagaagttcttcttggcatggccctaagtattatagaaacaaaggatgtccctccacccccgcgactttgaagaagttacaattttggggggaaataagatttctatacaagatacagtcacgtacacactagaataacatacagaattagcctattagagttggaaggaattttcgtcatatagcctgaccctttaattttatagatgaagaaacagactcagaagtgggtgacttgaccaaggacacacagcaagtagacaacagagcctgacctgcaggttactataatgagggtcaggaactccataaaaatttctagaagtaagttggctgtaccgatctgggagtcaaaataaaagtaaacacagtttaaagaaatagtcatcaaaacccaagtggtaattcaactagagatgcaggtgagatcacacagatgtgaaaatgagattcagacagaggaaggaacccagaagaaggaaccctagggaagctgaacacattaggaggtaccaataagacactgtgagaaaggcaagctcagaaactgaggatacagtatgaaatcttacttgcagaacgcaaggggatgcattttaggaagaaagtcatcaaatacaacagagggactgaggacagaaaagtatcccccaagtgcttagtatatgagttgcaacaaactaagaaaaccaaggtattgctgtaactgccgctggcagaggtggaatcaaagcagcctatgtctctgaaccattttcattcttccagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctca

SEQ ID NO: 2788 - DNA, 451 bp, Homo sapiens
  source 1..451: mol_type = genomic DNA
gcatgtgtgagccgagtcctgggtgcacgtcccacagctcagggaatcgcgccgcgcgcggggactcgctccgttcctcttcctgcggcctgaaaggcctgaacctcgccctcgcccccgagagacccgcggctgacagagcccaactcttcgcggtggcagtgggtgcctccggagaagccccgggccgaccgcggcctccaggcggggttcgggggctgggcaggcgacccgccgcaggtccccgggaggggcgaacgggccagcagctgacattttttgtttgctctagaatgaacggtggaaggcggcaggccgaggcttttccgcccgctgaaagtcagcgagaaaaacagcgcgcggggagcaaaagcacggcgcctacgcccttctcagttagggttagacaaaaaatggccaccacccctcccaggcccaccctccgcaaccc

SEQ ID NO: 2789 - DNA, 41876 bp, Homo sapiens
  source 1..41876: mol_type = genomic DNA
ttcaaaactgaaaaactcatatattcagtattttactcccacagcacctccccccaatttgacccacagggacccccatccaggtgcagggtcctcgcctgtgtacagggcacacctttggtcactccaaattcccagagctcccagggtccttctcagggtctccacctggatggtgggggtggaaggcaaaggagggcagggcgaggggtgaacaatggcgaatctggggatggactattcctatgtggggagtggaagccgggctcctggtgaggaaaagctggccctggggtggagccgagcgccagcctgtggggaagtgaagacggcaggtgtgctggacactcagcccttggctggacactcgctcaggcctcagccggacactcagccttcagccggacatgcaggcctcggccaaacactcactcaggcctcagactcccagcggtgcgggcctgggtgtgggccgcccctccctccctgggacgtagagcccggcgtgacagggctgctggtgtctgctctcggcctggctgtgggcgggtggccatcagtccaggatggtcttgaagtctgagggcagtgccgggttggctgcggcctccagggcagtcagcgtcgtccccgggagcttccgactcagctgcgtctgggctgcggggccaaaatcagactccgttccagaagaggccagaggtggcatcctccaaccctcctaggacgtgtgggtggccgggcaggcagggcctgcacctcgtggccctggctggtgggaacctcagtgaagggacagacacccctccaccggggcgagcagacaggcagcccagtgacgctggagcggcggggcggggagagaacttgctcaggaccccaggagctcagggcagcagccagggaagaggctgtgagaggacacaggtcaggggtcagaaggctcccaagcgtggggagccatcgcccctgagatgggaagcaggggttcaagaagttgtggaccctgccaggctccgtggcctggggacaccagcgtttaatcacatagggctgccagcgtggctccaggcccccagggtcaggcccgggggcgtctgcacttcagcagcatctgaggctgctcgccccacacagggcgttcaaggatgacccctgggcaggtggggcccgcactggcctccacccacacttgcctgtcctgagtgaccccaggagtggcacgtaggtgacacggtgtcgagtcagcttgagcaggaatgcttggtggcacagccactgcacggcctcggagggcagagggccggcggcgcccttggcccccagcgacatccctgggggaaaacagaggctgaggagtcacaggcccagcccagctcccctcccaggagacaccggaaagctgcccacacccgacggtctgcggggtggctccatctctggctgtcccgacccaagcaccgcaggagtcacgacagaaatgttttcttcggcttctccaggtgaaatttccacaacacagaaagaacagaaagtagaagctgttaagctcaggaccgcaggttcgacatggcttgaatttcagacggatcagaaacctccctgatgctggacaaagtgtccaggggcagaggacggtgactgggaagcagaggacggcgcggggctctgtcgtggtgatacgcggcctctgctcctgagaggggtggggtagcctgggcctggcctcctcctaagcccttggcctgggtttgcacaagggccctaagtgccatggacgggagacagcccaatcccaccacagggcaaacaggagaggccaggccccccaaatcccaccatggggcaaacaggagagaccaggccccccagcgcttccccaggcagagcaaggtgggaaggatggcagctcccagacagctcctgtcccttccatcaggtgctctgctcaccccacgagagggcgggcagacgagcctgacagtggttgggttaaaccacttcctgatgcgaaaaggggtaagaacttcctaagcccagattcactcagtctcctgacacactaacaccagcaggcaggcactgctgccactgaggccaggcacctgcacatacctgcgttcttggctttcaggatggagtagcagagggaggccgtgtcagagatgacgcgcaggaaaaatgtggggttcttccaaacttgctgatgaaatgggagctgcagcacacatgcgtgaaacctgagaggatggcggacagcgtcagaggaaaggcctcctaatcagacggtgctcgtgggtgtgggcatgggcccaccggtgcctgtgtgcgtgcatgaatgcacatgcatgggtttcctcatgggcacaggtgcacacacacggatgcatgcatgcatgtctgtgtgtgtgcttgtgtgtgcgagtagctgcgtgtctgtgtgtgcacaggtacactgcgtttctgtgcaccatctgtatgaacacgcatgtggaggctgaagcagctccatcctggatgccagccccccatgctggcttctgattagcccctgttccgggaaggcctctaaggtttccagtttatccattgttccttgtgtaccagcaggtacttatcatgaatcctgcccttcgtcagacaaccttgatgtcatcgtatatcaacgtcctgcgcatcccttctgagccacccgcccctgtggtgcataaaccctgggtctggggtgatggtgtgaggacccatcatctcatctcactgacaccgagacaccgacttggcttctgtgtgtaggttaagttcctactaaatgtttctttccaagaaactgcatttgtcagtcttctttgttgttgttgagatgggctctcactctgtcacccaggctgcagtacagtggtgcaatctcagctcactgcagcttccacctcctgggctcaagtgatcctcccacttcagcctcccaagtattggaactacaggcgcacaccaccatgctcagctaatttttgtttttatttttcatagagatggggttctactatgttgctcaggctggtcttaaactcctgggctcaagggatcctctcgcctcggcctcccaaagtgctgggactacaggtgtgagccaccgcgccagccctgtcagcctccatctttggcctctcagcttcctgggactttggggcaggtgtgcacagacctggctaccatgaaacagcacatgtgcacatgtgctcatatgtgcgtgtgatcagagcccccgtgtacctggtctgaccctctgcctgagccccccgtgtacctcatctcacccagtgcctgagccccccatgtacctggcctcacccactgcctgagccccccgtgtacctcatctcacccactgcctgagccccccatgtacctggtctcactgacttcctgagccacttctggaatgacctgagatcacaccagtcaagccagcaccccggtttcagcctctcagtaactctgctgaggtgggatgtcttttccccatttagcaacaacggaagccaggcccagaatgtttttaaacaaataaataagcctaaggtcccggggttgccacacggccacgctcctgacccaggagggaaacacctagcatgggtgaggggctctcttccaaagggagaaatagccacctgctagaggtcggggcgtccaccccaagcccgtgtggaggcgcggccagcacgggccaggaaggccgagccccagcggatttgaatcagaccccgcccccagcgccacgtggaccaccacagcctcgcccactgcagcctggctgccgtgaaatcggggcccagctctccgttctcccactcctgcctcgagggaaggggattcctgggccttccacgtgcctgactctgtgtttggaaacggcccgtggcccatcgcatctcggcctcctcagggctacccaatcaagcgactacccaagggtccccacatgggtggggaaactcagccgccctgccctgagcccaggccctctacgggagctcctcggagctagagaccctggtggggaaatgaggacaagactgagctgaatatgggaggagcaggtggcaggtcacatggccctgggagtttcccaggagttttcacctgggaaaactcctctgacctcatcatggcccaaggaggccccaagcacgccagctggaccctggggtcaaccacagtgtcagacacctccagtcctcagtggcacctgtatccagcacaccccaagggtttccggaaaggagtcaagcagcttgcacgagggcccaggcacgcgtcagggagatgcaaacgagggaagatttgaggcagagagagaaggcagagaggagggcggtctgagccggacgcaccctggaactgagacagcctggtcccaagcctctggagctggtgcaaaggcggtaacatgcagctgtggctctgccctccctgccagagcatgaaggcgcaagcactcgggttaaaaaccattttcatggtacgaccttgtaatggaaaactctcccgtgagcccttgctgggtttccacgatagacgacgacctcatttcacatcaagtgtgcacggtaattcgcgcagcctcggccctgggtaacacaaatgctcacactccttctcagccctcatggggcgagggcttcggcctcctggcattcagctcccagtggctcgggaggcctgttgaggtggaggcccgggcctgtggtgcccgactgccctttggtacagccccgaggcttgtgccaccacctgccctgactccaggcagaagctggccctgtggcctccacagattggcccttccctctgtgataaagttgtcgattcttggcaggggcaccccctgaccagccaggacagggaacgttccaggagcacagccatgcccagagcacaggtgctggccgggctgtgtggggagccacagctctgctgcaccttcccgggggtggggccagcgaccctcacctgcacccacctcggccctctttgctgagaccccaaatcctccgggcatctgatctcccatctactgttcagacaccttcccagcctcctctgctaagactccccataaacatctctttaccccatgcccctgctgccctgggatggcctccatgacgtcccacggccagtgcacaggcacagtggggacacctggggccacaccggctcctaccactacccagagatggagaacaggtgctttgcacagagccacgcgaacagaactgtgcacaggcagcagcaccactgaaaacgtaagacattccttgcccctaaaacccaggagttccaaggtgaagccccgggtcagaggtgagcagagcgcggagggtccctggaggctgggcctgcaccccttggtggcggctcacctgtacgcctgcagcaggaggatcttgtagatgttggtgcacaccgtctggaggctgttcacctagagtcgccaagaaagagtgagaaacggtagaaacctctctgggattttaagtttttactttttgctttatcatccattcagatggaacaagaaagaggaacattttgacaagaaactatccctcttcccagtgaaatccggcctggccctcacccggcagctgcgaaccaccctgggcgagtcaagactctgtgtcatctgcctgcccccgaggctcggccaagacaggaaggaaccaggagagggagtggacgcaaatgcccacagagaggggaggtggacgcagatgcccacagagagggggagtggacgcggatgcccacaggagagagggagtggagtggatgtaaatgcccacaggagagggggagtggacacagacgcccacaggagagagggaatggagtggatgtaaatgcccacaggagagggggagtggacacggacgcccacaggagagagggagtggatgcagatgcccacaggagagggagtggacgcggatgcccacaggagagggggagtggagtggatgcagatgcacacaggagagggagtggacgtggatgcccacaggagatggagtggatgcagatgcccacaggagagggagtggacgcggatgcccacaggagagggagtggacgcagatgcccacaggagagggagtggacatggacgcccacaggagagagggagcagacgcagatgcccacaggagagggagtggatgcggacgcccacaggaggggggagtggacacggacgcccacaggagagagggagcggacgcagatgcccacaggagagggagtggacgcggacgcccacaggaggggggagtggacacggacgcccacaggagagagggagcagacgcagatgcccacaggagagggagtggacgcagatgcccacaggagagggagtggacatggatgcccacaggagagggggagtggacacggatgcccacaggagagagggagtggacgcagatgcccacaggagagggggagtggacacggacgcccacaggagagacgagtggatgcagatgcccacagaagagggagtggacgcggatgcccacaggagagggggagtggacacagacgcccacaggagagagggagtggatgcagatgcccacaggagagggagtggacgcggacgcccacaggaggggggagtggacacggacaaccacaggagagagggagtggacacagatgcccacaggagagggagtggatgcggatgcccacaggagagggggtgtggacgcccacaggagagggggagtggacacagaagcccacaggagagggagtggacgcggatgcccagatgggacaatgccctcagggctgcagcttcagagcctcagcccaccaaggcctgggaccccgtctcatcctgtaaggagtggcactggtgctgaggacctagcggggtgaacacgaggacccctcaatacatgttatgtgcacacatgctactcacactgcacacccacacgcatgcacctcacgtgaatgcccacacgactgtgcacgaacacacatgcatgtcaggtgtgcattcgcatgtgcacacacttgtgcccttgcacacctgtgcacacactgccatgccttcatgtacacacatgcacacatgtatgtgctcacgtgtatatgcgtacatgtgcactcttacgtgcagccagtcaccatcagccttgcaggcacgcgcgcacacacacacacacatacttgcgcacacacctcctgaactctgaactctgtgctgaccatcagcctgctcacctgcaaatccagaaacaggctgtgacacttcagccgcaagaccccaaagagtttgcgacgcatgttcctcccagccttgaagccgcggttgaaggtgagactggctctgatggaggtccgggcatagctgagacacaggggggaatgtcagacacaggtgcctgccccacacccagccccctcctgcaaagcttgctccaaagagcctcctgccttcctcccgcttccttgtcctgcctggggcatgcgctgcagcccgagggggctgggtgctcactccatggactccaaatgctacatgccatccagactctgcatgaccaaactccaccaggacctggctagtgatgttgagtgtatccaaacctcgcacggccgtgtttgtgcactcatcatctgccctgatgagatctgcacataactcagccaaaaacacataataaactgtggagccctggctcccgggcgtccctcgagtgaacacaggtgtgactcaggttttttgtgggagaacactgagttgggcgtggggaatctcactgtgtttgaatctcagggatggaagagccaggtggcaccagctaaacagggctccagtgagtgcacgtggcacacatggtgtctccagaggggcaggatggaggcatcccaccgatgtcctccagggcctcaccaccactcactgcccatgtatgtccatgtccaaagatgaacacacatgacatccacggcaggctcctggggtgtgttcttttacatccagctttgaacactgctacattgaaataaacgttttgtgccattaaacattcttcaaaaattctttgaaaaatgtttaatggcagagcaagttttgtgatgcataatatctccttagccctgtatttgggcaggttcgtgacttgctgtggcaagtccccctgcctggaacactggaaatggtaaataagacccgtgataatgtctggtcacttcagaagtggaattactgggaagacacaggacattgtgaggacttccatgcaaacaagctgctttccagaaaagtctttccagcttgcctcaacctgatgctggctcttggcaagcccagaaaaggagccagcatgagggatggggacaggtctcgccatcagtttcacgtgcgtttctttgagggatgggtctcgctgtcagtttcacatgcatttctttgacgctgctggtaggaccttcccaagtgtgcatcagacgtccatttcttctttcacagccatccccaacacgaccttgggctccggctcaccctgagcctatgggtctgacttgtgtggggtcctcgggcagagcaagggccccggagcaggaggccaggctgcaatcatgcatgccctttgccagctgggtgaccaagggcggctgctcccctggagcctttcctcctctacctctcaggtggttaggagaacaaagtgagaggatgaatgtgcaggacctcacagggcgccttaaataaatcacgtgcacaaacgctccagggaatggccattttcactgtggctcaggcaagctgagtttctctgcagtgaaagcaatgcccgttgcctcactggtttcatccgcctccctgtgtgtccttccccaacaccaaaccagggaacgttcacctcccttccctttgagtcttttgttttatttctgttgctggtgttgtttgcatgtgtctcctcttctacctagaatctgctctggtatatgctgtaaagacacaacttatttgcttccagtcagttttctcagaaaaaaaaattacacacacactctcttttccatcagctgtgccacataccacattaacacacgtttctgagagatagggcttccgttttgttctattgttctgtccatcagttctgaccacattctaccatctgagctgtggtttgggagactaaaatctggacaagaaaattcccatcttaccacttttcctttttcacttttcttaatcattttgcctgttttcttctcccagatgcccttcaagcctctgctgtatacttcagacacagaggatgtgagttcaccctgagtatggcgaaccactgcctccactgctgagcttttagagccacctctgcaagcacacactctgaccaagtggcctttgggagcacagaatattctggcattggacccacatctgatgacctgatgcccacccatcctgcactagcctctgtggctttgcaatgtgtttagagagaacccattttcctgatttgtttgtctgtcctttgtccttcaataacattcactgatgctgtgccagaggctggaaccaggggtgcctgtcctaaaaaatacatttcatggggagcaaaataagcagtggacagttcacagctgactggtatggccagcactgcagaggtgcctgggagaggcgaagaggtgctgggagcccaggaaatgtggaaatcatgcagacaaagccagtggaggccaggaccaggtaaggctgtgagagggaagcagggactgtggggagcacaggagaccggcatccttgtggggagggagctgcaacagggacatgctgggcaccatgcacaagggtgtctgcacctgccactcccccatcatgagggcgtctgcacctgctgctcccccatcacgagggtgtccacacctgctgctcccccatgaagcaaaccccagggagcattctggaaagaggcaaagtccagatctggactgttaactcagaacgacaggaccccagtttaaacctctggtttaacaaccatccaccacttatttctcttcccatgaaggtgtgcctttcagaggaaggcacccccagttccggcctctagcacagcaccagtaaatattatcgaaggacagaataaaaaaacacctgtccactatggttttggaatgctgatacttttttttttttttttaagatgaagtctcactctgttgcccaggctggagtgcagtggtgtgatctcggctcactgcaacctctgcctcctgggttcaaatgattctcctgcctcagcctcccgcatagcggggactacaggcgtgtgccaccaggccaggctaatttttgtattttttaagtagaaatggaatttcactatgttggttaggttggcctcaaactcctggcctcaagtgatccacccacctcggcctcccaaagtgctgggattataggtgtgagccaccttgccctgcctggaatgttgatactttttattcataaaagaaacagcacagatttctgcatctgtgtccatcttcaattcatttgtgtctgagcctgagacggggccttgagctctcgggctctggggaaacaagaccccagaattttgtagagaccccccccacaccatggccctgtcccctgatgggtcacacgtgatcatgaactcatggcatcctgtagactgtggatgagccttggagtgtggggctcacagcggagagactcacgcccaaaagggccctgaagtctctgggttcggagagactcacgcccagcagggccccagggtctcgggttcagagggactcatgcccagcagggcccctgtgtttcgggtttggagagactcacgcccagcagggcccgggcgtcttgggttcggatccagactgctttctgaagacacctcagtgcacccaggtctggtgcaccatttccttttaccaaaatagcacagaaaactgctcccgttgtgagcaccctcactcccacagaaagatgcatttctgctcagccccagatgggacgaggggcaccctgtggcctctgaccctttgggattggcagtcgcctgccccacacggaagcagaggtggacgcaacggccctgcagcagcacctgccccagccgggcacaggctccacttccggccaggtgcgctcacctggagtagtcgctctgcacctccagggtccgggtatccagcagcaggccgcaccaggggaataggccgtgggccggcatctgaacaaaagccgtgccacccagggcctcgtcttctacagggaagttcaccactgtcttccgcaagttcaccacgcagccatactcagggacacctcggaccagggtcctaaggcagaggggcaatgtcagccccaggatgcggggccgtcacccaggaggtaacctgacacccttgttaaatgctttggaaaaccccagagaagtggtgatttggagcagggtgctgggcctggcaggagctctgaggagcctggacccagccctgctccagacttcggggtgctttccctgtctcccgggcaggacaggtaggtgagcatgcaagaacctggcctggacccgggacagccaggactcagatgggaggtgcagccccagtggcctctgtgatggtccatctcatgtgtccccatggcaacaccacaatcccgttatagactcatctgtggtccggggcagactaaaatctggacaagaaattgccaccatcccaccttcttttaagacgtttctcaacgactttgcctgttttctcctagatgccctgaaggcatctgctgtgctttagacaaaggggagggttctgagttcctgctcaggcgcgggacctggctgggctgtgagctgggcaacaccagtcgtcagcttcacgtcaaggaggttccctcgccgagtcatgagcctcgctcacccagctcagggagcccccctgtgcccggtagcctctgctctggcctgggcatccccttcccttcctgcggcctctgctgtggccccgggcgtccccctgcccttcctgtggcctggccctgggacctcggccagctgcgcagctcccctggtgcattcccagctccctgtggccaccccttcctgttacatggctgccgactcatcagagacagagttctgcccccggtgggaccccaacatacactctgagccacctccctggccagcaccctcaggaacttgccacacagaagcagcgttccccgtctgctctgtcccctcagcagcctcaggactcctgagccctcagttgcttgggacctgggctccccccgagtgaatcttagtggatttaaatgtgcacagcctgctgtgctccgggctgcggcacaaggaacgccaggcatacccccagcccagggcggccctggagggtggacctggagggtggacttggagggcgggtccaaatgggttttcacaaacacagcccagcaaagcacctgaaaccacccctggcggccacattttctgagggttccctttacagctttcaaggtttctcgtccctcgtcaaatcgcactttaaaacaagcccaccggctctgtggggcgcccttgagggggaccacattggacaatcccctgtgctgaggccaggtcccctgtgcctgattttagtttgattcacaaaaatcaactctgaaacccactcctagccatctccgtggttcaagacagcagcactcagcaaatccaaattctcccaccgatcccaaacaaccccacgcaggaacgtgaccgcagcgaacgctgtgggccagctcactcagcagctcctgctctccgcaggctcaggtgcaccctggggaggaggctgccgcctcggccctgcaggccctgtgcacagctcctgggggtctcactggggccccaggagccgccactcttgactttccaaagagcagcaggagccaggtcaccgcctgcactcaccacgtgtgtaacctgggtgcgtctctgcaggaccagggcctgcacggtacccactccctcccgaaggtgcccctgcgcccccaggcctgggtgcacggccaagcgcctctgctcttgcggatccagcaccggcagagagagaggacttggcagagacaacgctgcggtgccaggggcaggacacggggggctcaactgcaaagcccacaggctgtggaggtccccacagacacacggcacgggcctcacctgaggaaggttttcgcgtgggtgaggtgaggtgtcaccaacaagaaatcatccaccaaacgcaggagcagcctaaaataagggaaaatacacagcaaggttaactttacactttttacgtagtatctgtctacgagggactgaatgtcaaacaatttacacagccataaataaagtaacattctccaaagcggttaaatgaaaaacttaaatttctttccaacagacgagctctctacagttaactgctacagcaattcctcattcattataagtactcagtgtttaccatcagcttgtgcaattctgtgccagctgaagacgaacgaaggccatcaggcgcggccccacttctcagactcttagggaaaaataactgaagacggtaagaaagctggggctgggaacctcgccccctctgagccacgtggtgccctttaccagcatggcagctgtggtcctcagcatgatccgagacccagatcctatccacaggaagctgggcatggtgcactgtgtgaccctcaggcccaagcccagcgccccatgaccatgggccagaggtatcctgtcccagagggctgaccagtgtgccgccagctcgaggacactttcctccaaatcccagagcaagttgtgtgtacaagaaatttttgtttctgttacataaacttatttcaatctagaacttgaaccttaatgaagaagaaccttgatccactgtacatgctataattggagctagagtttcaaaagatgcacaggaaaaacccggagtcttcgagagaaatggctgtgtggcctgcaggcttcctgacgcatccttcactaactgtctgcttgttcagtgatactattttcataaaaaaataactgctgtccacatcctctccagcaccagaacacttttacactgttggtgggagtgtaaactagttcaaccattgtggaagacagtgtggtgattcctcaaggatctagaactagaaataccatttgacccagccatcccattactgggtatatacccaaaggattataaatcatgctgctataaagacacatgcacacgtatgtttattgcggcactattcacagtagcaaagacttgcaaccaacccaaatgtccatcgatgatagactggattaagaaaatgtggcacatatacaccacggaatactatgcagtcataaaaaaggatgagttcatgtcctttgtagggacatggacgaagctggaaaccatcactctgagcaaactattgcaaggaaagaaaaccaaacaccacatgttctcactcacaggtgggaactgaacaatgagaacacttggacacagggtggggaacatcacacaccagggcctgtcatgggatggggggagtggggagggatagcattaggagatatacctaatgtaaatgatgagttaatgggtgcagcacaccaacatggcacatgtatacatatgtaactaacctgcacgtcgtgcacatgtaccctagaacttaaagtattaaaaaaaaaaaagtaactgctgtcaataaaagccagctgagttgaaccacattaggttggcacgatatttaggtgtgtgcgtccttgggtgtagaccccatgcaagtgggatgggcaatgggctgaagaggcgcccagtccaggccacctgtcgagggcctgctgggagatgtggggcctcaggctgcaccagccccatctccccaaggaccctaacggaacctgggtgacgtgacagaagctggtgtgcttcctcggtgttgaattcacatgctcatcatgcagggcagcggccctcccgcctgctgagccctgaggcctctggacatggccgctggacagagcctgcgtggagcccgcagtcctcaggctgtgcaacccctcccgtgcggcttcataccaagaaggggctgcaaccttgtctggttcctcaagacagagcagtcatggtctccagagcaccaggaatattaacactgaatgcatcaaaagcaaatcaacccccacccaagcccccctggggaagaggaggcctcacccgtcccgccgaatccccgcaaacagcttgttctccatgtcgccgtagcacaggctgcagagcagcgtggagaggatggagccctgcgggatcccctggcactggacgtaggacctggggcgggaagacacaggtgagagacgggcagggcatgtgctggacatgcgtacactcaaaccgagccacacacagacacagaacctcatacacacaaacgacacgtctaccattcagccggcaaacacctcagaaacataccagatgagacctctgaacaaacaatccctgctccccactctcaccatgcactggggcggctgaaacagatccagccacaggtgtgaccacatccttgctctgaatcatcaaggttttctttcattaaggtttcttaaatcttagagtttattcacagaaccagacacttgacccggaatgaatgcttaaccggactccttttttttttttcaaggaatttgtccacggtgaaagactcatgaccctacatgtagccgctgcgcgccaacggatacaaccttgcccctagtttcagcatgaccaacgagaagcagaaactctccaaacaaggatgccaagggtgcgttttcagacaaacagtgagagcagaatagccccgtggaacctaaaggtgcacacagaaggcatggctgccacgcgaccctcagccatccccagagcccacaggacgccactcctgttgctaagagacgcttgcagcctactgcaaaaacaagacctgttattttcgggaagcgctataggtggtcaccttaaaaagaggctttccggctgggcgtgatggctcacacctgtaatcccagcactttgggaggccgaggtgggtggatcacctgaggtcaggagttcgagaccagcctggccaacatggcaaaaacccctctctactaaaaatacaaaaattagccaggcgcagggggtgggtgcctgtaatctcagctgctcgggaggctgaggcaggagaaatgctggaacccgggaggcggaggttgcagtgagttgagatcgcgccactgcactcaagcccaggcagacaacagtgacgttccgtctcaaaaaaaaaaaaagaaagaaaagaaaagaggctttccttgctggtgcagatatcacagtgatgggcaagaggactgcactttttgcacagaagcacacgcaccaactctaggagtccggccagcccagcgagtcaacgcaagcagatacgcccctgtgagcacatgggatgggaaactctctctgttcttagtttttggggcaacaggttttgaagacgtttttattcagaggccaaactggaccacgatggggactagagcttcgggcctgtccgtgtcctagggacaggacagacacagtcacctcctgtctgtcagggcatgaggacgcagtcatcacctcacattccccaaagccctgccacacgtggacggtacgtgacttgatccatcttaataaaattcacgaccacgaaggaggcccgtggtggcttctctggggaggtgactttgtcagcgaattctgtgggcctgggggccgcttacacacatgtgcacacgtgtccctcggccaaaattcactctgctgccatgtgcaatttgtgtttttccagaacgtgtgtactacttaatatttctaattatactttaataaatattataattgctgataccattagtgattacttataatgcaataattaatagttatatttttaaataaaagcttccgaagctgtgcacagtcctttatccgctggagacgatcccagagagaggcctccacgttccacctgactgcggatgaccttgctgatgaccttgagtgtgcacgaatttcctccgtgctaccactctccccaggcacacacagggtcgcaggcagatgcctgccgggaggtgtgtggttttacttaaaatccagaggacgtgatgtggcaccaggcactgtggctctaccaccgtgagtgtggctcacccagtggctgtgtgacggcagctctcccaggccgcctgccccatggccaccacaggccccccgagaggagcaaactacacggtcaaccccgcactttccagatgggaaatctagtcacagagagaagagcccgcgccctcgcgggggtcacacgacagggacaggaatgagaatcggataaaatccttttgtatcgggagagagagatacaagcgtgtgagagccgggtgtccagcgtcagtagtaacttggagctgacaagctgcaggctcaaacgctcggcgcacacctgacccagacacaccccccgcccctcgtcctccacgcaggagcaactccacaccccgcttgccatttccaggcctcgtgtggcacctgctccgctccggctgccgcaagccgagccatgtttccggggcctcgggagcctgcagcccaggagccggagggggcgggggccagaaaaggagactctggtggccccgggcagaagggcagtggggaaggggcaggagagaggtgagcagaagccctgccagcccgcccagccacccgcagggcaatggcacctggccacctgactcacttgcccctgatgcgcacggcgtggtggcacatgaagcgtaggaagacgtcgaagaggccactgctggcctcattcagggaggagctctgcgaaagcagacgggagacacatgggagtgagccggtgggtgctgagacaggcaggaccacgtggccaagaccctccgtcccttttggggtcagtgtttgtgatgaagtgcggggctgggctggaatgcagggccatcgtgggctggccgggccgagtctctgcagacacacatgggcttaggcagagtgtgtgacacagaatgtctcctctgggccacctgtgggtccagctgggctcacacccacacagcccaccgtggcccggatggcatatgtgatccaggagttgctgcccagctgccgggcacagggtctgggtcccagcagcccaggccacctccacccccaccctgggagccaaggaaattcgcccagaggtctctgagcctcatgcggtggacacgactgtcccctagagccgagcaagtgctaacaggcatctgcaaagagccacagggccacgtggacagaccacatctgcaaagggccacagggccacgtggacagacccagcactgagaggcccgctcagcggggcgtggctcaaacacggcccgtcctcctaagaagggggacacgtttcctttggcctcagacccagcactgaggggccagctgggcaggacacggctcaaacatggcctgccctcctaaaggagggggacacctttcctttggcctcaagatcaaaactggcagagaagacatttagcaaatcatgaacaaaggcactgcggaactggagagaggccgcgcagtcaaacgtgagcaggtgcctgaatgcagcagctgtcgcagcctggcatggcccagctcagatttcgccaaggcacacagctcatcatgcccccatcacagctcattccccccactgccccccagggccaacagtctgtccggtcatgagcccagtgattgcccaggggaggacccactgctgggagtccgtgcccaaccctgcagggcagtgcccagacctgctcgatgacgacggcatccctcagcgggctggtctcctgcaggtgagccacgaactgtcgcatgtacggctggaggtctgtcaaggtagagacctgccggcagaggagagggcatgagccacaaatgtggcctgccccggccagagctgggcacttgtttcttccgatcaggacgtgtggacctgcggccaagcccgatggcgggatgaagcccagagagcgcctgggaagcttctgtttgggaaacgggggccggggggccgaggacgcaaagtagctacagacacacctgggactccacctgcagctaccacacatcagacccctgtgaccgatcaccatccacagtcaccacatcagaccccacgaccgccatccacagtcaccacatcagaccctacgaccgccatccacagtcaccacatcagaccccacgaccgccatccacagtcaccacacatcagaccccacgaccgccatccacagtcaccacacatcagaccccacgaccgccatccacagtcaccacacatcagaccccacgaccgccatccacagtcaccacacatcagaccccacgaccgccatccacagtcaccacatcagaccccacgaccgccatccacagtcaccacacatcagaccccacgaccgccatccacagtcaccacatcagaccccacgaccgccatccacagtcaccacacatcagaccccacgaccgccatccacagtcaccacacatcagacccctgtgaccgatcgccatccagtcaccacacatcagacccccgggaccaaccgccatccacagtcaccacacatcagaccccacgaccgccatccacagtcaccacacatcagacccctgtgaccgatcaccatccacagtcaccacacatcagaccccacaaccgccatccacagtcaccacacatcagaccccacgaccgccatccacagtcaccacatcagaccccacgaccgccatccacagtcaccacacatcagaccccacgaccgccatccacagtcaccacacatcagaccccacgaccgccatccacagtcaccacacatcagaccccacgaccgccatccacagtcaccacatcagaccccacgaccgccatccacagtcaccacacatcagaccccacgaccgccatccacagtcaccacatcagaccccacgaccgccatccacagtcaccacacatcagaccccacgaccgccatccacagtcaccacacatcagacccctgtgaccgatcgccatccacagtcaccacacatcagacccccgggaccaaccgccatccacagtcaccacacatcagaccccacgaccgccatccacagtcaccacatcagaccccacgaccgccatccacagtcaccacatcagaccccacgaccgccatccacagtcaccacacatcagacccccgggaccaaccgccatccacagtcaccacacatcagaccccacgaccgccatccacagtcaccacatcagaccccacgaccgccatccacagtcaccacatcagaccccacgaccgccatccacagtcaccacacatcagacccctgtgaccaaccgccatccacagtcaccacacatcagacccccgtgaccgactgccatccacagtcacgtggcacaagtggcactcgagctcccgggcctctccagcccagtgctggagggattgcagggatgcaggtgcagccacagcacaggcaggagaagagtctgaagacgcgggagagagaccggcacccccacctcctattctgcagactcccccaggacgcttgtcatttactacgggacctgctaagcccctgcgtccccaagacaggatgtgagcaggcacgtgacacacactaacacggacacaggaggcctcgagcttgtgaggcatcaaaagacgcgcacggtgactctgtgcttcagcatgttccccagcccccaggagctggcggcagggccgtgggctaaaaccacatcgagtacgattcaaccctgagaaccaacctggaaggcagtaacaggaaggtacatggggcctgcacccttcccaacccaggagcaggcaacacgcccacaaatagcccatgggtctgaggtcggcggaaagcatcacagaaatccgtaattattctggactcaacacagaaaagccaatatatcaacactgacgagaggctgctgaagcaggtctttagcacagggtccccaaccattgtggtaccagggactggtttcgtggaagacgatttttccacaggacagcagtggggaaggggatggttttgggagcaaacggttccacctcagatcatcaggcattagattcccataaggagcacagaatctagacccctctcacgcacagttctcagtagggtgtgtgcgcctctgagcaccgcatgccactgctgatctgagaggggcggggctcaggcgggaacgctggctccccacaccccacctagcctcccgctgtgcgccgggttcctaacaggccccagaccggtgccactccacagccaggggcctcgggatccctgctttagagggaaaacggcaacttcagatgcttgtttagaaaagaaagttcaaacatccataatcgaaacttttccttcaaggagccggaaaaacaacaataaacaaagcctaaaggaaatggaaggaggccatcgataaacagcagacaccaattacgcaggaaacagccgggaaatcagcacacgtgaaactcttctgtgaagagagtcatgaaatggaaagacccctagcgagacctggagaaggaaaacggaggttgtcagcaccaaggctgcaggcagctatcgctgcagatctcacggaagctgcaggaagcgagtctcggccgggcgcggcggttcacacctgtcatcccagcactttgggaggccgaggtgggaggatcacctgaggtcaggagttcgagaccagcctggccaacatggagaaacctcgtctctactaaaattacaaaaattagtcagcatggtggtgggcgcctataattccagctacttgggaggctgaggcaagagaattgcttgaactcaggaagcacaggttgcagtgagccaagatcacgccaaaccactccagcctgggcaaaaaagagcgagactctgttatcaaaaaaaaaaaaaaagaaagaaaaaaagaaagaaagcaagcctccaactcgcaggggaattccaaggacggagcgtagccagggccacatccaggccaatgaacacaaggaggcctggaagccctgcccaccggccacacaccacagcaggcaccacacgaccccagagtggaagaaacagaacagggagcccaggggaggcctccacacccctgacttactataaacccgaccatagttcaaaggaagatatggtctcctcaataaagctgttggagcacctgcagacccactacaggaagaaagctcgccttgaactctgtgttaccccactcataaaaaccaatcccacagatccccacctatcccacacatgaaaaccaatcccacagatctccacctaccccacacatgaaaaccaactccacagatccccacctaccccacacatgaaaaccaatcccacagatccccacctaccccacacatgaaaaccaatcccacagatccccacctaccccacacatgaaaaccaatcccacagatctccacctaccctacacatgaaaaccaactccacagatccccacctacccccacacataaaaaccaactccacagatccccacctaccccacacatgaaaaccaatcccacagatccccacctaccccacacatgaaaaccaatcccacagatccccacctaccccacacatgaaaaccaatcccacagatccccacctaccccacggatgaaaaccaattcacagatccccacctaccccacacataaaaaccaatcccacaggtccccacctaccccacacatagaaaccaatcccacagatccccacctaccccacggatgaaaaccaattcacagatctccacctacaccacacatgaaaaccaactccacagatccccacctatcccacacatgaaaaccaatcccacagatccccacctaccccacggatgaaaaccaattcacagatccccacctaccccacgcataaaaaccaatcccacagatccccacctaccccacggatgaaaaccaattcacatatccccacctaccccacacataaaaaccaatcccacagatccccacctaccccacacaagaaaaccaatcccacagatccccacctaccccgcacatgaaaaccaatcccacctaccccacacataaaaaccaatcccacagatccccacctaccccacggatgaaaaccaattcacagatctccacctacaccacacatgaaaaccaatcccacagatccccacctaccccacacatgaaaaccaattccaccaatccccacccaggtttgcaagctgacacagtaaagactgttctaaaaggaggcgcagaagcaacgtcaccacaacctcaataccttgagttcctgcagagaacacaaacagctttagccacaaacagctgataaagtggactgcgttactggactgtgttagtggactgcgatagaagtacaatcttccagtcctcaaaaggcttgacttgagagcacaaaagcaagacacacacggcacagagattcacagtgcacgcatgtgatgccacacttgcagcagaacacacaaagagctcctgcaagccgatgatggcaggcaggcgccccatacagagcggggcaggacggacagccacctcccgcaagagccccggggcggccagcacgggaacactgtgggcacgtgggcatcaagagagccccctgcacaatcccacgaggcggcttcgacaccttcaggccagcggccaccggaggcatcgccctcacaagcagccagccggggtgtcactgtcacccccctggaaactcccacaacatccctaaagcacgtctgtgacccagcaaccccacccctggaattcacccagaggcgagggcctctgacccctgggacactcccagaacccagcaggctcacagcaggcgcagccgtgcagtccgcacccaggagcctccacagcagcgggaaggatacatccacgtggcgagttccacaacggatgccattcatggacagaacgcacagctgaggcgttcagcatagctgaggctcgaaccccaaaacccacctcctgcctgatctcactcacatggagaccgggagagggagaccatggaggtcgaggtcggaacgagggtcacggtgggggcggtagcttccgctgcagcggggatgtgggggggggtctcctgggctctggtgactttctacacccgggcacaggtgggcggtggggacgggggggtctcctgggctctagtgactttctacacctgggcacaggtggtggccatcagctttccatgagggtaaaattctgctgagatttgcaagtagctgcgatagctcaagaagtcagagaaagaggtccttgtgggtttccacatgtgcctctccccagaccgaagctccagggatacttcttcacctctgcaccccggcctggcacgactttgagggcttacccctccagcgtgctcatgaccactgggtgggaacccaagcccagggcccctttcacccctgccgagccccaaggcccccggccgctctgggaggagtgtgtcccggggagcgaggcctgaatcagccttcctatatctcatggagccggcataggccagactggggtcctgggggtgccaggggtccaggaaggtaccaccagcatccctactctcctctcaaacctggcttacagtctccaaggcccagccctgtgacaggacaggggcacccatgctagaagtgaggaccctgaatgtggagctccccaaaccagcacccgagagcgtgaggacaatggtgcggaccatgcctggaggaggaaggagtaaggccaaggggccacacacacccatgccatagacacgcatatgtcacggacacatgcacacacacacaccacaaataggcacatcacagacatgcagcacacagcatgaacatgcacgtgtcacagacacacacacatgcacaccacaggcacacacaccatggacacacacgtgccacacacacacacaccacaaatatgcacgccacagatacatgcaccacgacacacacgtgccacacacgcatatcacagatgtgtaaatcatggaagtacctccaccacagaaacgcatcacagacacgactgcattctagacacattcatatcccagagacacacatcctggacacgactatcacacgtgaaccttacgtggctcttgaaggccttgcggacgtgcccatgggcggccttctggaccacggcataccgacgcacgcagtacgtgttctggggtttgatgatgctggcgatgacctccgtgagcctgtcctgggggatggtgtcgtacgcgcccgtcacatccacctgtgtgagtggaggcgaggagactgacagtggccacgcagaaactcagacatcacctctgccctcagggcctggcctggcggtgtcccccactctctctctgacccccaccactccagaccccaagggcagggcgggctgtgtcccctctctgagcctcaggacaggagacccctggctcaggactggggtgcaaggcaccggggcctggtggctgagccgttgcggttccttctctgacggaaactggaatccagtgggaccctccttgggaataggagcccgggcagtcagggtgcacagtcggccccatgtgctgcaggaaaggctgaaggcctccaccctaggtgccaggtgtgtcctcaacagtgacagggtcacctgcactccctgcggcccacccaggagtacctcctccacccaacatgaggtgccaatcaggcagccactcccaaggtccagcagggctgctcacgggggtccccggcacccaccttgacaaagtacagctcaggcggcgggtcctgggcccgcacacgcagcacgaaggtgcgccaggccctgtggatatcgtccaggcccagcacagaggcgcccaggaggccggggcgccgcgcccgctcgtagttgagcacgctgaacagtgccttcaccctcgaggtgagacgctcggcctggcggggacagcatgggagacagtcaggaaagtggatccggccaagtgcccaccccaccatagggacccaggggagaagcagcccctccccagtgtccccagccacccagacccgggacctagaacccctcccagcttcctcagaccctgtttgaaacgggttcctggccgcatgtgtgttgcacacgggatcctcatgccacacctctgtccacctcaccccacactctcctcagatgacggggtcaccgcagccaccgcagccacaggggtggggtgcaggagccgtggggcaaggtccaggatcctcagagcccggtgggctcctggcagtcgtggcctggtccccgggccccgtaagcggaagcgcacggaggctgcgcaccacagcaggacacggatccaggacctcgggccgtgctgcatccaggccctggcccggctgcttcttgtggtcctcagagcctgtccctgccccaggagctccccctacacccccacgctgcttttctggaggcaccggcacctcggccacctcactgtgcgcacaaatgggttggcgccgtgccatggccctggctgtgtcccgtggcccctcctccgggcccttcatctaagctgataccaaatgtggggctcaaacgcacttctgtttaaaaaggaagttaaaccaaagcacagccaccctcttttctctgcggaacgttctggctcccacgacgtagtccatgttcacaatcggccgcagcccgtcaggcttggggatgaagcggagtctggacgtcagcagggcgggcctggcttcccgatgctgcctgacctctgcttccgacagctcccgcagctgcaccctcttcaagtgctgtctgcaatagagagcccctcaggaggcttgctcagccagacaacagactagggggaagctcacgggaagccacaagcccccaccgactcagtgagggctcagggcacccacggcagcacacgctgaaggccatgcccggggccacgtccacccatgccagccagacgcctctgagagcccctctacttgcagggcacctggacacctggtcctatagtcaaccctggggacgcccagtccggcggtcaacccccagggtgactgtcccaccatcagcaccagggagcctggtcccaggctgcatctggggccacgtgaacccatgcccctccacacaggatgcctgtccctctggtacagccactggggtagcccaaggctggccccaggcaggacccccaggtagaaagagccacatcccttcagatggagagggcgggagaggctgctcagggcagctcagccaaggagcagaatcagctctcatgagcccaccagtctcctgacacctctgccctttggccttttcccccaaaaccacccatgggggcacgggggctggagcggccacacctggacctgggcatctgtggctgacagcctggcactccgtggacactggggccgcgggtgctccggagctggtgccctgaccgcaggccgcaggcccagcagagtagaaaaggcacggtaccctgtccagggaggaggggcctccaaggccccccaggcagaacaacagtcccagtagtgacaaggagcatcttggggaccaccacgtctgtctgctccttccggtcaccccaattaaattctttccaaaatactggtcaaatgaccatgttgggtcgcacaccattaaatacgtgtaaagtctaagtaaggtgcattgtgtattaacttgttcccacagggaaagccctgaccctcccccagatgcaaggaaatggccccagcaccacgtcggggtccccagcccagaggctgtgttacctctgacgaggtctgctgccagctccctctgcagacatcctgatttggggcatggggtgtcacaaggccccccagggactcgagtgtgcaggggagctggggaagccctgatcttctgactaaagccctccacagtcagcctgggcgggacacggagaagctaataccatggcctgggctcagccaggctggcatctcccagaccagcgctcccgtccctcactgatgcaaatccagcttgaatctgtcacaatctcacactctcatcagccgaacattgcagacaaaatctcacagccattcaaatgcagccacctagaagttagctcatggtggaactctcctatccccaggtgctccctgcacaggtgctccctgcagtgagtcgccaagtgggtgggattttatcctctcatgacctaaatccaatagattgaagattcatacagaacagcatgaattaaaagagaatcgggggctgggcacggtggcttagcctgtaaacccagcactttgggaggccaaggtgggtggatcacctgaggtcatgagttcgagaccagcctggccaacatggtgaaaccccgtctctcctaaaagtacaaaaattagccaggcgtggtggcaggtgcctgtaatcccagctacttaggaggctgaggctggtgaatcgcttaaacccaggaggtggaggttgcagtgagccaagattatgccactgcactccagcctgggcaacagagtgagactccatctcaaaaaagaaaaaaaaaagagagagagaatcagacccacatcccagggaaaggcaaggaggctagtggtagtgtttccatctaatttaaatcccttctgctttacaaaccctagagaccacttggcacaaactcctgattttacaagtaagagaacgtgagctccaggcagtcagagccttgcacagaatccacttggaccaggcctgtgacggggcccctggctcccagcccagagctgcacagccagggaagcacaggcaagtggagacaggcgcatgctgaggccgggctggtgttccaggacttcgagaagcagaggcctggcgtggggatacagtacctgattccaatgctttgcaacttgctccagacactcttccggtagaaaaagagcctgttcttttgaaacgtggtctccgtgacataaaagaaagacctgagcagctcgacgacgtacacactcatcagccagtgcaggaacttggccaggatctcctcacgcagacggtgctctgcggccggaacacagccaaccccttaaacgagaaggacatgccacatccagatcaccgagggcctggtgacctcaccccggacctgcaccatccggacaccgcacatccagctcaccaagggcctggcgacctcaccccagacctgcaccatccggacacggcacatccagcccaccaagggcctggcgacctcaccctggacctgcaccattcggacacggggacaccgcatatccagctcaccgagggcctggcgaactcaccccggacctgcagcatccagacaccacacatccagctcaccgcagggcctggcgaactcaccccggacctgcaccatccagacaacacacatacagcccaccgcagggcctggcgacctcactccggacctgcaccatccgtacactgcacatccagctcaccgcagggcctggcgacctcacgccagacctgcaccatccggatacagcacatccagctcaccgcagggcctggcgacctcaccccggacctgcaccatccggatacagcacatccagctcacagcagggcctggcgacctcaccccagacctgcaccatccggacaccacacatccagctaaccgcagggcctggtgacctcaccccggacctgcaccatccgacaccgcatatccagctaaccgcagggcctggcgacctcacgccagacctgcaccatccggatacagcacatccagctcactgcagggcctggcgacctcaccccggacctgcaccatctggatacagcacatccagctcacagcagggcctggcgacctcaccccggacctgcaccatccagacaccgcacatccagctaaccgcagggcctggtgacctcaccccggacctgcaccatccggacaccgcatatccagctaaccgcagggcctggcgacctcaccccggacctgcaccatccggacaccccacatccagctcaccgaaggccttggctacctcaccccggacctgcaccatccagacaccgcacatccagctcacagcagggcctggcgacctcacgccggacctgcaccatccggacaccacacatccagcccaccaagggcctggcgacctcaccccagacatgcaccatgcagacaccgcacatccagctcaccaaaggcctggcgacctcaccccagacctgcaccatccggacacggcacatccagcccaccaagggcctagcgacctcaccctggacctgcaccatccggacacggggacaccgcacatccagctcaccgagggcctggcgaactcaccccggacctgcagcaaccggacactgcacaaccagctcaccgcagggcctggtgacctcaccccagacctgcaccatccggatacagcacatccagctcacagcagggcctggcgacctcaccccggacctgcaccatccggatacagcacatccagctcacagcagggcctggcaacctcaccccggacctgcatcatccggactccatacctccagctcaccgagggcctggcgaccacaccccagacctgcaccatccagacgccgcacatccagctcacagcagggcctggcgacctcaccccggacctgcatcatccggactccatacctccagctcaccgagggcctggcgaccacaccccagacctgcaccatccagacgccgcacatccagctcacagcagggcctggcgacctcaccccggacctgcatcatccggactccatacctccagctcaccgagggcctggagacctcacccctgacctgcaccatccggacaccgcatatccagctcacagcagggtctggcgacctcaccccggaccggcaccatccggactccatacatccagctcaccgagggcctggcgacctcactccagacctgcaccatccagacaccgcacatccagctcaccgcagggtctggcgacctcaccccggacctgcaccatctggacactgcacatccagctcaccgagggcctggcgacctcactccagacctgcaccatccagacaccacacatccagctcacagcagggcctggcgacctcaccccagacctgcaccatccagacaccacacatccagctcacagcagggcctggtgacctcacaccggacctgcagcatccggacaccccacatccaactcacagcagggcctggcaacctcaccccagacctgcaccatccggacaccgcatatccagctcaccgcacggtctggcaccgtctggcgacctcactccagacctgcaccatccagacaccgcacacccagctcaccgcagggcctggtgacctcaccccagacctgcaccatccagacaccacacatccagctcacagcagggcctggcgacctcaccccggacctgcatcatccggactccatacctccagctcaccgagggcctggagacctcacccctgacctgcaccatccagacaccacacatccagctcacagcagggcctggcgacctcaccccggacctgcatcatccggactccatacctccagctcaccgagggcctggagacctcacccctgacctgcaccatccagacaccacacatccagctcacagcagggcctggcgacctcatcccagacgtgcaccatccggacactgcacatccagctcactgagggcctggcgacctcatcccggacctgcaccatctggtacaacagccatggccatgggaagcccagcaggtccaggccgagatggccacgcacgggacctacacacgggatcccgcagacaaagctcaaaaaatgtcaaatgtcctgtgagtgatgctcccaccaataacaccctaaaatgatgaggtgtggacatgctgggcttcagtaaaatctattattacattaatttcaccttttcttttttacttttttaatgtggctactagaatttttttttttttttttttttttgagacagagtctcgctgtgttgccaggctggagtgcagtggtgcaatgtcggctcactgcaacttccaactcccaggttcaagcaattctcctgcctcagcctcccgagtagctgggattacaggcacccgccaccacgcccagctaatttttgtgtttttagtacagatggggtttcatcatgttggccaggatggtctcgacctcctgacctcgtgatccacccgccttggcctcccaaagtgctgggattacaggcgtgagccaccgcgcccagcctagaaattttaaaattatccacatggctcacgtcatgctcctgttgggcgacaacggctcggagcctcatcctttgtcctggttcccaagcagaagggaggaagcagacactcccccgccaggcagcaccgtcagagctggcgccacaccgcaggtttgcgcgatttcaaactcgacaccgcggagccaccagaccccgacatgcctggggttttccaggctgaacccaggccgagcggacgttgctgtcactcactggctaaggaacgctggccacgtggtgctccagacactcacgggccaagatgaccgccctcctcgtgagtctccacatcttcatctgtgcatcataagcagaggtccccggacgtcgctagatgccatggaggccagcacaggtaaagctggggtttaccagcaataacaagacagaagaaccacgcaaaggacaaggaaggggaccccagacggcgggcctgagacagaagacagacggggaacaaaggaggaaaagcagggcgggggcaaagctacagaaacactcaacacggaaaacaatattaataatgcttagcttgtgggggtgtcaagatgcctgagatagaactaagtcagcagggaaaacagcacacaggctggggggtggccagagctaaaatacactaagggtcttattgctcaggacaagggtagcaatgtttcagacttcattttaaaagatcaaggtatgccgggcacggtggcttgcacctgtaatcccagcactgtgggaggccaaggcgggcagatcacttgaggtcaggagtttgagaccagcctggccaacatggtgaaagcctatctctactaaaaatacaaaaattagccaggcgtggtggtgggcgcctgtaatcccagctactcatgaggttgaggaatgagaactgcttgaaccgaggaggcagaggttgcagtgagccgagattgtgccattacactccagcctgggtgacagagtgagactgtctcaataaacaaaagcaaacaacgacaataaaaagatcagggggtaacactaagcaaagagaaataaaagcaaatgcccagtgaccaggaggcaacgagaggatcaacacacactcggcaggaaacgcacatggcaacccaagaggtggtgagaaacaagggaacgaggacatgcaacaggcaagtggagaatcagagtgcaccaggcgggtctctagtgacaaaaaaatgaaaataaatcaggttatccagttaaacaacgactgtcagactggattggaaattcacctacatgctgttaacaggacatacccacactataagaatataaaagtgttgaaaattaggccagacatggtggctcatgcctgtaattcagcactttgggaagccgaggtagatggatcccttgagtccaagagtttgagaccagcctgggcaacacagcaagaccctgtctccagaaaaaatttaaaaattagccaggtgtagcggtgcgtgtctgcagttccagctattcaggaggctgaggtgagaggacggctcaggccagaaggtaaaagttacactgacctgtgatcacaccactgcactcaccctgggcgacagaccaagactctgtctcaaaaaaaaaaaatatatatatatatatataaattaaaggcagaaaacagacacagcaggaaaatactaatcaaaagaagcccagtgtggcagtactaagagcaatttaaaaaaagaattactagattactagagacatagaagtctccaaaagattcactcatcaggaagataaaaattctaccacgtgcatgcacctaacaatgcctcacataaatgctaccaaacgagaagaaatgaacagacccatcccccaggtgagggactatggcctccttcttggaatttcatgcatctagaaggagacagaagctttgcactggaccttaataagctggatatagtgaacatgcatgcccactattgacaggatgtcaaatttacaatggacagttctggaaaccatgcacacactagatcacaaagcaaggctccgcaaacttcaaataattggtattatacagaccactacacaactgagttagaaatcaataataaaatgataacttaaaatactctacgtatcttgatactctacatatcttgaacataaacagtgttcaaataactcactgctcaaagaaatcacagaataagctaaagaatacttaaaagtcactgatatcaaaatgatttcacgtcaaaacacagcgtgcacaaagaaaaaaatcacagaataagaatacttaaaagaagtattaacactttgaagtattttaagaacacttgaaagtggctgatgttgagattacttcacatcaaaacacagggtgcaggtaaggcagcacttagagggaaaggcatgactaaactaagaagctagaaaaggaatgaaagaataaaccaagaaaaagcatacaatggagagatagaaacgtcagaggtaaatcagtgaaattcaaaactaagacccaagagggaagtctgacgaaggctggcggagacaccggccctccacgtgggtctcagagcaggagacagacagagacactccaacctgtggctggacgtcaatccatgtgagggggcgactggaggcagagcccagcctaagcaatgagcggcaggtgcccagaataaggtgacaagcgttgccacccacccaagggggccaagcagaggggcagcttgggagaaaacaggacaagtgagggggctggggtgacttgctttccttcagggcacagagaaccctttctgggatgtctccagcaacacgtggcagcagacacaggcagcccagagtccagcctcggcatgagacaagctgggagaggagtattggcagcatgcatgtggcgggcacgtggtgagcaagccaggcccaacagaggcaagcggacctgaagctgtggctgcagtgcctggcacgcgggaggcgagagcctgcagtcccgtgtccccgtagcaaaatggaacggagaggtgaccaagaagagccgagcatcagaaaagataggcttggggaccagcactgcgcctgcaccatctacccaggcaatgggcaaccggcgcagctgtggctatagaaagagcaaacattcaggagcaagctcaagtgagcaaacgccaaggacacctggggacagagcctcactcaccctacacgagacagggacacccagggacagcgcctcactcaccctgcacctgagagggacacccgggggccgcaactcactcaccctacacgtgacagggacacccggggacggcgcctcactcaccctacacgtgacagggacacccggggatggcgcctcactcaccctacacctgagagggacacccagggacggcgcctcactcaccctacacgtgacagagacacccggggacagtgcctcactcaccctacacgtgacagggacacccggggacggggcctcactcaccctgcacgtgacagggacacccggggacggcgcctcactcaccctacacgtgacagggacacccggggacggcgcctcactcaccctacacgtgacagggacacccggggacggcgcctcactcaccctacacgtgacagggacacccggggacggcgcctcactcaccctacacgtgacagggacacccggggacggcgcctcactcaccctgcacgtgacagggacacgcggggacggcgcctcactcaccctgcacgtgacagggacacccgggggcctcgcgtcaatcaccctgcacgtgacagggacacccggggacggcgcctcactcaccctgcacgtgacagggacacccggggacagtgcctcattcaccctacacgtgacagggacacccggggaccgcgcctcactcaccctgaacgtgacagggacacccggggacagtgcctcactcaccctgcaagtgacagggacacccgggggccgcgcctcactcaccctgcacgtgacagggacacccgggggccgtgcctcactcaccctgcacgtgacagggacacccgggggccgcgcctcactcaccctgcacgtgacagggacacccgggggccgcgcctcactcaccctgcacgtgacagggacacccgggggccgcgcctcactcaccctacacgtgacagggacacccgggggccgcgcctcactcaccctgcacgtgacagggacacccgggggccgcgcctcactcaccctacacgtgacagggacacccggggacagtgcctcactcaccctacacgtgacagtgacacccggggaccgcgcctcactcaccctacacgtgacagggacacccgggggccgtgcctcactcaccctgaacgtgacagggacacccggggacggcgcctcactcaccctacacgtgacagggacacccggggacggcacctcactcaccctacacgtgacagggacacccggggacggcgcctcactcaccctgcacgtgacagggacacgcggggacggcgcctcactcaccctgcacgtgacagggacacccgggggcctcgcgtcaatcaccctgcacgtgacagggacacccggggacagcgcctcactcaccctgcacgtgacagggacacccggggacggtgcctcactcaccctacacgtgacagggacacccggggaccgcgcctcactcaccctgaacgtgacagggacacccggggacagtgcctcactcaccctacacgggacagggacacccggggaccgtgcctcactcaccctgcacgtgacagggacacccggggaccgcgcctcactcaccctgcacgtgacagggacacccggggaccgcgcctcactcaccctgcacgtgacagggacacccggggaccgcgcctcactcaccctgcacgtgacagggacacccgggggccgcgcctcactcaccctgcacgtgacagggacacccgggggccgcgcctcactcaccctgcacgtgacagggacacccgggggccgtgcctcactcaccctgcacgtgacagggacacccggggacggcgcctcactcaccctgcacgggacagggacacctggggaccgcgcctcactcaccctgcacgggacagggacacccggggacagtgcctcactcaccctacacgtgacagggacacctggggaccgcgcctcactcaccctgcacgtgacagggacacccggggacagtgcctcactcaccctatacctgggagggacacccagggacggtgcctcactcaccctacacgtgacagggacacctggggccgcgcctcactcaccctacacctgagagggacacccggggacagcgcctcactcaccctacacctgggagggacacccagggacggtgcctcactcaccctacacgtgacagggacacccggggaccgcgcctcactcaccctgcacgtgacagggacacccggggacagcgcctcactcaccctgcacgggacagggacacccggggaccacgcctcactcaccctacacgtgacagggacacccggggacggcgcctcactcaccctacacctgagagggacacccggggacagtgcctcactcaccctacacgtgacagggacacccggggaccgcgcctcactcaccctgcacgtgacagggacacccggggacagtgcctcactcaccctgcacgggacagggacacccgggggccacacctcaatcacgctgcacgggacagggacacccgggggccgcgcctcactcaccctacacgtgacagggacacctgggggcaacgcctcactcaccctgcacgtgacagggacacccggggaccacgcctcactccctgcataagccaggggcagattgtgacctcatctgaagtcagagaacagcaatgacaggcagagtcctgatcagagaactcaaactctcctcaacgaaggaagctggagcacaaaaagcaaaactgggttgcatgacgcttatctgactcggcgtggtccacctgagccgcagcaggtgtgaggcagctgccgttcgatgggtagggacttccagtcacgcaagacgcagcatttcaagcaacctgctgtaaacaccgccgagttagcaattctgcactgtacacagaaaacggtgttaggagtgccaatctcatgttatatgacttttgccaccataaaaagaaaaaaagaaaaaaaagagccccaagaaggtcaccctccttgtctgcatggccggaagtcttacatgtcttgggagtttgtggggagggggtgaaatcgggacttcttctagctgccacggtagggcctgggagcactgggagccaaaagggggctggagcggaggttcctcaacatcaaatccagaaaaacagggtggggacacggcagggcccagcagcaccatcccctgaacacccacaaacactgtcccttcctcagcaggtggagccatctgctgtcctctgctcccatgtggccctcttcatacctaaagatgggaccaggatctgtgctggagaacagtcttatctccctccctctaccctgtcctggcacaatcaacgaacactttttttttttaaagacagagtttcactcttgtcgcccaggctggagtacaatggcacaatctcagctcactgcagcctccgcctcctgggttcaagtgattctcctgcctcagcctcccaagtagctgggattacaggcacacaccaccatgcccagctaatttttgtatttttagtacagatagggtttcaccatgttggtcaggctggtctcaaactcctgacctcaggtgatccacctgcctcagcttcccaaagtgctgggattaccggcgtgagccaccgcacctggccgtcaacacacaattaaatcttaaacacaaacctgcatattggctgaccacgtgcacctgcaaaacccttacctcccacccccaggaagagggggttctcgtccccacctctcattcccacccttgaaattgcgaagaggattataggtaacctgcaggcaccctcgccagagcgtctgtgcttccagacacttctccccattgccggcaacccggctccactgccgcgcccagcctcctctgttcactgctctggcctcggcgcctggaaaccgcgtgtccatcaaaacgtgaaggtgaacctcgtaagtttatgcaaactggacaggagggagagcagaggcagagatcaccgtgtccactcgacgtcctgagcgaaaagccacgtgtgcccacgtgacgatggagacaggaggaccagggctctgcctgcccccttttctgagcccctactgcattcagctctggggcctgggccctcgacggccaccacctcctcacctgggctcctgcgcagccaagcgcagtcccgcacgctcatcttccacgtcagctcctgcagcgagagcttggcatgcttccccagggagatgaacttcttggtgttcctgaggaagcggcgttcgttgtgcctggagccccagaggcctgggggcaccagccggcgcaggcaggcccgcacgaagccgtacacctgccaggggctgctgtgctggcggagcagctgcaccaggcgacgggggtctgtgtcctcctcctcgggggccgccacagagccctggggcttctcccgggcacagacaccggctgctggggtgaccgcagctcgcagcgggcagtgcgtcttgaggagcaccccgtaggggcactgcgcgtggttcccaagcagctccagaaacaggggccgcatttgccagtagcgctggggcaggcggggcaacctgcggggagtccctggcatccagggcctggaacccagaaagatggtctccacgagcctccgagcgccagtcaggctgggcctcagagagctgagtaggaaggagggccgcagctgctccttgtcgcctgaggagtagaggaagtgcttggtctcggcgtacaccgggggacaaggcgtgtcccagggacgtggtggccgcgatgtggatggggggcccgcgtggtgctggcggcccacggatgggtgggagtggcgcgtgccagagagcgcaccctccaaagaggtggcttcttcggcgggtctggcaggtgacaccacacagaaaccacggtcactcggtccacgcgtcctgcccgggtgggcccaggacccctgcccaacgggcgtccgctccggctcaggggcagcgccacgcctgggcctcttgggcaacggcagacttcggctggcactgcccccgcgcctcctcgcacccggggctggcaggcccagggggaccccggcctccctgacgctatggttccaggcccgttcgcatcccagacgccttcggggtccactagcgtgtggcgggggccgggcctgagtggcagcgccgagctggtacagcggcggcccgcacacctggtaggcgcagctgggagccaccagcacaaagagcgcgcagcgtgccagcaggtgaaccagcacgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctg

SEQ ID NO: 2790 - DNA, 41876 bp, Homo sapiens; identical to SEQ ID NO: 2789
  source 1..41876: mol_type = genomic DNA

SEQ ID NO: 2791 - DNA, 75914 bp, Homo sapiens
  source 1..75914: mol_type = genomic DNA
ttactatgcatgtaaatattaaaactttattagcagtatgctatcaaaggcatcacgtatacatataaatattaaggaaatgccaaaagcacaaatattaacataggcatgaaatgctatccaatcctagaaagaacatggatgcatgaatgcagaaggcgttcagaaagacttggtaaatatgagccgcattcttccaaccatcatttgttccttcttttgtaactgtggatcacaaaattgataaataaaaaatgtgagtcatctttatatgtttaacactgtggtcaatgctgagggtgggggaagtctataaactgtatagtacattatgtttttcttcaaaaaaatcttgtaatctagacagtgaggcagagcaaacacaatatctaatagtacaagtattgaaggaatcatagtaagaagccaggggagagagacagaaagaaggcctccttatggtagtgaaaaggcagattggttaagaagattaggagggtcagtcaattttaggtggggaaaataacataaaacatcctttagaataagagtgagtaatttgtgtttaatgataatgaaaaggccaatttgaatggacggaaaaaagttatatttaagggacagaaaatatctgcaatagatagaggactagtggacaatgcagacaaattttaggcaagtggatgaagctaaattaccacatgatcgatgactagaaataggacagtgatgtcaaaaaggtcatgtataatttgttacatatgactgttcctttttgtctctctctctctaatatgctttagtttacttatgttagatatataattacattatgtgttatatacaatatctgagtcatatctgagctttctgatatctatttatttatctatttgtctcatgtctatacagcctggtttgcctaagcccctattagtttatgcttattttggggggatatcacgttcatatatatatatatatatatatatatatatatatatatatatatgatttaaaaatactgaaatacttttaaatataaaactatttttgtagagtcaccaaaacgacaattccatttttaagtcaatgcatacatatatttaaaatagacatataccttaattttttagcaccctctttaactatcattagtgttccaaattggatgacatgattgtttagggaatctaaccatgaaggattgatgatctgaatgaaataaataggaatgaaaatggaagagagagaaataaacatttcataaaaagcaatgaaatttaatgaatgactggaagaatataagtgatacaaagaaaattactaatcattcaaattggaataaccagaaaaacagtagaagaactcaaaaagttcggaaagttggaaatgtcgaaaagataaagaacaattatacaaataaacatcttttgaccttgaagccccatgatactcctctgtgacaataatctcaacttgtttctaatgaacacattcaaactcttcgagtttccatatatgcattaatttaattctagtatgaattcttcttaaaatattagtcatgattttgagactgtatatttactgatgcatttatctgaataaccagagactttatgagtgtctgaaatataaatttcttctgcaaatgggaacttacaaagaagttgtttaacaaatgagaatctaaggcctggtgaattaagtgtattactctgaatcacatggataataataatgagtaaccctacacgaactgactagatatcaggcactgtcctaagaaagttatgtattttgactgatttaacctcacaacacaacctatcaacttagtactataatattaccatcctcattttacattggaaagatgaaactcaggttaagaaatatcttagggtcacacagctattagttgaagagttgggaatttaacgcatgtcttcaggctcaaaggttttttatctgctatatcattatttcaatcatgggggaaatcaagaagaaccagttgtgatggctttcagttctagcgtttatgcgcaaaattgcacacatttagggaaattgctttagaaatatttcaggtggagagaacacacatttattttaactacatggatatactcaacacagccaatcaaactgaaataatgcactcacgctcagggatatgcttacaaatcattatttaaaatctctttaaggaagagtaagactgtctttgagattacctaaataacttgttaatattgaaatgtggaaataaaaagaaaaattacaccggaattgtgcttagtaagtattcaagtatctcgaatcaagaaagcttactggaaaaatatatcttgaaagccatttacaacattccagtaattaaaaataaatagcaatttttaaaaagtcatattatgataatgtttaactaaacttctaaaatgcttccataatatcatgaagaaaaacattaaaattatatttataaatatttcacttaataataattgaattttagaatattcaaatactctacttaaagattgttatttagtggaaagaatttaaagactggtattccatttatgttgtggggcagattattattcctgtacattgaattgaaactttaaaggatttacagcttttcaaaataacctgataccacagagaactttacacgtttgataaaacccttgaaaaacaaagttttatgtaaacaaagaattgcattttcttaaactacaatagaatgtattaatataattgtaagcagtgacagatgtaattatatttgattggggaaattaagaggtgtctgtagatctcagcaaacccctcagacagaagtgacaaggggtcatctaggttttagaacagagtacagggacatctgcattcccacttccgcatcttggctggggcagattcgaaatcacgtaggttttaagaagaatggcaacatagcttcattgacaatccaccttatgccatccttaatatcaaatgtctcctagttactgcaacattgtttcatgttttagattaggaaggaagaaagggagggaagggaggggaggggcggggaagggaagggaaggaaatgctcttagaaaaaggaaaaggggtcaaattggccggaggaatgttgattttgaggccaatatatacaatcaaaaataaaacagttttttagacaaataaaggagacatttgccctaattttaaatgcagttacgataacattattccttaaatgtctattattctgaataaattattgttaatattgttttcttttaaattcatgttgtcaattcttactgcttagttaataatttacttttacaagcatttatttatttgttacaattttcaatgtgcatctacacaataaactaaagaagacatatcagaggccatttaaaactcattaatattactttctcacactaatttttattttgccctttctaacttggtagtatgcttaccaaaaattttaaattttatacttcaaaaaaacttaaggcaaaattattccctaacctactctactcactttaatgataaatgactgcagatctccacttgaattggtaaaataattcaaacaaaagtattcaagcatgttgcaaactgatttcatacatttcttgtacttactgatatactgtgtcacatgtatatttaaacctgttaatttagtcattctaaattttcttttacagcagtaagatttaacgtgcttttgaaaatataataactgaataaaacaaaatacgagtgaaaaatacaaagctggaaagacataaagaaataatgcaacgatagtacttaatttttcagataagtcagaatcacaaaagtattaatttttacgaacgaagtagtatttaaaaattagactcaagttcatctggcattcaattcactgctctacctattgaatgtaaggacctgaagtcattttgaatatatcgtattttccaactcccactgaaagtttgcatccccttaatgacctcttaagtgttaattgcacacttattgaatgcctacaatttagggaatttattaatacctgagacagccatcaattttttaagatctcacataagaaagaaacatattatagaaaggcatttatactttagttctcacacattaatcctcatgcttaggctgggttgagggggataagggaggatggggatgggggtctggggagggtgtgaaataggcaggactaaagggtaagtcatgtagagaacttaattctcctttcacataatagtgtttcagttattaaaagcacatattatgctccctcgtagatctcatgtctctttacacttttcatttcctctttaatcatgtttcaaatcctccttgtgatttccaaggtgtgacattcagtgctgaagcaagacccacaaatgattagatcactgtgggactcagctgaacattcacagactctttctagaaaagtcggagtcaacattttaatgcttcaaatccacgtgggcagggattttgtttgcgttctgttggcttgcttgcttagttgttcgtttgtttgtttgttgtaaagaggagtagctcaaagccaatctgattctgataaatggccaaggtagagaattcctggcccaaacactgtttcttttttttttattattattttaatcctaagattgcaattttaatagttacagaattcttcacactcaggctaagtttatatataaacatgccaagtttacctttgacatgttcacatggactacttctaaacaaaatcttcaatatctgaataagaatatgtgatttttataatttagctaggatctaacaattttacactggtaatttttagctgtttatgttatttctaactgcccagatatttgtggttcctgattatgttttccagtattttcactattttctcagctctgcattttgtggaaatatttcctgtatattcgtttaaatctgataaataggttaacagacaagaacataaaaaagagtcctgcagaattcaaaagaaaattccctccagagtgacataacatttaggcatggttattcaatcaatttctaatctgtcctgtgagtaacaccagagaccttgcctagtgtcatactgactttaaaagcactttagactgcgtttgatgcactgctgtgccagtacaatgatttaccatcttacactgaggctgataattcctagcaccattttacaaaataaatttggcatagagttaaatatcatatgaaagtttttcatgtgatacataatcaaaagcttacttcaaagcatactttaaaatagattaggaaaattgttgcttttatgagattaaatgtcttaaacaatttgaatctcagtatttcaacaaacacattattaagcaacaacgcaggtatatatatatatttaaagacatacttctaatacacaatccacttcattgttagcatgataatagtttcctggaagcaataaaatccacaagattcttaccaaaaaggctgggaaccttggttgattgcggagtcagggagttattcacagcattgagctgggttccataattatccacctggaaaccattcgctggaaaaaaatacagccaattaaaatagataaacattgtcacaatctcatatttggactcatgaagcgtacaacagttaaaaaagcagacttctggcaatttcattcacattgctatgttaaattagcaaacagtgaatctttaaatataattgtaaggtaatatttccatgagtaactgtagttcttggtcaaaaaagcgtagcagttaatgtttaagtcatccctttaataaatgttataggcagataaaactgagtgactttaggtggtggttttcagtaactgtttgctctcatatttgtataaatgtgaaagatttcagcaattctattgtgccaaaattgtactgcagtattctcaggaagaagaattaaataatgcaacataaaaagtattagatctatgaaaataatttcttaattttctgtgctttttaaaaaactacagtcacaaatctcacattgaatgcacacaaatatatcttcatttgcatggctcaaacaaaacctgagtatagaatgccatctgagatgccttagttttaaaaggatgcctataaatgaactaaaatgaaataagaaataaacttacgaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttctagaaattataaaaatgtcagaaagcaatattcttttgtgtaaataaattactgattttaataaaatttataaatacctggctaagttattgaaggagtaagcataaaaattaaaaagtaaaaatctaactttatccataaatatacactattaaaattatctaccatattttgggattggcatttcaaattctaaatttctcatagtaaattaatagggaattaactgtcatttttttacaaatttaaggaataaaagattattttaccatgtaccactcttgctttgaaattacaaaacattatggcaaaaatgtggtttaattatttttaatatgttcatgtgtattaacatttagggaaggtctatgaacatttcaagctattgagggtggcttctcaggaaaagcattgtagtgcgttgctccattaagaatggtttaaatttttaaaagttgaaaaagaatatttgaggggtaggaagttttcatggctagccttagaagttcctgaattcttatgcgggaattaatatctgtactaggtaggacatcctttactgctgtgtcatttttattttttccttcttcttgtcattggaatgacttcaataatgcagaggcagaaaggaaatacatgttcaaggattggagaggcttttgcaaaagactaatacttcttctttgatagtgctccaaagcaggctaaacacagctgtcataaaagttgtgccactgtgatctacatcaccagctctgtctacatgcatgcactgtgaaaagaagtgagctaattttcaaaattattatgctcacaggcgtattgggcttgaatttttagaacaaaattccaatttctcaatttttttcctgcaagtatattaccatattggcaaaactgaactgtggtaaccttttttcatcttaaagcaacttgttcttctatgtcagggaagcaatacccacaagtattttacaataaaaaagaacatgtatttaataatgttaatgatttctgcaacagttgcagatctgcaaaagaacaaactccttattgaaaagttattttattaagtaaaacttcctactataatatagttttaaaagtctattttctgtaacttttcaatgtattaatttgaaagttaactttgtttcttctgtattgcctcttgatctttcaaatgaatgtttttatgatttttagttaattgtaataatatgtgggggaaaggaataaaacaattctttaaaatgttataacattttataaggtaaaaatacattgaattactatcatatgatttgttttagtcttaatgtgtactttttatgaaattttaaatgatctgaacagaggatacaagaactttatgtttgccaaaagtggatggaggaaaaatattgcatataaaaaacataaaggtataaaaaattatgctgataagtataattaagaaattatacatgtacataaatatatacacctaatatgtacccacaaaaattaaaaataaacaaacaaaaccacaacaaacaataaactgtacaactgaaagttgttatttttcatatgaaactacattgggaaacatgaacttatgtgaagacaaagttgaaaatggacacatgtaaaataattctttttttggcctgcagtttaaactacagttgcaaatcaaaaaattaatttcccattttcttcaggtaaataaattaaccttcttattgaatttgcatacataacccttgctctaagttggtgctcagttgcacttgagtaacacagaatgcagactggataagctaaagcattatcactgtcaacttttgtttgggcctgaatacttgggaattgtcttggaccaaactttctttctaagggattgtattaaatctcaaatctctttataatggtccaatgctaggaagcataatacaaagttcactcgaaattgatcaagtctttgttacaaataggtgttaacatgtaagcatttttaacattcatgtgaacacagctttattctctaactttcatatataatatgagataagaatgattgaattctgaattataaatatacactttatagcataattttacctaaaaatagtacctgtatttaatttttctctaattttatgtttttggtaaaaggtcctaatatttaaaggttggtattttctttcacaaaaatatttattctcctttgtagacaaaaacttctttattataaatatgccattttgatattacagataaggccttcatttaattaaagtactaaacattttggtcaagattattttaatatttataggaatctattttttaaaattgtaagtacatttagttatgtttcttgtacaaactttgctattatctttattttatacattttgattccaattctggtcagtgaattgagcctaaagattatcaatgtgtcacagaaattttcaactctttcccacataaataaatcaaaataaataaaattaaaatgcactttgaattttgtggtctttcatgttgcggtctttcatgtcctgagttaaacaatttaatctctttgttcaatattttctcattgaaatgtaaatgccataactgacaattggaccaaatcagtttccaggcctttattaaaaggacgttggtttccctgatccattgataacattttttcttgtgctgatatatttgtgaaaaagtaattatttttagctaaaaacaataaatgatatgatttaaattacacaattaaacatacacatacatgctagatatttatttttaaatatctctacttacttttgcatgtataactgctgacaactcagagacatacatccattcaagggaatatttggtgaaacttgctaaagccacacaatgttgattagattaacaagtgattagagatcagagaaataaagttaagactcaaaatatctaaatctctatctggaaggtgttaaaatagcatgtgtggctctggactatgattgaactaaaactaaatatcatactacattagaattagagtaaatacggtgtttggagcctcctctgacaaatataatgtatatattttcctaatttttgattatgtccattgaatcatgcaacaaatcatttcaaaaatgacatgatcaatctgtcatatgggtttatgatcaatctcttttatggatttttttaaatcaatctcagagaaacttaagaattgaatatctatactgaatcagggaccagaaaaaacaaacaagcaaacaaacaaaaaattgaatatctaaatgccttacataaatgcttcaaatttacagacaaataaatgttcaccttgttgcaatgttgtctttataatcctgtttgcattatctgtaatcaaaagaatatatgcatatcaattgtcacaatttataaagtaatactatgaatttgaatttaacaaacaagagtgacatatttattaccattaaaattattcttatacagaatgtcttaataaaaattgaatttctttttcttttctctaaaaattaatcttttctatttattgtaaccatgaagccacttcatttcaatagagtaatgttttagaaactatgataaaactttctaacacacttacaaagctgagaattcatagtgactatgtttactgttcaggatatctatacttaaaacaattattttaaaaatgtgaaatatgaaagtaattcaagcagcctacattacatataaaaataatttgttagataactgggaataaaagtgaaattaaccagaattatttcctttccttattctttcccctgcttcgttgtctcaatccaattgcaagtttcattattattaccaatgtagagaagaaatgaaacaaaaggcatctgggacacgttgtttggtttaacatttgattaacggaatcatttccctctaaaactggaatgttagttgtctttgtcctaccatattccaagtatgaattctaagttctaatttaaatgataggtaatgaaatttaaattgacaaaataaatctatgaagttttaatttgctcgcatagacattaggaaagttgagtggtatttattttgttgtggaattatttgttttgcagagaaaatctttggtcaaagcaggttagcattcgttatatgaccagagagatagaaagggagcgagagagagaagggaagaaagaatgagagaaataatatgaattgggttataagcctctttcagcaactgcatcatcctttttttcttgaaatagttaattcttctatggagagtaaaatgtctatgaaagtgaaactaacggacccaaacttcttttctaattgtactatgttttattcaatagccttttaaaaaaagaggtgtgtgtgtgtgtgtatatgtatagctgtatctattgaggtaagttttttggtttactttgttttcactgcaactaaccaacttcatattaatgttttcaactagattgtagactgtcatataacctgacattaaaatatttagatataaaactaatatgatttaattgataagaagaaagaaatgtatacatataatgagtacataagactagaacactaagcaattttcattcctgatttacctattgacaatagtcataagatgggaatatataaatgcttgattaatacaatttttaaaagaacatctattttgtttgtttactgttacattgtaaataggattaattcaggtaatatacatgccaattaactcaatgtggtttagcacactagaattttaagtgtatttatattaccaataattgtctttgaggactaataataataaccttggacacgataatttgtatggcaatagcagtatgaaagcgattaatagttagaaaagatttacagcaaattatcaagttttcttagatttagacaggacgaagcatttatcaatgctttttaaggagcaatgagagaatgttagactaatttccattctagtactcttttgaatttcaatttatatgaatttgttttaatatttcattatgaatattaagatgtaagactgacaagcaaaaatatcccaaaatttgcatttggttgacacacattggcatatgatatttatacctcaaactgacttatttatttttgcttctaaatccattcaaaagtgtgccagatgtaaataatgatattttcttctgggtgtgcaaggagagtgttagataaataccaattgtgtgaagttggtagagagtgttgttcaaatcttttatatccttagtgattgttgtttactttttctgtcagttactgaaaaaaggtgtcttgaagtatgtaaactgaactgaataattgtatactctcacttctgccaactttttctttaaaaattttggagttttgtaattaggaccatgcacataggaattaaggattgttgtgtcttttttattaatggacccccattataaatatctttctttccaccaggtagtattttttatcctgtagtctacttttactaatcattcttatgattagtgcttacatattatatctttttctatcctttcacttttaatctctctgtccttatttttaaagggcctttcctatagacaacatgtagttagttcttgatttatttttgcatacagagtgataatatctaccttttaactggcgtgactggaccattaaattttaatttaatctaattatcattaaagttgagtataaatatcactagcaatttgatttctgtttctcatttcttctttgtttctgtttccctctgttcatgtcttctttagaattactgtaattgaatattttaataataatttcatcttcattatgggcctatttgttatttctgcttgtttcatttttttaatggttgctttaaggattataatgtactaatccattacagtctagtgccaagtaatgtatgtcattgtcacctgtagaaacctcagaactttacaacaataatctcatatttttctccttccttcctgtgtgctttaattctaaatcctttaatactaattgtactgctgctctaccaggaataaatttccccagataatgctgatttgaaaagcccttattttaagaagtagattactgattggcactttttttctctttcagttctttgttttttctttttaaaaatttatttcttttttattttcatagatttaggggctagaagtacgattttgttatgtggttatattgcatagtggtgaagtggattttagtgtaaccataacccaaatagtgtccattgtacccattagatagtttctcattccccagttccctttcatcctcccatcttcctgagtgtccattgtctattattctactatgcccacatgtatgcactatttaccccccacttataaattagaacatgtggtatttgaatttctgtttctgagttatttcacttaagataatagcctccagttccatccatgctgctataaaagacatgattttatttttaatggctgagtagtactccatggagtatatgtgtatatataaatatcacattttatttacccaatcatctgttaatagacacttacgttgattttatatctttgctactgtaaatagtgctgtgctaaacatacaagtacagttatctttctgatataatgatgtatttgcttttgggtagacagccagtagtgggattgctggaacaaatggtagttctattttttaggtctttgggaaatctccatactgttttccatacaggttatactaatttacatttccagcaacaatttataagcattcttttttctcctaatcttcaacatctgttattttttgactttttaatagtagccattctgactggtataatatggtatctcattgtggttttaatttgcatttgtctgatgattagtgattttcagcattttttcatatgcttgttggttgtgtatatgtttcttttgaaaaataccttttcatgtcctttgtccattttttaaatggtttgttattttcttgttgaattgtttgagttacatgtacattttagatattagtcttttgtccaatacacagtttgcaaatatttttctcattccttaggttatctgttcactctgatacttctttggctgtgcagaacatttttaatttaagttacttgtggatcaacttcaatttaactctcatttggctatttttgtttctcttgcatttgcttttgaggatttagtcataaattctttgcctaggtcaatatgtaggagggtttttcccagattttcctctagaattattatagtttcaggttttacatttaagtcattaatctattttgagttcatttttgtataaggcaagagacattattccagttttattcttctgcatatgattatccaatttctcaacaccatttattgaatagagtgcccattcaccactgtgtgtttttgttgattttgtcaaagaacagttggctgtaaataagtgttacaaccaggagggaggctgtaccctgcaaagtcacaagggcagagctgcccaagaccatgggagcccacctcttgcatcagcgtgacctggatatgagacatggagtcaaaggagatcattttggagctttaggatttgactgccctgctggattttggacttccatggggcctgtagaccctttgttttggccagtttctcccatttggaacagctgtatttacccaatgcctgtacccccattgtatctaggaagtaactaacttgcttttgattttacaagctcctaggcagaagggacttgccttgtctcagatgagacattggactgtggacttctgagttaatgctgaaatgagttaagaatttgggggactattgggaaggcatgatcagttttgaaatgtgcaagtgcatggtgcaagctgtcaatggatctaccattctgtggcctggagtatggtggctttcttctcacagctccactaggcagtgccccagtagggaatctgtgtcgggggtctgactctacatttcccttctgcactgctctagcagaggttctccatgagagccccacccatgcagcaaacttttatctgcgcatccaggcatttccatacatcttctgaaatctagatgtaggttcccaaacctcaattcttgacttcggtatactctcaggctcaataccatgtggaagttgccaaggctcgaggcttgcaccctctgaagctctggccctagctctacgttgacccctttcaatcatggctggagtggctgggacacagggcacgaagtccctagactgcacacagcatgaggaccctgggccgggtccaggaaaccactttttcctcctaagcctccaggcctgtgatgggaagagctggcacaaatgtctcacatgccctagagatattttccccattttcctggtgattaacattcagatccttgttacttatgcaaatttctgcagctggcttgaatttttcctcagagaatgtaattttcttttcacttgcattgtcaagctgcaaattttccatacttttatgctctgtttctcttttgaaactgaatgcctttaacagcacctaaaccccccttgaatgctttggtgcttagaaatttattctgtcaattactctacatcatttcttcaagttcaacattccacgaatctctagggcaggggcaaaatgctgccagtctctttgctaaaacataatgagagtcagctttgctcaacttcccaaaaagttcctcatctctatctgagaccacctcaggctggaccttatcgttcatatcactatcagcatttttgtcaaagcctttcaacaagtctcttggaagttccaaactttccaacattttcctgtcttcttctgagccctccaaactgttgcaacctctgcctgttacccagttccaaagtcacttccacattttcaggtatctttccagcaacaccccattctactggtaccaatttactgtgagcaagtcacatcttacatggatagcggcaggcaaagagagagcttatgcagagaaactcctgtttgttaaaaccataagatcatgtgagacccattcactaccacgataatagcatgggaaagaccaccttcccccccgccccatcccccatgattcaatcatttcccaccagtccctcccacaacatatgggaattatgggagctacaagatgatatttgggtagggacacagagtgaaaccatataacacacattgttagaaaaaccacaaccacttctgctttctaatctctaatagccatctcctcttttcagagagaccaccatgctgtacttgggtttctttcatgtaatggtggttctgaatgccttcacacaggaagcaggggagactgcagggctcatcttatgtatttaccttctcccagaggtcacaatcctgcactgccttttgttcaatgcttgcaaacagtagttttttacattttgtccagttttatagttctttatgttggggagagaaagtcttgttctatttatccatcatggctgccgattaaattctctccttaggtgcgtttttaaaagtctagccatattttttccatataccagttatatccttatcagtagtctgctgtataaaacactcagacattcatacaataattgcaagtgacttttctttttttttcatggagtcttcctctgttgcacagctagagtgcagtggtgcaatcttggctcactgcaacgtctggctcctggttttaagcaattctcctgtctcagcctcctgagtagctgggactacaggcacatgccaccatacccagctaatttttgtatttttagtagggacggagtttcaccatattggtgaggctggtctaaaattcctgaccttaggtgatccacccacctcagcctcccaaagtgctgggattacaggtgtgagccactgcacccagcctcaagtgaattttgatagataatgaggagatgggggtaagagagttacatttacatgctagccagaaatgatattttaaatgatgataagcaaggctatcactgatgagcaaaatgattacatttccctaacctttaaagaaaagagtaagttttgcacaatgataaaccataagacttgaactatacacatatataaaaagaacaggtatatatttcaggaaagaggccagttgatgaaaataaatagcctgctaaatgaaagagtggggattacaaagaatgaggcaaccaggcttctagccaaggtactgacaactaagaatgattttcaactcaacacaaaaggatacttggcccaatatgtatggaagaaaatggggtatagaaatctgtgatgaatgggaaaagaccaagcaatcacaaaaaccaaaagcaccactgaggaccactgagctgcctaaactgtgttagtaacattcctagggcatctatggagaggaaacagagaaatcagtgctgtgaggttaaagaaatatattcgtgtctattctcttctttcagcttgggagcatacaactaaacatcttacagagccacagaggagagaagttcactcttttcaccacatggaagttttcccacaggccaagagcaccatgatgccaaggctgtttagtaaaagctatttagaaagcagtaacagagtgagaatgcagagctgcctgatttgcaaaaaacaagacatctagtgttactaaccagagatatcatttctgtatcacctcaattgtatccaaccagctctacgaacatgctatggtagaatattggtctagaaactagggaaataaaagcaactcaacttattctatcccttgagtaacttacaatttggaagaatagcctgacattaaaaaaaaaacattcaaaattttggtcagtaattatttgtaatttatcttagtgagaagatataaaatcccatacaataaagtaattagcaaaatttgcaaaaatgttaaattttagtaggattaatgcagagtaaaagtttaatataatatgacgtacttttgaaatttataacttagtaatattaatataaaacattgggtttagtaaagtccacaagggtcatcagggatgatttttcttttctatggtattctatttttatttcctgtagtattttaaggttccaataataaaaaaatcttaaatttcatatatagttctactattttatgcagcttacaattttgtaattaagagccatagagcttcaatttccagattcatgatcttgagagagtatagcgatgagaccattgtgttgacaaaggaaagactaagtcaatgtgactaacagtttttcttctgccaactgagattacaagtctgggaggccgaattacacccactttattttaaaaatacttcacaattctttgaacatgagttgaggtttttttcttctgtctttattatggataagagtataagacaataaatggggcctcatattttataattcactgatatgaagaaaatgaaaaatgatagttgaacatgcaagttgaccgtacctaaaatttgataatttgctttaaaatgtctctcgggcatatagagagtttctggtacctataaatgtgggtatttcatggtacaattcagaattatcattttccttaaatgtttttaggattccctgaaagtctaaaaatgtggaaataaaagattccttggaaatattaaaacagcatgaaattacttttctccctaaattatcaaatccataattagactcaatagccctaaagggtcttgagtaataagggttcccagaaacctacctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctataaagtaaaaataaaagatataacatgtaatctccatcaacactgtaataatgttctttatttcctttttaatatgtcctgattttaaggaaaagtacaataaaacatactaagaaactataaaaagttattcagttatcaaaatggtagataaagttaataaattcaccaaatgaaacacaacttctagactcttgttagggaggtattgcttaaatcgtaccaaccgaactgggagggaattgagtagtagttgtaaggcaacttcattcaagtggatgtgtccacaatagacctcttttaactcagctaatggacagttctttgaatttctctccctaacccacacttgtgtcactttttacacataaaacaaccctttaaaagcaacagcatattcacattcacatatatatatacacacacatatgtatataacactatattaaaccattttccctaattataaaaatttatgtgtttgatgttctgaaaaatatacttcatggtgctttttattttaacttaccataccatgcttgggttttaataatgttgaaataatgtaaataatgctttctatgttttaaatagaatgaggcaattcttttgacttcacgttatatattttttctttaaatatttaactcctaattttcataacagaattttctatcctgggaatggacatagaaataggggaaactcaactagattttttaaacattttatttttttcaagtccaataaaattaatagaagcctaatgttaagtaaagtctatttgtttaccagtaaagatagacactgaaaattgtgggtggtgcaaccaaaagaataatgacaaaaatgccatataatacttcttgaatattttctgcatattgagtctatgtattttctatgtctttggcaattgatttattaatctcttatggggaatattgaaacctataaatgaccgaaaccaattttgcctctagagggcagcagtattatattgaattaaacagatgagtataaatatcttgaaaaaaagtgttttcatgcattctaaaatagtttactttgaacaacaacaaaaaaagaatgagactttaatattttcacataaaatatttttaaagcataaaatacaggataagtttttggagtatgattgtctcaaaagaaatcagttttaaatttcctgtaatttcaaaatgtgaattttttgaaacagaaaatatgtgtgtaataaaagttaaattagataattttattaattgcactccacccataatatattattattctaataatcaattttgaattaatagcaagtattagtcttattttagtaatgttaaaactttttgtaacaaaatgattgaaatgatattgttaattttttatatgagtcataaaattgtaagtagcctttacaatcttggaaggattaaagatacagctttctatacataagttggcattttcatgctgtttgattcatgtgacactaattatttttgaacacgtaaattttatctcaactactaacactgctttcaatttttaaaaatactagttaaatttacataataccatctcattattttgatctatttgataagttaattgattatttttttcaattgaaataaattgagctgacagaactgatagaagagtatgtttttcaggtccagaatttgttaacttagaataacatatgacagagaattattatgatacggggatagtttcagcaccaaacacaattgtcataaaatagctaattagcaagtaagaatgttgatcaaatctttaactaaagttgagttttatgcacatatgcatttgtgtgtcttcaaatttttctggagttatattcaattgacaaaatataatgtttgtgtttaccaacatgatttttaaaataattttaaaccaataacagtgtcactaaatccaataaatatctatagtatatatacaaataattgtatcaaagtgagttaagaaatattggtgaacattgacaagtttaaatgtcatttcttttttttttcaaatcctttatctaacatttcatgttgatgaacatatctaaaatacgataatttgctttagaaggtctctcaggcatatagagagtttctggtacctataaatatgagcacttcatggtaaaattttccatttttcttaaattagatacacaagtactttttaatagaaattcataacaaatataattgaggattgctaaaaatactttctaaaaatcgaaaaatgtatgaaccaaaatgacttgttaaaacacattttctctatcactgaagttataattgtcagttttaaaaatcattgaatttttttttctgagtggcacatttatgaataattgtaaatgctgtttatatctttttgtctttacttaaggattttagaatgccaagctgacattttgagtttttatgagaaaccagaaaatttggtgtgaagaccctaagtggtgtgtctgacttacagcaggcccacagtaagtatcatcaaattacgtatcgtgagtttctgaactctagacatgtttgttttgaaaccaataaaaatgtgacctatcagctccttaaatatgggaccccagaattcacataacaaagcaggaataaaaatattctggcatttttaattttacagctatataccattatctcaaattgctgtagaaattctcatataatgtgatgttattcattcccaagttaacatgactttagaactttagagacaagttattgaggtagtgtttcagatagaaaacttgaataaagatctgtatctgcagaacacagggaactttacctaatacctgcattgccatgtatattcagaaaaatcatttttcataaatcaataattttatcagatactaattgatgatttttctactttttattcttaatatatttgatagtatttattatcaagctaaatcttttttccattttctgcattaaagatataatcacctctagttcaatctgctattgagtaattttgccagcaggtggtggcagtgcaccacaaaggcaaaagctgataaactcgctgtagtagttgtacctagcaacaatagctaatgttgctcactgagtaattacaatacccttgacatttttgtaattgtaccctttaatgatcataaccacctactgagttaggcattattatcttcattttataaattataaaatagctttcagaaattaagtaaataacttaaattcataccataaatgatgggtttaaaattgatcctcatatggttttacaacagctatctcacacattcttaataactacatgatattgtcacagacatgtgactgagattcctaaagtagcatttggatcaagcatacggttttaattatataatttccactcaatcaacaacattttttttcaaacattcacctttatgaaactaaaaatggtttcaataatggaagtaggtgataattttatagaaattttctaggagaaacactaagtattaacttttatgaattatattttgttaattattaggtgattatttgtctttattcacactttaatgtatttcttatagaaatcctgtattagaatattctttgtgcagtgatcttgcagcccacacctaagcacagcatccctggactcaagcaatggccaggtgtgctgtgtgacccacagtgccatgccacttcacccaaaagggatggaaatctgcctcggttttcatttcttattttgaataaacccttttgaatgttaataattgggtattgaccatgcgtcaagcactgtgctgtcactacagatatgacagtaaattagatgacagcaacccctcgttcatggagcatatagacactaaggacttacataaacattcagaaagtcctgggtgctgtgcgagtgaacagtaggatacctaaattagcctgaaggggtcagcgataactttcctgagacttgaaattgagacttgaaggaaatgtttacagaggtaataattatctgccagcggccatgagaaagcaaaacacatagagggcaatctaaaaggaatttaatctgatccagtcatataaatagaattatggtttatattgaatcatttgcctttgatgtcatgaattttatgtctcatagtctaaaggttacaatcctgccttccccttccctccccccgccccatgtcctgggatgttggatagaagcttactataatatttgctgcctgaaaacatatcatgcccttgactgtaagaatactcatcctcttggaacttatttgcaaatctagggctttcaggtaacttaccatctaagaatccacatgctgctagactctaattaaaggattttattttattttattttattttctggcagggaagaacaaacacatgtaccttttgccttctctgtgtcagaaaatgtgccagatgcttttccactttttatataaaaatcataggaaattagttatttacattattcatttacagcttaggacactggtagtcagaaagtttaacttattcagtctcacaaaggtactaggtggcaaactacacctgcaaactcaggtctgtctgattctaaatcctacaaaagatacttgcctttcactaaatgttcactcttaattttctctctcctagcccaatggaattgttttaaaaagcttatcactactctttttattatcatttttgccttatctagacgttaattctagattatcctccctgctgatttgactgttaaaaaaatcatctactatttgcttgtgagagaagcaataaaatttgatgtatttttctattaataagagtaccttatttcaattaaataatatacttctataaaatgatgttatgatcttagcatcatgtgataaattgtatctcctaaatagaattttttcagatgtgagataaggttattataaaaattaattttaaacaaaaacaaaataaaactagataaaactgcaactagttggtgaagaggtctttaagtctagcttaaatatcaaaattctttgttaccacctaggtttggaagctaccttatagtaattttaaattctggcttaattactgataacttaattctggattattgattgacagtggcagcagccacaatttcaggaacttcctggttaaccaatattcattttctcagtccagttgaggaaaattggactgggacaaatacagggaacacttggatctatttgcttctcacttcccacaagtgagattgcctgttttttccctgttaagacttattttatcctccaccttccttgtttctgtaacctccagaatgttagaattttaacccaccaccttttgagaaaaaagccgaatgagggattgaaactcataatgttcaaattcttattttcaaaaaggtacattagggtttttactaaataatgcttcatctctaggaaatttttataacatgacttccccttgtggagccctcagagagccaagcttgattgaatctccttcctcttcccatcaacagcagcactctccatgcttctgtcactttgtgtactactttatacggaaataaactgtccacccttcacactcccctaggaaacagtgagattcttgagcacctcatctcagccatacctgtttctctagcaccttccacagattcaggcccagaagatgtatttattcaaactttattaaagtacactgaacacagtcattttaaaaagctattaaagctatcaaataagaatgcatttatggaaatcttttttacatcttaaaccactatacaaaaataagctatcattttgttaatattctctcattaataccaatgcttgagatttctgtcaacaatttactaatttgccacaaaatgttactttaagaaaggtatatatccacaataaccatcaccatacagtcttctccttgctctattttttattgttaatattctcatttttagacacagagttttatgggattagatctaacttatattactagatcctttggtgtcctggttgactagatttttatattagtctcaactgggaagttttgattttggaaatatggggaagaaagagagaatagctgaaacctcagatgtctgaagttccctttcctcctcacacttttcctagccaaagggtagcatcaaatgtcatagggagttgtttttacaacattttgctccttgcaatagcccggagctactccagtgtttaatattgtatgctgaaaaaaaagagagaagtgtttcagctaaagttacttggtttcggactgtttaaaacacacatgtgcatgtacacacacacacacacacacacacacacacacacacacatacattaggtataataaatttccaaagaaaaatatcacttcaataacaactaatttccctccacaatggaaaactatggtagattttttagattaaaattgagagctttaactagcttaaaaagataattgcttctaatattttacctgtgataattgtgtgttcttcatcttcctcagaatcagcattaagaggggcaggggcaagattaagcagcaggcatacagaagcccaaagtgcatgtactttcttcattgtgtaaatcatctctgaaatacagaacccatacatatctaataaataaagtgttaatatgcactcatttacagactagtaaacatcatatgtgtacctcatatgcaaatttctatgccattttatgtgtatacacatacatttctctgtgcatactcaatgagtcatacttaaaatgtatatgtagtattcagaattatgggcaaacacattcagtgcatatatttattaatattcaagcaaacaggtcatatttcaactttgaaaatataaataaaaaggacagtaattgagagacatgggtaaacgctgatcaatatggcgaagtatgtattaaagtccatttccatgtgcaattttactttccacatctttcgcacagctattctttctcagtcagaaccaataattatttaggcatttttctattatttctttaatgcaacttttaattcctgatttatctttccctctgctctagttcttcttttaaaaaggaaacacattttcagaattttcatctttgtttcctttaaaaaatacattatttacatcaatttcctaaccaggttttctgtgagatagcagacagccaaaacagaggacaaaagaagtgtctgacattcgagttagtcctctttcccagttcattattccgcagtttagggagttatctgattcaaaaagtttcacagaaaagtgactctaagtgataagccatcactcttacactctaaaggaatcagatttcaataggagagtgagacttttcctgtttcaacgttgtttaaagatctatcgccaaaaaggaaaaaaaaaaaaaagaaaagaaagaagtaagtcacctttatttttttaaagacgacttcttctttggatttaaaggtggaaggaaaagtgtaatgatcatgcaacacagaaaaataaaagaagagaacacttgcttccttcctgttctcagccaccagtgcccttccagtcaggaaggaaagcgagatcttatcagcaaacattcacaaatgcagggacagatactccatcaaaaacaatctagagaattatctggttttgtctgtagcagatcacagctgcaatatacaccattgtgggtagccatataataattaagtaataaatgttattatgctttaagtttcattaaaatcactagtgagatacataacctttttttctcacaacactttgcaagtgttaacatacatttgatttttagtcagtagagatctcatatatcttgtaaatcataccataaaccatttgaattcacaaatatatatatatatttatatagatacatgattttgaagaatcttgaaactaaacttctaatccttatcgcatttttgaacacgtttttcagagattcatttatttccatttgattctttgaaatatactatcctgctatactttgagtataaaatacagagtgtactctgcatcacacagttcaggaagcaggctgaggttgggggcctgctgaagcccttgagagagagggctctaaattcagcaagttcctgtcttaaaaaatggcagcctagggtattgcctaaacttagtactttagactttcgttgggtgctaggattagaaaccagctctgacaaatttggatcatcagtttatttattctagaatatgtggaacaatctgagatgacaagggcaggcttgcattagttctcagaaacagctagagctggtgagctgagcaccaccaggtatttctcattgtggctacactccttagacagctttattttctctcagtgtgacccaatcttctctgcatagcatgatgcatgaacaatgaactgtcctgggttttaaaccttaagagtttttcaatcaaaatagtgtgactacttctctttatggtccaggcttaaatagcttgagactagctctgatagttttagcatgaaacaagggacaccttttggaccaatccatttgagttgggaattgtaggagaccatcatagatttggtggacccaaaaccagtctggggtcaggaataagaaaatgtaatagcatggcaaatattaatggaaccatatggtttgggtggtggaaacggacaagtgtaactcccagaaggaggaaattgttgctttcagaagggaagggtgttagacagataaatgactatatgactatatgactatataccacagcaagccatagctaaatagtagcgtatgtaattttttttttaaaaaaaagaaaagcaaaaggcaaataaagtacatgaattgcaggaggaatcaaatatctaaatttttactcaaaaatgctgtctggttctgggtgataacagatttaatgtagggatgaatccatgcaccaacttctatataccatgcaaaatctttttccttttggaaaaatccagctttcttaaaattagaaaacagagatttataaaacaccatttgcagatctcctccccccatagttcagcagagaatttgctgtaaacatctgcttgataagcccataatcctggctttctaatagaaacatcttcttttaaaaaaattgaccccattatttaaaatagttttagatttaaaaaaaaatagagaagaatgtacagagacttctcatacacctcacacccagtttccctattaacatgttacgttagtatggtgcacttatcgttaatataccaaaattgatacattgttactaactaaagtccatatgttaatcaaatatccttatcttttccccagcacgtttctgttctagcaacccatccagaataccaaattgctctagttgtcatctctccttaagttcccttggctgtgacagtttctcagatttttcttatttttgatgatcttgacagttttgaataatactggtcaggtattttgcagggtatccccttaatagaatttatctgatgtttttactcataattagaccagggttatggggtttgggaaagaagataacagagttaaagtgccatttttgtcacattatgacaaggatacatactaccaacataatttatgactgctgatattgatcttaaacacctgactggggtaatgattgttagatttctccactatgaagttactttctacccctacctttccatactgtttatttatttatttttttatactttaagttctgggatatatgtgcagaacatgcaggtttgttacataggtatgcacatggcatgttggtttgctgcacccatcaacccatcatctacattaggtatttctcctaatgctatccctcccctagcctcccaccccctgacagaccccggtatgtgatgttcccttccctgtgtccatgtgttatcattgctcaacttccacttatgagtgagaacatgtggtgtttggttttctgttcctgtgttagtttgctgagaatgatggtttccagcttcatccatgtctctgcaaaggacatgaacacatccttttttatgtctgcatagtattccatggtgtatatgtgccacattttctttatacagtctatcattgataggcatttgggtgggttccaagtcttttccattgtgaatagtgccgtgacaaacgtgtgaaagcgtctttatgtagaatgatttatactgggtcaaacggtatttctggttctagatccttgaggaattgccacaccaccttccacaatggttgaactaatttacactcccaacaacagtataaaagagtttttatttctccagcatctgttatttcctgactttttaatgatcaccattctaactgaccagtgatgatgggctttttttcatatgtttgttggctgagtaaatgtcttcttttgagaagtgcctgttaatatccttcgtccactttttgatgggattgtttttttcttgtacatttgtttaagttctttgtagatcctagatattagccttctgtcagatggatatattgcaaaaattttctcccattctgtaggttgcctgttcactctgatgattgtttcttttgctttgcagaaactctttagtttaattagatcccatttgtcaattttggcttttgttgccattgcttttggtgttttagtcatgaagtctttgcccatacctatgtcctgaatggtattgcctgggttttcttctagggtttttatggttttaggtcttatgtttaagtctttaatccatcttgagttaatttttgcattaggtgtaaagaagaggtccagtttctgttttctgcacatggctagtcagttttcccaacatgatttattaaataggaaatcctttccccattgcttatatttgtcaggtttgtcaaagatcagatgattttagatgtgtgctgttatttctgaggcctctgttctgttccattggtctatatatctgttttgctacctgtaccatgctgttttggttactgtagcctcatagtatagttggaagtcaggtagcgtgatgcctccagctttgctctttttgcttaggattgccttggctatatgggctgttttttggttccatgtgaagtttaaagtagtttgttttttctaattttgtgaagaaagtcaatggtagcttaattgggatagcattgaatctataaattgggcagtatggccatttttcaatattgattcttcctatccatgagcatgaaatgtttttccatttgtttgtgtcctcttttatttccttgagcagttgtttctagatctccttgaagaggtccctcacatcccttgtgagttttattcctaggtattttattctctttgtcgcaattgtgaatgggagttcactcatgattttgctctctgtttgtctgttattggtgtataggaatgcttgtgatttttgtatcctgagactttgctgaagttgcttatcagcttaaggagatttggggctgagaagactggttttttaaatataaaatcatgtcatctgcaaacagagacaatttgacttcctctcttcctatttgaataaactttatttctttctcttgcctgagtgccccggccagaacttccaatactatgttgagtaagagcggtgagagagggcatctttgtcttgtactggctttcaaagggaatgcttccaggttttgcccattccatatgatattggctgtgagtttgtcataaatagttattattattttgagatacgttccatcaatacctagtttattgagaatttttagcatgaagaggtgttgaattttatcgagggacttttctgcatctatcgagatactcatgaggtttttgtcattggttctctttatgtgatagattaagtttattgatttgtgtatgttgaaccagggttgcatcccagggatgaagccgacttgatcgtggtggataagctttttgaggtactgctggatttggtttgccagtattttcttgaggattttcacattaatgttcatcagggatattggcctgaaatgttcttttttgttgttgtgtgtcttccaggttttggtatcaggatgatgctggcctcataaaatgagttagggaggtgtccctctttttctgttgtttggaatagtttcagaaggaatggtaccatctcctcttcatatctctggtagaattcggctgtgaatctgtctgatcctgggctttttttggttgctaggctattagttactgcctcaatttcagaacttgttattggtctattcagggattcaacttcttcctggtttagacttgggagggtgtatatgtccaggaacttatccatttcttctaaattttctagtttatttgtgtagaggtgtttatagtattctctgatggtagtctatttctgtgggatcagtggtgatatcccctttatcattttttattgtgtctatttgcttcttctcttttttcttcttcattagtctggctagcaatctatctatttgctgatcttttcaaataaccagctcctgtactcattgatttttgaaaggtttttcctgtctctatctccttcagttctgctttgatcttagttgtcagatataaaaagagttcctctttaaaagtttggcttgtttagcgtccttgctctttgttccctactcccaaagccaaactacattccttatcctttatgcctccccgttttagtttcagtaaacaactttcctatcattccttatctacagagcccacatctgctaatcattctgtaaatcacccctcccattgtccaccagtgtaatcacacccctgcccctttcaagttagccaatcaagttcagtgtcgatttgtacagtccaactccagctaacagagactagacacatgtcagagatgataaattcatcttcaaaaagttttagttctgtgttcttcctgttctttgtttctccagtttctatagttaactgtgctataaacaacccttcccaccagtcctaatctataacttacatctgttctgttcccttagttacgcactctacaactattcttcctgctgaaactacttgtcctaccactgtaacccacatccttgctctattcagattagccaatcaaaattagcttcaattatacagtccaactcagtcagtaaaaaaaagacacaacagtaaaagccccttgtgttaaaaataaaaaaccctgcccacccctcttggtgtgctttcaaaatgacaaatgcaaataacacccttctactaagagaggagaccacccctcatattgtcttatgcccaacttctgcctccaaagaaagaagaagtaaaaactaaaaggcagaaatgaaatccacaggcaggcagcccggcgctgtgccctgggcctggtagttaaagatcgacccctgacctaaccagttatgtcatctatagattccagacattgtatggaaaagcactgtgacaatctctgtcctgttctgttccattctgattactggtgcatgcagcccccagtcacgtaccccctgcttgctcaatcaatcacgaccctctcacacagacctccttagagttgtaggcccttaaaagggacaggaattgctcacttggggagctcggcttttgagatgcaagtctgctgaaatttccagctgaataaagctcctcacttctttaacccggtgtctgaggagttttgtctgtggcttgttctgctacatttcttggtaccctgaccaggaagcgaggtgattaacagaggccaaggcagccccttaggcagcttaggcctgccttgtggagcatccctgtggggactccagccagcttgagcgatgcagatcctgagagcgctcctgggtaggcatttgccccagtggaacgcctcctcagagcagtgcacggcaggcccccgcagagggtcaacgcagtggctgaacaccgggaaagaactggcacttgcagtctggacatctgaaacttggtaagactggtctttggaacttgaccactccatttgagtggaagcgtggcctgatcacccacggcgtgtctgtaccagcactttggtttttgtttttgacttgacttggatggcttgatactttggttttggttttgacctggcttggatttcttgatactctgatttggttttgactctggtttggtgtaaactgtgaaagtgtctgtgtgccctttttacttgttctttgttttgcggtgtgcatgtggtgttttgtctcgaggaagcatgggtcaggcacaaagtaagcccaccccaccaggaactatgttgaaaaatttcaagaaaggatttaagggagattatggtgttactctgacaccaggaaaagttagaactttatgtgaaatagactggccagcattagaggtggatttcccatcagaagtaagccttgacgggtccgttgtttcaaaggtatggcacaaggtaacctgtaagccagggcacgcaaaccagttcctgtacatagacacttggttacagctggttttagatccgcctcacagtggttgagagaacagcagcataagcagctgacagaggcaaggaaagaccagcagagagagagagatagaggaaagagacagagagggaaagaggcaaagagagagagaaagtgacaggaagagacagaaagacaaagagggagtcaaggaaagagagagagagagagatatacaagtagttaagaaaaaaaacagtgtaccctattcctttaaaagccaaggtaaatttaaaacctataattgataattaaaggtattatccataaccctataacactccaataacactttcttgttgtcagtgtaaacaagggaataccccaaaagcattgaggccgctgataacccctagacttcctatcaaaaatccttgacccagtaacctgcggatggcccaaatgcattcactctgtagcggcaactgctttgctaacagaagaaagtagaaaaataacttttaggggaaacctcattgtgagcacaccttaccagttcagaagtatcctaagttaaaaaaaaaaaaaaaaaagacaaaaaggtagcttactaacttaaaaatcttaaagtataagggtattctgttagaaaaaaaagaaaaaagatgatttaacattaactactgaaaattcccttaacccagcaggtttcctaacaggggatttaaatcttaattactatacaaaggttcaaccagacctaagaggaactcccttcaggacaggatgatagatggttcctcctgggtaattgaaggaaaaaaaaaaaagccatctataccaattctaagttaatttgaactaaacaagttcttattaatagcaaaggataattgaaatcccaaacttacaaggttttcagcaaaagtaaagtgtgctaaaagttaacagtgtaacatatattatagtaacttctaatcttgtggccttagacagtctagtccacagacataaaggaagtccactttggaaaagaatggttatcatcttcaaaaaaaagggaaaaaaagttggggggggccgcgaaatttatgtaaaaagaatgttatatggtaaattcttatcctgaaataaattaactggttgtttaaagaaagaaatgtttgtaataagtcagaaagttaacgcatgtcaaagaattgtctgtgaaagtcatgaaagagaaaaaaaagttataaaaaagaatttatgcaagaaatgttgtataatttaaaagtaattgggcctcctgaatgtaaaactattgaagaaacagtttatgtgcaaggtgtataaggaaagtaaaatatacctttggtaaagggattataaggaggcataagaatgtggatttttacctacattaaaaggttaaaaaaaagttttcttttgaaggcttaagcaagttttaaaacattaatcataaagaaaattctgtgtgtaaacatattagctaaagttaaagaggtatcatccagtttttctgtgaactaaacattaaaataaaaacacaacgggttttttcttaaatcactaacctgctctttaacaaaaactataaaaggttaaaaagagtctataaaaatcttaccttatggtccaacattaaaaattgaataaatatgtctacgaagttttatgaaaactaagtttaacattaataacacactaatataaaggtgaaatttacttatctggtataaaaatcacacaagaagcattgtctaatttcttaaaaattatatacactttcctttccctcaaaactaaaagtcttttagcacacgtaccacccctagaatttctggtaaaccagctccagcctaaagatcacataagaaggaaaacttgagccatcctgtgaaggagcttaccttgtgctgctaaccgctgagactgctgttcctacaatggaaaggggatggattcatcacacccaagtcaagaaagcaccaccccctccagagtcataggccatagtcccaggggaaaaccctaccaaactaagctaagaaaaatttaactctttcatctattctattactctttcttctttcctcactctattgctgaccatctagttattaacataaccaagtcaattttgcctcaaactattgcatttaatgcttgccttgttataccctgtggggacttaccaagtcaaagacagccctctacttcagaaaagtacctctgaccttcctgactctcctcagactgggcattagtaaattgggaccatttaatccagggagatttccataaagaccccagtgccaactaggagtcttgccccccgatgtagagcttttatgccatagttggtccaacattccgtggaccactacagagcaaggatggacttccccaaccggtttttgtaatttcctaaaaccatatgttcattttactagaggatcatagaagttaaagacttaatacaaactttggcaattaagcaggttaccaagatgcaaatgcctggttggaatggatcaaatattccctccacatgttaaacaaaagcaattgttatgcttgtgcacatggcaggccagaggcccagattgtcccctttccactaaggtggtcctccagtcaaccaggcatgggctgcatggtagctcttttccaggattctacagcctggagtattaagtcatgccaagctctttctgctatatccggaagtcgagcaccctgtgggtcagccctcgagggccatcccgcttccgtcttccaacactaggttcacttcgtgtctctcatgacagggagaaaacttagcattccttggagacctgaagggatgcagtgagcttaagaattttcaagagcttatcaatcagtcagccctggttcatccccaagcagatgtgtggtggtattgtggtggacctttactgggcactctgccaaataactggagtggcatttgtgctttagtccagttggctatccctttcaccctggcatttcatcaaccagagggaggaaaaataagacattgtaaagtgagagaagccccttatgggcctttcaactctcacatctatttagatgcaattggaatccaaaagggaataccagatcaatttaaagcccaaaatcaaatagctgcaggatttgagtcaatattttggtgggtgacagttaataaaaatgtagattggataaactacatctattacaaccaacagcaacgagcttttcatgagttaaaagaaaaactcatgtcggccctagccctggggctacctgaccagacaaaaccttttacactatatgtgtcagacagagaaaaaaaaatggcggttagagttttgacccagaccatggggccctggctggggccagtggcctacctctctaaacaactagatggcgtttctaagagttggcccccatgtttgagggctttggcagcaacagccctgctagcataagaagtggataagctaactcttgggcaaaacctaaagataaaggccccccatactgtggtgactttaataaataccaaaggacatcattggctaaagaatactagactaactagataccaaagcttgctctgtgaaaatccctgcataaccattgaagtttgcaacaccctaaaccccaccaccttgctccccgtatcagagagcccagttaaacataactgtgtagaggtgttggactcagtttattctagcaggcccaacctctgagaccatccttgaacatcagtagactggtagctgcacgtggacgggagcagcttcaccaacccctgcaaagtgactctgaagaagatgacaagcgctgctccagtcacacccagaagctgactggtccacgcacagccgaagcatgaggaaactcatcatgggactcattttccttaaaatttggacttgtacagtaaggacttcaactgacctttcccagactgaggactgttcccagtatatacgtcaagtcactgcggtaggacaaaaggttgctacagttctattattttatggttattataagtgtaccaggactctaaaaggagcttgtttgtttaatgctattctatacaaggtatatagccctggaagtgaccagcctgatgtgtgctataacccatcctttttcctagtgcccataaaaacaggcacacttctaggcttcccagtctgtgcttcccgagaaaagagaagcatagctataggcagctggaaagatgatgagtggccccctgaaaaaaatcatgcagtactatgggcctgccacttaggcacaagacggctagtggggataccaaacccccatttatatgctcaaccgaatcatacagttaaaagctgtcttaaaaataataactaataaaactggtagagctttaactgttttagcccagcaaaaacccagatgagaaatgctatctatcaaaatagactagccctagactacttgctagcagctgaagaagtagtctgtggaaaatttaacctaaacaattgctgtttgcacataaatgatcaagggcaagtagttgaagacatagttaaagatatgacaaaactggcacatgtgcccttgcaagtgtggcatggatttaatcctggggccatggttggaaatggtttccagcactaaaaggatttaaaactcttataataaaaattataatagtaataggaacctgcttactactcccttgtttgctacctgtactccttcaagtaataaaaaacttcatcactaccttagttcaccaaaatgcttcagcacaagtatactatatgaatcactattgatctgtcttgcaagaagacatgggtagtgaggatgaaagtgagaactcccactaatgagagaggttctcaaagagagggggataagggaggagaccacctctcatattgtcttatgcccatttctgcctccaaagaaggaaaaagtaaaaactaaaaggcagaaatgaaattcaccgacagacagcccagtgccacgccctgggcctggtagttaaagatccacccctgacctaaccggttacgttatctatagattccagacgttgtatggaaaagcattgtgaaaatccctttcctgttctgttccgttgtgattatcagtgcacacagcccccagtcacgtaccccttgcttgctcaatccatcacgaccctctcacgcggacccccttagagttgtaagcccctaaaagggactggaattgctcactcggggagctcggcttttgagatgcaagtctgctgaagttccaggctgaataaagctccttccttctttaacctggtgtctgaggaggagttttgtctgtggctcgtcctgctacactacaaaagtaaaattgccttactaagtaatcttttattgagcacacgttttcttcgcagcaccaagcacttgtttctaaccttagttatttcttggcttctgctagcttttgaatttgtttgctcttgcttctctagttctttaaattgtggtattagggtgtcaattttagatctttcctgctttctcttgtgggcatttagtgctataaatttccctctaaacactgctttagctgtgtcccagagattcttgtatgttgtgtctttgctctcattggtttgaaataacttatttatttctgccttaatttttatatttacccagtagtcatttaggagaaggttgtttagtttccatgtagttgtgcagttttgagtttcttaatcctgagttctaatttgattgcactgtggtcagacaaactgtttgttatgatttccattattttgcatttgctgaggagtgttttacatccaattatgtggctaattttaaaataagtgtgatgtggtgctgagaagaatgtatattctgttgatttggggttgagagttctgtagatgcctgttagatccactcggtccagagctgagttcaagtgctaaatatccttgttaattttctgtctcattgatctgtctaatattgacagtggggtgtttaagtctcctactattattgtgtcagagtctaaatctctttgtaggtctctaagaacttgatttatgaatctgggtgctcctgtattgggtgcatatatattaggacagttaactattcttgtttcattgatccctttaccattatataacgcctttctttggctcttttgatctttgttggtttaaagcctgttttatcagagactgggaatgcaacccctgctttgttttggtttccatttgcttggtcaatattcctccatccttttattttgagcctatgtgtgtctttgcacttgacatgggtctcctgaatagagcataccaatgggtcttgactctgtatccaatttgccagtctctgtcttttaattggggcatttagcccatttacatttaaggttaatattgctatgtgtgaatttgatcctgtcattataatgctagctggttatcttgacttttagttgatgcagtttcttcagagtgttgttggtttttacaatttggtatgtttttgcagtggctgatacagattgttcttttccatgtttagtgctcctagaggagctcttttaaggcaggcctggtggtgacaaaatttctcagcatttgcttgtctgtaaaatattttatttctctttcccttatgaagcttaatttggctggatacgaaattctaggttgaaaattcttttctttaagaatgtagaatattggccccactctcttctggcttgtagagtttctgcagagagatctgctgttagtctgataggctttgctttgtgggtaacccaacctttccctctggctgcccttaacattttttcctttatttcaactttggtgaatctgacgattatgtgtctttgggttgctcttcttgaggagcatcgctgtggtgttctctgtatttcctgaatttgagtgttggcctgtcttgctaggttggggaagttctcctggataatatcccgaagagtgttttccagctcctttccattctcccagtcactttcaggtacaccaatcaaacgtagatttggtcttttcatatagtctcatgtttcttagaggctttgttcattctcctttttcattcttttttctctaatcttgtcttgacacttcatttcattaagtcaatcttctacctctgatatccttttttctgctagattgattcagctattgatacttgtgtatgcttcacgaagttctcatgctgtgttttttagctccatcaggtcatttatgttcttctctaaactggttattctagttagcaatttctataatcttttttttaagatttttagcttccttgcattgggttagaacatgctcccttagcttggaggagtttattatccaccttctgaagcctacttctgtcaattcatcaaactcattctccgtccagttctgttcccttgctggcaaggagtgtgatctgttggaggagaagtgttctggttttgggaattttcagcctttttgcgctggtttttcctcatctgcatggatttacctacctttggtctttgatgttggtgaccttcagatggggtttctgtctggatgtccttttcgttgatgttgatgctattcctttctgttcgttagttttccttctgaaagtcaggctcctctgctgcagtgcaggtctgctggagtttgcctgaggtccactccagaccctgtttgcctgggtatcaccagcagaggctgcagaacagcaaagtttgctgcctgttacttcctctggaagctttgtcccagagggcacctggcagatgccagctggaattgtcctgtatgaggtgtccatccgcccctgctgggagttgtctcccagtcaggagacacaggtgtcagggatccacttgaggaggcagtctgtctcttaccagagctcgagtggtgtgctgagagatcctctgctctcttcagagctggcaggcaggtacatttaagtctgctgaagctgagcccacagcctcccctttccccaggtgttctgtcccagggagatgggagtttgatctataagcccctgactggggctgctgcctttttttccagagatgccctgcctagagaggaggaatctagggaggcagtctgtttacagaggctttgctgagctgttgtgggcttcgcccagttggaacttccctggggctttgtttacactgtgaggggaaaaccagctactcaagcctcagtaatggtggacgcccctccccctaccaagctagtgcgtcccagggcgacttcagactgctatgctagcagcaagaatttcaagccaatgaatgttagcttactgggctctgtaggtggtgggatccgttgagctagaccacttggctccctggcttcagccccctttccaggggagtgaacagatctgtccactggcattccaggcaccactggggtatgaaaaaaactcctgcagctaacttggtgtctgcacaaatggcttcctgttttgtgcttgaaacccagggccctggtggggtaggcacctgaggaaatctccgggtctgtgggttgtgaagaccatgggaaaagcatcgtatctaggctagagtgcaccattcctcagggcacagttcctcttggcttcccctggctaggggagggagttccccaatccctggcacttccctggtgaaacaatgccccaccctgccttggcttgccctctatgggctgcaccccctgtctaaccagtcccgatgagatgagccagatacctcagctggaaatgcagaaatcacccaccttctgcgttgatctctgcgggagctgtagactggagctcttcctattcggccatcttgccagccacccgtactgtactttggaagaaagtcactacatatagccagcactttaaaagaatggagaattatggtccctatccttaaggtgagagtatctatataaattgttcggaatacttttgcaccagatatttgtctctctgtattaaattatttaatcctttatttatataagtatggactcatggatatatattctatactttatgttataattcactatgactttacttacattgttgctcaaatggtctcctggctttggcaaatttgagagagcattcagttggctcctgtacttctttgagatagctccatcaatatgagtttttaattttttctgagtgccttactttttgtcactactagatgccccagtctcatattgtatattttatgccccactcttataatcacagacatttctccaagaagccctgattccttctactagagattggtattagaaacccagatctgggcactaggcatgctcattgttattgggatgtcatttcttttaggccttctttttggcagattaaaggaatatatgtgtatattctatcctatctgtaaaggtatactatctttaaatacatcaatatgttctgtgactggcttattttacttagtataccatccatgttgtcacaaatagcagaatctcctattttaaggcagaataatatttcactgtatatatgtatataccacatttcttcattcatttttaaaaagatacttgaattgtttccatatcttggttattgtgagtaatacctcagtgaacatgggaatacagatatcttttcaagactctgattttaattctttttttatatgtacccagaggtagaactgctgggttgtatggcagttttatttttaatttttgagaaaccttcatattaatacccatagctactctaccattttacatccccgccaacaatttgccagcatttcaatttcttttttttgagacagagtctcactctgtcacccatggtagagggcaaaggtgcagtctcggctcactgcaacctccacctcccgggttcaagtgattctcctgcctcagcatcccgagtagctgggattacaggcgcctgccaccatgcctggctaatttttgtatttttagtagagacagggtttcaccatgttggccaggctggtctccaactgcggacctcatgatccacctgcctctgccttccagagtgctgggattacaagcgtgagccactgcaccaggcccagcattccaatttccacacatccttgccaacatgttacatttcgagtttttagaaaaatagccattttaacaggcataaactgatatctcattattatttgattttcatttccttggtaaataatgctgctgagcatctttatatatcttatttgtacgtcttcttcggagaaaaatgtgtttaactcctttgcccattttttaaaaatttctgctattgagttgaaggagttccttatgtatcttggaaattatcagatatatgacttgaaaatatgttctctcatttcagtttgtctttttattctgttgattgtttcttttgccacgcagagctttttaatttgatgtaatcttgtctatttttgcttttgttgcttgtacttttggtctcatattcaaaaaatcattgccaagaccaatgtcaagattttcccctatgcttttgtctagaagttttacattttcaggtagtaactataatagttaaactgatagaagaagagaatacaatagtggttgctagggcctggagagtggggaaaatagagtgcttgttgttcaatgggtacaaagttttagttatgctagaatagtaaattctagagatctgctgtacaacatattgtttattgttaacaacatggtattttgtgtttcaaaatttcttaagagggcagatctattttgtcttcctatcacaaaacaaacagaaaacgaaaacaaaataaaaaggcggggtgtggtggctcatacctgtaatcccagcactttgggaggcggaggtgggtggatcacgaggtcaggagatcaagaccatcctggctaacatggtgaaaccccgtctctactaaaaatacaaaaaaaaaaaaaaaaacccaggcacggtggtgggcgcctgtagtcccaactactcgggaggctgaggcaggagaatggcgtgaacccgggaggtagagattgcagtgagccgagatcgtgccgctgcactccagcctgggtgacagagcgagactgtgtctcaaaataaataaataaataaataaataaataaataaataaataataaaaaacagagacacaacaaaactttggaaggtgttgaatatgtctattattttgattgtgttgatgggtatttatttgcatatgtacaaactcatcaaattttacataacaaaaaatgtgcatgtttcactgagatacaatcactatacaaggaactgcacatattactgtctaaaatttgatgagtttgtgcagtttttaaatagtgattatatctcaatgaagttgtttaaaaacttcagtgaaataaataaatacataaataaataaggaaccaactttgtttaagtgaaacatgagttcttatgcatgtgttcaacacatgaattattttagcccttgaaactcaactatcactatccaccaactctttaattaattgttcaattaaaatatacatgtatagcaataggaatattgttaacccatatgtccatggaatacagctttattaactagagggcagtgtctgtgtgcagttccttttacctttagacttataggctccacttattttcaatgttatttagttcagccctcctccacccccaaactccttcagtgaggttgccttaaacattcatagcagagtgagattttcttgtcacagtctgcattccttccaaattcctgaccttttaatttattttttttaaattgtataaattaaggttcactctttgtgctgtagctgtctatgggtttcaacaattgcatagtgacacatatccacagaatagttgtagtatcatacagaatattttcctctaaaaattctctgtgcttcatccattcatcctcctccttccctcctctattccctttgaagttactgatctttttactgtatctatagtttttaagtaattcaatcattcacaattttgtacaaatattattacagtcaattttagaatattttcattcccccataaggaaattctccaccctttaggcttcaccctcttcccttaaagttctccatctctacattagtaggaaacaattatttggcttctgtctctatgtattgccaatactgaaagctttagttaaatggaataatataatatctggcctactatgtctggcttctttcacttagcatactgttttcaggctccattcatgctgtagcatatatgattgctttctttttattgctgaaaatattttatagtataaatataccaaaatttatttattcattcatcagttaatgaaaatttttgctgtttctactttttgcttattatgaataatgctgctatgaacatttgtatacaagttttggtgtgaacataggtttgcatttctcttgggtatataactcggggtaaaattcttgaatcacatggcaattctatgtttaaccatttgaggaatttccagactgctttccaaagtagctgcaccattttcctttcataccagtaatgtcttcctttcttttttgaatgacactcatcaccatttatatatttatgtgcatttatatatttatgtgtgctgtctccaccactaaaatgttttctattcttagcacaggcactttacataggattcacaactctgtgttcaataccccaaacaatgactgatacaagtaatacttgatgaataattaataaattagaataaactttgtgagttaaaattaggcggcagtacagatctttggatatatgcatggtgttttattactaccaattccaccaaaaaataaagagatcagaaacaagtattgtgaaatggtgccataaatatttttaaaattgtgtcttgtattgcttttcattttttaaaggtatgaaatacttcaattaaaattgttttaaagaatctgtaatgaaaatgaaacaaatgacatagatttaacattttttaaattttgctgaaatgataggtatttttcaagtcaaagaaaacagataagaatgattgctgaaattccagcaaaagagaaatgtgagtctgtgggaaagatgactaaagaaaggtgggcttagaaaagagataattaggtagaagaaatgcataatttgctattttactctttctttataatattaatatttatgagagaatatgtgaaagagaggtcaatgttctgtattgaatctactaagagaggacacaagaaaggaaaggaaagaaaaaaggaagacctttgagactttcactttttatgaactcttctatgaacttcatatgaactataatccccctaatagccctaacctataagaagtatgatgtgcatcttaagaaaactgaggttcataaagggaatataaccttccaagtagcataaaacagagtaatatttgcactcataactctgtgagtccagaattcatggacacttcaccatacaaagctgacttcccaataattactttgtctccagcatcatctggaaagcattctgcctccagttgtcttcataattattctggtttgcttggcaagtagctcctttctttctcccttcctcccttcctttttttctccttcctccctctttccctctctctttctcagctcttcctttcttttttaagttcgtttagtggttaagaagagggggtttgtagtaagactgttttaggggctgaattgtgtcccctttcaaatttatatgttaaagttttaactcccagtacttcagaattcaactgtatttgaaaacaaggcctctaaagaggttactaagaataaatgatgtcattgttgttgagtcctaatccaatatgactggtatccttataaaaacaggagattaggacacatagaggaaagactgaacatctataaatcaaggacagaaggctcagaagaaaccaatcttactgatcaccttgatctcaaacttatagcctccaggaccatgaggaaataacaaactattcatttttagcactttgttatggcagccctagccaactaaaacagactataaagcttcaaatatcagttccgtaacttactaattatatgaatttgatactatatttacttcctatttgtctctatttacttatctataaaatgagtattttactagaacctactacatagtattatgaggattaaatataaaagaattagaatagtgactagcttgataatgttagctattataatttttataagcaatccttgaaaacctcttgggtacactgtagaaacagaagctcagtatttatagatcttattctgcattgagaatgtcatctcagactttttgaaggtctaaaaatataactgaaaaatagcactgatttggaaagagtttaggatcaaaccgagagacatttttgtttgaatttggttaagcatgggagcttagatttgaaagactacaagtggtaaggtgaagcagtacaggtctcaatgtaaaagacatgttctaaagattcagatccattggagctaaaatattttggcaatttggctttggtggccagaagaaaaaacctcgaaaggaatagcaacagatattgacaaaaatgaaatttatgggatgaaaaaaaagagcaagaagctcacatagaattaaagagagtaataggattaaatcataacattaaatttccagttcattattttgggaaaagcatgatacaactagcaggcagttattgatctgttttatcattagttttggggtatacacattattttatcatctttaagtgaatctagaaaaaaatttatggtgctaacatgtatactaaaagcatggtacttatctaaagtttctagttcagatttttctctttattacatattgttgaatttttttcttttttaaagttttactattaatctctaagctcaatgagtactttgccatgtctaaaagaaggaaatttcattttagctgctgatttatggtgtaccagtggaagacaggagagacaaaacctgacaaccagaaaagaaaaaaaaataaattgaagaatctttctaattttctgctcagcagtggctaatgttgttgtcctcttgttgttgattacttccatccactcaatttggctgatctccagggggcctacccttctgtccactaaaacctggcagcctgttttttgttttgttttatctttaactgatgtgctttcattttgttttattctattttgattgtttttcattttgggtgagtttacagcacactaataccaaagaaaatgaataaagaaaacattagaataaaactatgttggaggagaaggggaacaacaaactctacaggaattctgatagctttctatttcctttttttgaagtttactttttgcaagtagtattctcaattgtaaatccacaaaatattgagaataactaggatctgcaaatggatttttgttaataaacattctttactagatttccaactgtatttccccaatggagaacttgcataatctcagggagaggtttgagagccagatttttctcaggaaaagagtatttcctgaataaatacattgtgggaatgcaaatgtttgagcagtttcccaggggaggtttaaggccgtgtgactgcacatttgccacgtaccaaattctaacaagtcggcacagagcctgctttatctctttattaatgtccctgttgggtcccacatttttgggatgtcgagtcatcactataaagattattttggcattaaggttctttatatatgacataaaattaaaaagataaaattttgtaaatttggctgtatgctgaatatataccacatttatttaaagcaataatattagaagtgcaaagatgtatcattataaaacatcattttttataatggtttactattttcacagtggtttcttatctgttagactacatattgacaataatactgtgcaagtatgttgaatagtgctatgcaggtacgttgaatttatcttagagctacataatatatttttcagcattatatgactagatggctagtaagtgacaaaggcagaactagaacctggactacattatcccagaacatcctgaaaaataaacaaaatatatgaaatagaggccaaagcccaacccaggaaaatataataaataaatatattaattaaatttgtctatatttatttttgattcagtgagttgcctaaatgttttctatttctaaattaaaatctaaatttcatttatatttattatcataaagtacttctacatcactctatccacatatataggaatctgggtttcagcccaaaccctaattaacctcatcagagaagggcgtaggtctaaagcttagaaacctggagaattgcctctcacagctgggaatagggcaaagaagttcacccaacagtcaaaccctgaatgaatggattagtacaagcctaaacaagagaatgtctaaagagatacttgaaaatctattaagtattatatttattttcccttcaaacttgaaaggaaatacaaagcatttatataccagttttttttaaaaaaagtcttggctaaagagttgaaaagagcaaaccctgttttatttcagcctcctttcaaacatgttattatggtcaattcaaattatctgggatgaattgttatatgaagattaagtctgtttagatttgctctgtagatgccattttattactataggaacgttaaattacagtttgtccttctaattataacaatcataatgtaaatagcagtttccattgttgaatctttattattattgcttttctcatttgtatctcatactcaccttaaaagaacattatcttatgctcattttataaaggtaagaaacaatggttcaaaataacaaattgtccaaaaaacagcagtgtaactatatttgaccctgaagcaaatgcctttaatcactgctctatgctgtcagattttttaagatagtgttggtaaaaaaaaaaaaaaattagtaaaaatcatatttaacactgatgtatagattgagtagtgtgactcctttttataaaaatggtaagaatttgaaaaaggcagtaaagatttgatacaggcagtcaccatcttataatggagtcattccaaactatgttggtaggaccagttttttggaacactgaacatacaatattataaatgaaatttatgttgatagttaactggtaaaaacaaacgaacacgaataaaaaagcctcaatgcataaggatgaactagtccaggtttgaagtttggtaagaatgctgcatcagacccagttcaaggtggcttttatttgctatcacttccaaacagccaataagtcttagaatggatcttcaccaggtaagaatacaattgattctgtgagtgaagctctcaggagctctctcagtctattagggttgctgtaacaaaatatcacagactgtgtggcttaaacaacagaaatttgtatctcacagttctggaggctagaaaatccaagatcaaggtgctggtccaatcgttcctggtgagggctctctcttggcttgccaatggtggctgctttctccctatgtcctcacatggcctttcctgtcctgtgtgcacatggagagaaagaaagatatcttttctctaaggccttctttaaggccatcaatcctactgaattaggattgaacatttattatctcatttatgttaattaccccctaaaaccttaccttcaaatgcagtcacattgggggttaggtatccaacattttggggaaacacaactcagagcaggaacattcctagtgtttcaagaaagtgtctctaacttggttgcaagtttgtcttggaagtgggggtcactgcctttctatcagtaggctggagctgaagatacatcagccctagagtgcactttctaatgtgcaattcaattctttcctttccacatagctatagactttgattctctgtttcttgcggcattactaacctttaggcaggactggtcatatcaatcacatttctattgaaaatacagcaatcgccaacttcttatgttgtacattttatgataatttgcccaaactatggtgtttgtttattcgtttgtttttggttgttccttaagagtgaagtactggtctgggaaagtgactgttttctgtaagtgttctccaatgagaaagtgtattttttgctcacaataagaaggaaagacttggcagggaaaacagatcctcaccttcgaattccttctctacccttatttctcaactgtaattgcaaatcacatgtaagagagcagaaggcactgccctggaggtcaattcttgtaacctgaaattgagtaatatatttgttttctgattcagttagttgtgcagactaactatgaaagtacccagaaggcttgttttgaaattggagatctttttcaaaattgcgcacaataaaattcgcatactaaacattctaagggccctaatctaaatatgtaatatttaccacaagattttaggaaaatgatcagttattatcatgaatatgaaaaaagttggaaagacattcccaatggcagcagagagaaaacctggtaaatcctacccatattgtcaacattatctcttcacttttggcatcgtcccctgacttaatcacatgaatggaatggaaatattgcttctatataaaatctctactcaagtggtgtctttcagagcgtaaaataacttgatggttacgttctcttccttcctatgctttttaaatcactgtacctcttcctgtgttacacattatatatttatttgcttactctgtcttttctctcaaatgtaagctctttaaatatgggaatcatgtttgttctttctggtaccctctggaactcaatggatatttgtgaaataaatcttttatgaattaaaaattcggtaaaaattgttttattttgtattttttttacagaaagtaaaaggtcactggagaaatttaaaacaaatatataagctaaaattattttaaatggtatgaataaaagtgaatataatgggtaatgggcctcgagtataaactaatcctttattagggaagacaattattacttaactaatcatttttcctttcttccacctttgtttctcacaaaacctgtccatattctgtactcataaaatgtattctcaaaacttctattaaatggacagtaatggagtcacagcagcatctggccacaactgacttgccaaggagtcaatacctttacagactcaggctaactactgtctgtagaaaggtgtgtggtatagagttctacagagggccagtactagagaggctgctgcagtaaacttagttgtttatattttagtttctggcttagctcatgactgtagagtctctaatatactctatattctaccaaagaattccaaattgtgctttcaaggtcttattatataaaatgtttattgtgtctgaatgaattcagtccgacaatgaatcattaaaatgtgatgtattttatcagcaccttattgatgtaataattcgtttctttttacagttattacaagtgtcaataacagaaaaatattcacagaaatttttctgtttttttgcaaccatttgattataaataaattttcatatcaatttttctatttaaaaatatcgatagcatattcctcttttgatatgatttatatgatcatgataatcgtacaagttctatgtcaaccaaaaattttatttttcctcatctctgcaatgggaaaaattaaaaaaggtttaccaatgcagtcacctagaaattgaccattttatttatgtttgatgccatttacaaaaatagtttatttttcatgtaagtgatacattgacatgtctaaagacagcattctatttgatattattaaaattgtattcattatagttaaataaaatttttctatgaccttttataatacacttaaatactttcttccaaaggtagaaaggattgagagaatgaagatttcttaccaactgcttttatttaaaatttttttttcaaaattggaggattctatttatttttagctacatatttaactaactgttctattcttttagtatttaaaatattaaaactgtctttttacactggaaaagtaatacatgtgtatttttccaaatcataaaacataaagcagaataaagaaaatacagaataaccatcaatctgcctattcagaagcaacctctggttgtatatgatttcttatgcatgttaatatgtataagtgtgtgtatatgtgtgattatatttatatgagcatatgtgaatgatcattgcacatatattgtttggtaacctcctttgtcattgaatgagataatattgataacttttgagttgcaggcaagatggctgaatagaaacagctctggtctgcagcttccagtgagatcaatgcagaaggtgcgtgatttctgcatttccaactgaggtacccagctcatctcattgggactggttagacattgggtgtagcccatggagggcaagccgaagcagggtgctgcgttgcctcacctgggaagcacaaggggtcagggaactccctcccctagccaagggaagccgtgaggggctgtgccatgaagaacagtgcattctggcccagatacaacgctttccccatggtctttgcaacccgcagaccaggagattccatcgcgtgcttacgccattgaggccctgggtttcaagaaaaaaattggacagcctttgggcagtcacctaccaagctgcgggagttttttttttcataccccagtggcgtctggaatgccagtgagacagaaccatcatcccctggaaagggggcttaagccagggaggcaagtggtctagctgagtggatctcagccccatggagcccagcaagctaagatccactggtttgaaattcttgctcctagcacagcagccttaagtcgacctgggatactccagctttgtcaggggaggggcatccgccattacagaggcttgagtagccggttttcccctcacagtgtaaacaaagccccagggaagttccagcacagctcctcaaacccactgtagccagactgcctctctagattcttcctctctgggcagggcatctcagaaagaaaaacagcagccccagtcaggggcttatagatcaaactcccatctccctgggacagagcacctggggaaggggtggatgtggacacagcttcagcagacttaaacattcgtgtctgccagctatggagcgagcagcggatatcccagcacagtgttcgagctctgctaagagacagactgcctcttcaagtgggttcctgacccccgtgcctcctgactgggagacacctcccagcaaaggtcaacagacacctcatacaggagagctccagctggcatatggtgggttcccctctgggatgaggcttccagaggaaggaatagcagtaatcttagctgttctacagcctccactggtgatacccaggcaaacagggtctggagtggacctcaagcaaactccagcagacctgcagcggagggacctgactgttaaaaggaaaactaacaaacagaaaggaatagtattaacatcaacaaagaggacatccacacagaaaccccacacaaacgtcaccaacatcaaagacgaaaggtacataaatccagaaagatgaggaaaaaccagcacaaaaaggctggaaattccaaaaaccagaacatctcttctcctccaaaggatcacaactccttgccagcaagggaacaaaacttgatgaagaatgagtttgatgaattgacagaagtggcttcagaaggtgggtaataacaaactcctccaagctaagggagcatgttctaacccaatgcaaggaagctaagaaccttgaaaaaagtatggagaaattgctaactagaataaccagtttaggaaagaacataaatgacctgatggagctgaaaaacccagcatgagaacttcgtgaagcatacacaagtatcaatagctgaatcaatctagtggaagaaaggatatcagagattgaagatcaacttaaggaaataaagcatgaagacaagattagagaaaaaaaagaatgaaaaggaatgaagaaagcctccaagaaatatgagactgaatgaaaagaccaaacccacatttgattggtgtacttgaaagtgacagggagaatggaaagaagttggagaacactcttcaggatattatccaggagaacttccccaacctagcaagacaggccaacattcaaattcaggaaatacagagaacaccacaaaggtactcctcaagaaaagcaacccaaaaacacataatcatcagattcaacaaggttgaaatgaaggaaaaaatgttaagggcagccagagagaaatgttgggtttcccataaagggaagcccatcagattaacagtggatctctctgcagaaactttacaagccagaagagagtgggggccaatattccacattcttaaagaaaataattttcaagccagaatttcatatcaagcaaaactaagcttcataagtgaagtataaataaaatattttacagacaagcaaatgctgagagattttgtcaccaccaagcttgccttacaagagctcctgaaggaggcactaaatatggaaagaaacaatcggtaccagccactgcaaaaacataacagattgtaaagaccgtcaacactatgaagcaactgcatcaactaacaggcaaaataaccagctagcatcataatgacaggatcaaattcacacatagcaatattaaccttaaatgtaaatgggttaaatgccccagttaaaagacatagactggcaaattagatagagtcaaaacccattggtgtgctgtattcaggagtcccatgtcacgtgcaaaaacacacattgactcaaagtaaagggatagaggaatattgaccaagcaaatggaaagcaaaaaaaaaaataaaaaaataaaaaaaatcaggggttgcaatgctagtctctgataaagcagactttaaaccaacaaagatcgaaagagccaaagatgggcattacataatggtaaaggaatcaatgcaacaagaagagctaacaatcctaaatacatatgcaccaaatacaggagcacccagattcataaagcaagttattagagacctacgaagagatttagactcccacacaataatagtgggagactttaacaccccactgtcaatattacacagatcaatgagacagaaagttaaaaaggatatccaggagctgaactcagctctgcaacaagcagacctaatagacatctacagaactctgaaccccaaatcaacagaatatatattcttctcagcaccacatcacacttattctaaaattgaccgcataattggaagcaaaacactcctcagcaaatgcaaaagaacggaaattataacagtctctcagaccacagtgcaatcaaattagaactcaggattaagaaactcactcaaaaccatacaactacatggaaactgatcaaccagctcctgaaggactactgggtaaataacaaaatcaaggcagaaataaataagttatttgaaaccaatgagaataaagacacaacataccaaaatttctgggacacagctaaagcagtgtttagagggaaatttatagcactaaatgccgacaggagaaagtgggaaagatctaaagttgacaaccaaacattgcaattaaaagaactagagaagctagagcaaacaaattgaaaagctaacagaagacaagaaataactaagatcagagcagaaaagagggagatagagacaggaaaaacttcaaaaaatcactgaatccaggagctggttttttaaaaagattaacaaaatagacagaccgttaaccagactaatgaagaagaaaagagagaagaatcaaatagacacaatacaaaatgataaagtggatatcacaactgatcccacagaaatacaaactaccatcagagaatactataaaaacctctaagcaaataaactagaaaatctagaagaaatggataaattcctggacacatacaacctcccaagactaaaccaggaagaagtcaaacgcctgaatagaccaataacaagtcctgaaattgaggcagtaatcaatagaataccaaccaaaaaaagcccaggaccaaagaaattcacagccgaattctaccagaagtacaaagagtagctggtactattccttctgaaactattccaaacaatagaaaaagagggactcctccctaactcattttatgaggccagcatcatcctgataccaaaacctggcagagacacatgcacaaaaagaaaaattcaggccaatatccctgatgaatatcgatgcaaaaatcctcaataaaatactggcaaactgaatccagcagcacatcaaaaagcttatcccccaccattaagttggcttcatccctgggatgcaaggctggttcaacatatgcaaatcaataaacttaatccatcacataaacagaatcaatgacaaaaaccacatgattatctcaatacatgcagaagaggcctttgataaaattcagcatggctttatgctaaaaactctcaataaacttggtattgatagaatgcatctcaaaataataagagctatttatgacaaactcactgccaatatcatactgaatgggcaaaagctagacacattccctttgaaaactgacacaagacaaggatgccctctctcaccactcctattcaacatagtattggaagttcaggcaagggcaatcaggtaagagaaagaaataaagggtattcaaataggaaaagaggaagtcaaattttctctgtttgcagatgacatgattgtatatttagaaaacaccatcatctcagtccaaaatctccttaagctgaaaagcaacttcagcaaagtctcaggatacaaaatcaatgtgaaaaaaccacaagcattcttgtacaccaataacagacaaacagacagccaaatcatgagtgaactcccattcacagttgctacaaagagaataaaagacctaggaatacaactcacaagagatgtgaaggacctcttcaaggagatctacaaaccactgctcaaggaaataagagaggacacaaacaaatggaaaaacagttcatgctcatggataagaaaaatcaatatcatgaaaatagccatactgtcctaagtaatttatagattcaatgctatccccatcaagctaccatttactttcttcacatattagaaaaagcaaactactttaaatttcatatggaaccaaaaaacagtctatatagccaagacaatcctaagcaaaaagaacaaagctggaggcatcacgctacctgacttcaaactatactacaaggctacagtaaccaaaacagcacggtactggtacaaaagcagatataaagaccaatggaacagaacagaggcctcagagataacgccacacatctacatccatctgatctttgacacacctgacaaaaaccagcaatggggaaaggattccctatttaataaatcgtgttgggaaaactggctagccatatgcagaaaacaggaactggaccccttccttataccttacacaaaaattaactcaagatgcattaaatacttaaatgtaagtcctaaaaccataaaaccctagaataaaacctaggcaataccattcaggacataggcatggccgaagacttcatcactaaaacaccaaaagcaatggcaacaaaagccaaaattgacaaatgggatctaattaaactaaagagtttctgcacagcaaaagaaactatcttcagagtgaacaggcaacctacagaatgggagaaaatttttgcaatctatccatctgacaaagggctaatattcagaatctacaaagaacttaaacaaatttacaagaaaaaaacaaccccatcaaaaagtggacaaaggatatgaacagacacttctcaaaagaagacatttatgcaatcaacaaacatatgaataaaagctcattatcactggtcattagagaaatgcaaatcaaatccacagtgagataccatctcacacccattagaatagcaatcattaaaaagccaagaaacaacagatgctggagaagatgtggagtaataggaatgcttttgcactgttggtgggagtgtaaattaattcaaccactgtggaagacaatgtggtgattcctcaagtatctagaaccaaaaataccatttgactcagcaatcctattactgggtatacacccaaaggattataaatcattctactataaagacatatgcacaagtatgtttattgcagcactattcacagtagcaaagacttggaaccaacccaaatgcctgacaatgatagactggataaagaaaatgtggcacatatacaccatggaatactatacagccataaaaaaggatgtgttcatgtcctttgcagggaaatagatgaagctggaaaccatcattctcagcaaactaacacaggaacagaaaaccaaacactgcatgttctctctcataagtgggagttgaacaatgagaacacgtggacacaaggaggggaacatcacacaccctggcctgtcaggggttcgtgggactaggggagggatagcattaggagaaatacctaatgtagatgatgggttgatgggtgcagcaaaccaccatggcacttgtatacctatgttacaaacctgtatattctgcacatgtaccccagaacttaaagtaaaattaaaaaattaataactttccaaactgacttgcataaccttatttaatggctgcataatattttttggatatttaaaaatttatgttaccattctcatatttttgggcaatatctatttttgcaattgtaagtattcatgcaaaagtgtgtttgtagtctaatatttcaaaactttgaaagttacttatttatggtaaattcacaggagaagaattattgggtctaatatttaaacatttgaataatattaatatatattgaaaattgtcattcagagatataatatcaacatacacttttcttatgagcatatgaaagtgtttatttatttgtacctttgcctaaatagagtgtgtgtgtgtgtgtgtgtgtatgtgtatgttctttcaaactttatcaattgttcatatggatttcaataaacattaaggggctgctactgtggacagtataatgtctgtgagtacattagagaaatattttacagagtgtgagaatgcaaagtaaggaccagtgataataaagttctaggtgtgcccttgtacactctttttttctttcaaaataacttaagaattaaaatgagatggagcaaataaatatattgatgttattttatatgtaggacaaggtagtgtgaaaaaatgagatggatagaatggacataggaaaggcataaaaaaagatcgaagtttaccaactttttaatggaaaaacacactaaccatctataagattcagttttccatttgttaaatgaggctattaagcctatttgtgtttacgagtgaagataatgtgtaaatacagcagatagtgtgtaaccttagtgcattttcctcagcaaaatttaatccacgattggaaactccaacatttgtgatttttttctagaagtagaaaatcccttcagataaagtttgatgaaagtagatagagagctagaaaaaaaattggtccatttgttttcaaaaggctagatgtgacttattccaaatcagacaacaacaaaaaagaaatggtggaggagaggagggattgttaatgtgaaagcagtgtctagtttatcctcaaactgaataaacatgttttgtattcaacatgcttattcagagaattcctgacatctttaacatcacaaccaccacccattacgtcatcttcttttttttttttttttttgagacggagcctcgctctgtcaccaggctggagtgcagtggctcgatctcggctcactgcaacttccgcctcccgggttcaagcagttctcctgcctcaagcctcaagctgggactacaggcgcccaccaccacgcctggctaattttttttgttgtcgtattttagtatagacggggtttcaccatgtggcccaggctggtctgaaactcctgagctcaggcaatccacctgccttggcctcccaaagtgctaggattacaggcgtgagtcaccgcgccccggccacgtcatcctcatttataacccttaactatttgagcttgatcctaaacagaaagagtaagatccttaccttgctgcaaaaaattgcaaaataagatggaaaaaacatagtgtgtcaataaatcatatcatactatgatcaaaatcacagaagccccactgcatattcagtatagggggattaatgctgttaataatatgacagctgtgaactggaaggaaatagtattttgaagatagatccttggtaaagtgaaatatcaaaaacttctgaaaacttggaaagaaagctcgataaattaggacaaagaatgagcaaaatctgtgagaaattttatagatgtaagtcatataaagagatgacttcttttatgtaatacattttcttaaaagaaaataataaaccagccaggaggggtggctcacgcttgtaatcccaacgctttgggaggccaaagcgggcagatcacttgaggttagcagttccgagaccagcttgcccaatgttgtgaaaccccatctctactaaaaatacgaaaactagcctggtgtggtgatgtgcacctgtagtctcagctacttgggaggctgaggcaggagaataatttgatcccaggaggtggaggttgtagtgagctgagattgtgtcactgcactccagcctgggtgacagagtgagactccatctcaaaaaaaaaaaaaaaaagaaaaaagaaaaaaaagagaaaataataaacctttaattaaagaggcaacttaagagataggattaaataataacagatcattcaagatgcttcagattctgaagcacaagtgaccacaagcaatatattatgtaaaaatattcagacacattttcatatatcttctccatatttcataacatcacaaatacttaccacacacactcaaaaactgtaagacataaaactaaaaagttatcctaacatgtatacttgaaagttttcacagagcaatttgaaatatattctggaatatcagaaagccagaagtttggggataagaattatctatgatttgtaacacaatattggaaatagtggtctaatttttgagaaaattcaaaagtaaattcaagagacttttatgattaaaatgataaggcaagtgaggaagagagaggaatcaaggccacctacagtgagcatctgactttagcaaaggagtcaattgatggttcctggcactgacttgggagcctaaaataaaaaagaacgtagccctaggaaggtgattaattcaaggtgaggcagtttgagtttgaaggatttgtgaaacctccagtggaactatgaaataaaaagccccatatgtagctatggagctcagaatagaggtctctgctggagacaaaaacttgagaatcaggagacaaacgatcattgtttcgtggggtgaatgagatctatttatttaacaagtatatatagtatttgatgtgaagcaagcactctcctgaacgcttttacaaatattaactcatgtaatcctcatagtgactatgaggtgactgtgaagattgggaaggaatatcctagaagtgaactctgaacaaccaggagaaaaacaagtatgagaaaactgagaggaaatggccagcaaagcaggagaaaacttgggaagccgcagttacacaaacactaggggaagtgattattgccagaaattgtcatgagtcaacaatgtctaacgcacagagtgttccagagggcaaggggtaaacacatgcatgggatttaatgacaatggcatcacaagtaaccttctaaaatattttagcgtgagggggcagcagcaagtgagatggggtaggaacaggaacagaggctatgaaaacagaaatttaggatgctattttataaatctgtgctgaaaagtaacagacagaatttgaagagaaaaattttatgaaggttatagttgtatatggttaaaaagggagagtcaaaagctgtaagaaaagtaaaataaatagcagatgcgaacccaggcacaggtgaaaagagtttaactgtgggctgaataaaagatgtatttcccattaaaatgataggttttcttggtgggggatacaaatacatttttaaagtgtgtgtaatgaatgtgtgtttgtgtgtgtgtgtgtgtgttttgccaggggaaacaaagaaacagaaacagagagagagatgagaaagttgctgaagagcagataggaagacgaaaaatttcttgctgtgattaaattttgtgtacaagaaagagattgagattgtctttcagaatgacaagaagcagtagacttttaaaaatgtgaaggtttgatgttctctctaggtaaaataaaatggagcattaataatttagcattaaaagatttctggggctggacgctgcggctcatgcctgtaatcccagcactttgggaggccaaagtggctggtcacgaagtcaggagtttgagacaagcctgaccaacatggtgaaacctctctctactaaaaatacaagaattagctgggcgtggtggcgtgtgcctgtaaacccaggtactcaggaggctgaggcaggagaattgcttgaacccgggagatggaggctgcagtgagctgagattgtgccactgcactccagcctgggtgacagggtgagacttagtctcaaaaaaaaaaaaaaaaaaatctgggctgctggaatcccaactataaattaatagtaacttctgctgccttaaaaattcagcatttctcccctccagatacaggaatttaatatttgaatgattatatttggattttgttaactggacagagataaagaacaaaagaagcaagactttgacaggtgctggtaagaggaaatatataaatggtttaaatggtttattacttaatcatcaactaatcattttttctacatgtgttctttcaatgtttagaaatgtagataatacttcaaattagtaatatcacacttgggaattaaaaatattaaaatggctatgtgcacgttcatatttattttactagagaaaataaaattacattttaaacaatgtagatttccaacataattaaagttattagatatggtggcacatccatctaccgaatttaatatacactaagttaaactggcagtgataatgactagaagataatttgggaataatccacatgatacgaatttgaaatgctgtacacaaaaatagatgcataatttaagatcaaccaagtaaaaaactggtgttcatggagaaaaagatggtttggtaacagaaaatactttaggtcaatgagattatgaattcattttcatagtttctcttctacttaaaagaagtttagtcatctggtttgtttgctcatgaaacattctctgctacattagagagtgagaagactctttaatatgttcataaatccagctctcagagaaggttagcctacacccacctaaagaataaatcaccattaacccacattaatcatggtgattccattaactttatagtgtttggtttagatatctctatatgaactctggctaacaagttgagaggggatgtagctgcatggttggggatggggtgattttgaaaattctccttgctgtgaatgcagctatatgggaagaaccacaaggtatctcctccttctatttgtcctgtctgtaagtgacacttgttactgaagctgcaatcttgtaacattgaggcagacaaactaaaaataaaatttatctgctgtgtatgatggaaataaaaatataggaaaaacctggttccttgttgaaggaaccagtcttgaagcagcttacctctgtattttgtacctctaatgcaggctaataaatttaagctaattatttatgctacctgtgctgtggtggtttcctatcagcagccaaatataacctcacagttgttttgctgtttttgctttcacaaaagagctattaaccaacttaaaaatgttttttgattgaaggatgcttaggggatgagaggatatcaacaatataagcccatgccaaatccccatttcttatcattaaaactgacctgacattaaagcaatgcttaattttttaccataagagtgaaattttgggattataattttaaagtgtaaaatatttacacttaaattacacttataattttaaagtgtataatatttacacagattaaaataaaatatgggaaacaatgaagcaaaacattctaaacttgaaaagtaaattgatattacaaacacagagtgacttaaaaacaaacaaaaacaacaaaaatcaaacctccgttataattgcagatttgttgactaaatgtttactaaaagactggctagcttgagcccagggggcgaaggtttcagtgagctgagattgtgccactgcgctccagcctgggcaacagagcaagacttcatctggaaaaaaaaaaaaaaagactcgctaaagggaaatttctttttggatttggctctttttacaggaagtcatacttttctggagaactacttgatgaaaaatttcttaaccttacttcatgaatcaaatcacaactctttctacattttagattgtgaaaatctcactgataagaaaaaataattgtttctcttggccaggtgcagtgactcacatctataaaaccagcactttgggaggccaaggcgggcggatcacctcaggtcaggagtttaagaccagcctggccaacatggcgaaaccctgactcttctaaaaacacaaaaataagccggttgtggtgtgcgcctgtaatcacagctcctcggaggctgaggcaggagaatcgcttgaacccgggaggcggaggttgcagtgagccgtgatcgtgccactgcgctccagcctgggtgacagagggagaccctgtttcaaaaaaaagaaaaaagaaaaagaaaaataattgtttcactcttttaagtacaaaagtaattgtacatagttttttaaaggagggaagtctcttccaagaataaaactgttcactgtatagaattaatatttttgttattcatagtattaaaagaaaatcccttggagaggaaatagcaataccaggcaaaatgagtatatatttttatgttacaacacaatagcatatagcatatgcaaactatttatttaaataattttaaagctaaaatggagatgaggtcacacatttatacactgctagagctaaaaacaatcatagaaataagtatctgaaatatccagattttttaaatacaaaaactgaagctcaggaaattgattttttcaccccagagtcttacatttacatattggcaatgtttcaactcagacataggaatgtgaccattcaaggaaagggcaactgcaaagcttcaaaagacacgctattctcacaaatattttcctttttgtcacctaaagtaaatttcagattacttacaatctctagaaattaacatttcattaaaccataactaggaaatgtgtatttaatatttgagcaaaagttaagaaacatatttaaacttaattaaaacaaaaataaattaaagaaaattaattaaaacaaatttttatgtaatgttttgagccaaagttaagaaatttaattaaaacaaaatcatttttggtgtttatgtttttgataggtaaaaataattttctcctaccaaataacaggaaatattaatatttattgccaattaagagaggaatgtgagtcctggaagtggagaagtgaaactgagaggcaataagggggaagggggagaagagatcattagaaaattaagaacagggcaaatgtaaacatgtaaacacatttcttaaaatttgcaattgaaatctgaagagaatgtgatatactatagatctccactactaagaatacaacgaacacattgaaataaaaaagaaacacataataaaggaaataatgccaatgtttctttttatagtaatgaatagtattttaatatgcctgttctatgtatagttgtccataactactaaaactctctaaaaatgaatggaattattttgtctggactttatagttaaatttgtaagtttttttttttttttttcagaaaaagattacattgttttctttgaatgaattcacctttcttcatcaaaactactgatttccatactaactaaatttgtttaaaagcaaagctctttatggtatgttatcgtcatttccttaagaggggaaaaaaaacaaataaaagttagcattacatatctgaaccaaacggaggttttcaagaataaaattctgcacaactacaaaactagtagctccaaatgaaaggaaatggaataaaaaacgaatgcaagataatacaatgaatttttggcatgagaggaaaaaaaaagaataatatattaaatgtgtatttctctattataattaccatacatattaaaaatgagaatgatatagagagattgagaaacctgtggctacttttggctattttacctgctttttgtatttgctcttctaggtacctgttattgagtgagataagcaaatggtatttcaggaccaaaacatctgtttcctgaagagttgctcctttaattgtgtatctacctacctgtctatgtaactcttggtaaatgaattaatttgttagttaaaatcaatctattaattcataatgaatgggatatcttgtgggaggtacatgtgctttgcaaatacatggaaagacgagactttcctaacaggttctggaattcaggttgatattacctttttaaaaatttttaaggattaatagctaaaaagatcaagtcagtttcttcatttctcctgaaggcctgtttccatcagattttatctctgcctaggcaaatacattggagacttctcaactttctgcttctgatgatctcaacttgtggtatggcaaaaggagagcaaaatgttcacccaggtatgggaatttctcacaaaaatgttactttattatatttaggggaaaaagggggcaaaatctacactcataatacctgagactggatttctagaaccttttggtttcagatttatgatgaattagaaaacttcctgattagaaaaatgttatagtttcaaatattagctaaaatttttatctgtaagtacaataaacatgacaaataatgatcagtgttttcactcctattaaggagagtatttttagtaataaaaataagccttaatgtgaaaaagctaagaattcatgattgcttctaatgacaagtatctgggaggggtctgagtttggttcaagagaggaactacagctgttggtgactacaaccatctgcccagatgacatcgtgatcaactcctctgaatcactctaaaggaacgagaagtcctggcagctgagtcatgatcccccaggagccattaagaagttaatcttcagtcacttccatccaaacagaagaaaacccatgaaggatgagaactatgggtcctgagaatgacaggtaattggtgccactttattcacagaatccaataaatagtactctttgattcacatatttaatgctcattattgtacatttttataaagacaagttagtctaaattgccattcatctctttcttatcaaagtcctacccaacacatgatcatatcatcagaaatcagatattttcttgttgaatgccctacctaactcattcaattgtaattttctgggaatggtgaccagagatttgatatttttggaagttacatcaaatcctcattactttataagtgatttaaaatttatcacatggtacacttttcatatctttcaaaggattaatatataaaaaatatatagttaatgctcagctttaaagacattaaaggacagagttatacagaaagaaagatccagagatctttctttaataaagatattaaaattgaatctgcttattcaagtataatgatagaacagaaagagatcttaaaattgtttaatctcttccttggctttcaaaaatataaagtcttctttattggagatttctttatccatagaatatcttaattccccactccccaacttcctccccatgtgaagttttatctgtctttaaaatatttgtgttgtcttcttcaggatatatcattgattggcactttttgattctagttttatatactgttatccttgtatattaaagtaggtctcaaatatatctttcatggtggtgtgtaaggttctgagagagctggaaaaaaggtataagctcccttctaaagtgcaagtatatacttgcagagatattttttcacttacattcttggagatcatccatggtctccccatgtcttttacaaaagaggtttccagcacctattagggaagctagatggtcacttgtatcttccttatctctgtattagatgataatatcgaatgcaggtaagtggtggtggggagagtaatattgacagaatagttatatggcaaacattggcacctcagaaattttttgcttttttgagggctcttattaatatttgcaaactttaaaaagccttgaaaagagttttatccagagctcaccacatatagaaaaacagatctctcttgttatgggaattgaggctagtccaaattcccccagattaaacatctttcctcatttggcacattcttcagctgttccttaagaaaaaatcatactaaggaaagttaattctgggaagtctagaattagaataaaattattacactaaaaggaaagcccagatatctctttaaaaatgcttaatttttttgaaaactcacatcagcaccagatcatttctttaatgtgtacagatttcctttcttcattgactaaatagctttgctaaacgagattaaaaccacataactcaaatgagacatataagatcttgaataatgttcacatagctacaacatcaaattccagtgctaatataaattatgtctactacgttttcatttatttgggattatctgtttgcctcaagtggtgtaaaaaaattgagcaggaaccacctgaaacttcctttcacaacaagagaaagttgtaatttgtatttactttacctagctttctttatatgaatgtagccaagaagcaggggaggaaggacaattacaggaaattgtgataggaaactattaggaaaagcaatttgtaatttctgctaaaactctaggtaaataaccctgagcattcatagtctggcaagtgggaagtacctgttgaacaagtgatcacttgattgattttaagcatgtggagctcatttgtcatctaaaatatagaagagagtgagatattagcttcctgaatagctattgttatttagaaaaaataatgaaccaataaacttcttacataagatgaaataactgttttctagaaacagtgatcttatgttcttcattgtataaacacttatgtactcatatcacatagctcctgggatacaataaacaataaatgtatgtttatcttatttaggcaaactaaaagttacaggctctgtgcccttaaatttttaaatttatattcatcttttgttttttaaggtgttatgaaaatacaattttaaaagcccttctatttctaaccaccatgtattaacagggattggatttttccacccacctgaaataagtaaaaaaaaaagacaaaatataagaaattatattggtcagtggagagcagtgatttcatagagatgagaaacaagtgtttagccccacatttgtacatttgttccaccagactgagtggagactcagtttagtttctatatgaaagctcagggaggaggaactctacaagaacccagtggtctcgctgagtttgggagacaaagcagacagtctcaggaggtagttagggtatatagtaccgaacgtcagagaggacagagttacacagaaagaaagatccagagatcttcagatggacttctaggcttcagctcaatattgatctgttgcattcataagagaaaagtctaaagactgggtgaagcaccacctaaaagggttagaggggcccacacatgtaaagcagggaatattttttgttcccaagttgcaaaactctcagttcatggagcattaagtatagtactcaggtgtttgcaacagtagtaggaaaaaattaaccatagaataaacaattctctggtcttgcctaacaaagtttaatagcaagacaacaaaataggaaacagtttccaagtactttaactacatcccagaagagagctcaaggatatttatagaaatacaacatataccaacacccaataaggtaaaattcataatattaggcaaccacatcaaaattactagggatgcaaagaacagtagaatataactcataatgagaaaagtctaaatgacagaaatgacatcaaaaacagaattagcagacaaaaatattaaaaatgtaaagtattttccatatgtccaaaaaactagagaaaagttgtattacattttaatataaccattgtgattcattttctgagatgaaaattaatctttgaagcttcctaaatggactttaaaatattaccaaaatattcataataaacaccattattctggagacttaccctgtttctgagatttactctgtttttaagccttgggaaatgaggaatgaggaatgaagtgatgcttacagatgaattatcatagaattcaaggactggatagaaatagataagggtcaagaagaggagaagagatagactaggttggcagcagtgtggtggcagcacttgagggtgtggtatatttcgagggtgtcaaaggcacattgtgcttggtaataaaaactgtttacattttatcagtgtcctactgatgaatactttcacatttctgatgttgaaatagctttcttatgccctaataagcaatatataatattttttactcacatattgactgggtaattccttgcaataattccaagtctacacagagacctgtggtccatcacatggaacaattgggatagttgtactgcagcattggaacttctattatgggccatgatgtccttatattcttttgtttttgaagtaattttaacacctggttgttccaactaagagaggacatagcatcccaaatagaggcttaaagagaaaacagtggatttgacatgggcccatactttctgttattgtcggtttgaggaagaagaaaagtagaggtgaagaagttgccttcagcaactggtagctactggtagttgaatctcaggctgtggttctacttggcacctgacacttggagaagtgaagacagggagagaaaggtaatgggaagactgggcccccggaattgatacataacaccaagaaagcagtcagtgaggatttcagaaagccaggaaagatggtctattatgaagagaacttgctggaaacacttgaacacttccctgtttctggtgagatttgatatccagaaacacatgtctattgaattcaagtttctcctaatgcacattgtagcaatcagaaagaattatagtactgctatatttctataaaagatagcagaatctacctttgacactaatgcatgaaaatatatttgtgttttaaaaaggcagcctgccaaatttaattcctaaaatgagttaattgctatagatggtaaacaaaaaaggatggctggttgtagaaggcctttattgagaatagatgagttgtattgtagtacaattcttagatcatgtccacatagaaaaaaataaattgatgatataattaacccattttaacctatattataattcaatttaattaatttatactgataagatttttttgaaaatcctagtctaagtaattttcttcacttttcatattgtctgttcctttttattttttgtaaggatgtttactttgcattttttttcttgtattaggtagagatatcagttgaaagataccttaaaattttgtgacactgaatttaatcagccaaccattcctaaggaattgatagcatatttactatttggttagatggataggcactctggcattaaattaagtctctaaagttggcattttttctccattagtttgccatcctgcccacttacctcttgaatttgaaagatgtaaacaaaagatttctaaagattagaaaattaatttttaagataattaagctgttttgaaaattagagtttattacaaaatatgttatcattttatgtattattaatttaacaataagttttatgacagaagatttaagtcaaaatagttgtacaatcaacaagcaaatgataatcatttccttaaatgattatctgactgataaatggacaatcagtcagaccatcaaacaccagttgataacataatccatttggacaggaaccacatttccaaaggagttttgatttagtcattggtggtaaaacaaaagatatcagactgtaccttaaaaacaaagaaacaaaacaaaacaaaaacttgtccaattcagtatacctaatagagataggaatcaaatagtagtatatgtcattaaacttttccaacaagattctgtggtcacttgaagtagaaaaacttggttttccaatataactactcaaatcagtaaaaataaatattttaaagttttactcttattttaaaattacttgattagttatctgtatttacattaatatttttcaatctttgttgatccctaattatatttcatataattttattaagctgtaggccacaaattaacatttcaaactcagccaaatttcagggactatccctctttagtttaaggattagatgagatatggacactgtatattgaaataatcatgcactagaatgatagatttaaaataatctttaaaatgtgttagggagattttgcctccctaacacattttattcaaaagttttgcagtatctctcaaaattgtcacaactttccccctttcatgtaaatattatgcttttacacatgaaatatgactctctgggcagtatgtttcctgcttgagttttgccctttgtgtttatattatctcatgttatacaaagtcattttgtgactaatttccagagcactgagtcacagtgtggctgttgcttatcttttcttttttcccacatggtagtactcttggcccttatttttggtaattattttatactaatgagtgctttttcataattaaataattgtttctctcattatatttctgtggttgtttactgctgtattatatgctttcatttttcactagaagcaaacattttataacaggaacataacagtacatcatgtaggcatgttatctattgttttaatttacaaaattgcacaacatagacttgatcgtaagtattctcgtttaagtatctcagaatatgacctttggtctttggagaattgtaaaatatttccttagagagattagttaatgctggcataaaatattccatttagattacgattattttaatggttatacctcattttaaatatcatcaactaatagtattgaaagattatttgaatagaagaataacagtctctattttatatgttatgaaataaaatggaaaggtaaaccgaactttcaagaacttccaattaaccaagcacaattagtaaagaattctactacaatcttcaaattataaaaaagctacatacaccaattagttacaaaaatgtttatggtttaaaatcataaaaattgcacataaatttgcttaagaactaaatgcaaaatgctgagaactcaagtttggattgcagtttgagtttactctgtttacagggaagggctgattttcattttacgcaaataaacagtgatcctcccctatcagttctttgcctctcagcaccctgcttttcccccgagaaaaagaaattaaagttatttcttatgggctagacagtatattgccaggtactcacaagtaaaatctctgatgaaagttcttggaatgtttttttcaaaacggagttgaggttattttgtttttccttccaggtattgaagacaggatttatcttctctacttcttcttttagaagcagatcaagaaactggcgattgaagagtaactgaaagaaacgcaatctgatcttactagcagtgaaagagcgaggtaagaatttgactattatccagcctaaagtcgctgctgtctgttagagcaaagagggagcctcagagtcggcttcagagatcactggcagttgggaat

SEQ ID NO: 2792 - DNA, 90262 bp, Homo sapiens
  source 1..90262: mol_type = genomic DNA
ttcattattcagaataatatattttacttcttataatgtaaaaaatataatcgtttgagtggttttcagcatgatctgttaattttgaatacagagaatgaacaaagcaggtaaatatatgtatatgctgaataatgtaattccatatacaattcacagttagatgcacttaattgtggaaaataaaggaagacaataacatcaagatctttttccaaaacacggtaaaaataacgttcacatgcattaaacatttcaagccatctcagtatatgtctttcttgagtaagtagtgaaccaatggaccagtggttattgttggagaaaacaattaggcaactcatcaatgcgctatttatacaatcttagtgactatttaccacttcacctaagtagactttcccactcatttgaagctattgctatctataaataaatggcaacaggaaatgtttcacaagggcctttgatttccaaaactctcaaattccacagcaaagactcaatttaaggcaattatttatgcactgaatatttgaatgaagatgtattattttccttaagtgaaaaaagctgatactattttgtaatgataaaatttgtataccatagtagaaaatgatttgcaattatgtgttaggacttttcatattccatattgaaacatagtgattctgtagctggcatcagctgtaccctgacttcacatgaatggcctggaggggatcatatttttaaacaggaaatcagtgtgaattagctgagtaattaacattcagtgtacagtgagcattcttaactaaatcaaagtagtcatgaaagaaagtactgttggtaaatccaaaaacatacatcaaaattaaatggtgaggttgaaggttgtagttaagtaccaactagtgtgagttctgggagcattttgaaatggtggaggaatgtactaaatttctgaggaattaatactgatgggaaggatgcagtaaagagtaaaaacgggggcattgtggtttatacctgtaatcccagcactttgggaggctggggctggaagattgcttgagcccaggtgttcaagacaagcctaggtaacgtggtgaaactcgtctctacaaaaattacataaattagctggtgtggtggcctgcacctctagtcccagctaggtgggaggtttcagtgtcctgtgattgcaccactgcactccagcctgggtgacagagtgggaccctgtctaaaaaaacataacaaaacaaaacaaaatgaaaaaaaaaaaaaaacaagaaaaaagaaaagaaaaagaaaaaagtaaaaagcctagggattgggtgaactttttcgaaaaaaaaaaaaaaaagcataaagatttggagactgtttagatgtggtatatgagggaaaacaggaaatctaaattgagttcaaaatttcaatcctgaagaacaggcagaattatactatcattgttagcgagaagtcatgaagctattcatgaagctattcatgaagctagtcatgaagctagtcataccaaatgaatgaaatggttgtttctaaatcagttccaattccagtgtcagatttgaggtgaacactacagaaactgacatgtcttggaggttgttgaggttgttgaggttgttgagatgccagactgcacatggctcagcaataaatgaaagatacaggtctggatatagtgaattaactccagcaaaatattaaatccccaagaatgactagcacatgaattttctagtagactcttccctgctgataattttctcttcaacagaaataacctactttttaaagcatgaattattagttgcattgtgtgcaaatcctaatgataactgaatagatttcagaaggtttaaatatttttgttatttttagtaagaaaaaatattgggaagcatagtattaagaagtacatataaataattccctctcgattgccataaaacttcttgtttccataaaggttctccttatcatgagttgtatttaacacacaattattcagtcatcttgactgatagaatgggctatggtcaaacaaaaaaaaaagtgaaaccaatccaaatcaggcaggcacatgatgcagagttgactgttcaaagacagtttagctcaatatagatggaagtactggttagtacaaaaggagaaaaactatgtctaaggagggaagcacataatagaattctattattacaatagaatactataaatacaaaattggataaactttatcagaagcaggtgtttgtcaccattttatatgtgaaactcaggaagttcttgattttttaagagctgtattccttaatctggttacaggctataaaggagataatcatttacatgatcatattctcaaacagatggtcaccaaatggaatcaaaggactgatttgatgtagccggtagtatgataatttgtagttaaatgaaaatacagatagatccagaaaataagtaatttcccagtagccagttaataaattacagacctagaataagcaatttaacaagattagaaaagcaactctgatacaaacgtgttgataacaagtacaataagcatagaaaatttaatgaacatattaattaaaagcattttagaagaaaaatagaaaatcatagtgaaacatttcatataaaatatttagtagaattaatgttacattgctataacaaattcacatatttttaacaaaaatttcttcatatgctattttcactctctgcttctttctttttcttttggttttaattaggcctccttttgatattctttggatgaaacctataagaggaagaggaataaattaatgtgtgataaaataacacaatgaaatgttttatctaaaatcttctcaaagtaacttttaatatttaaatccaaaagatgttattgatttaaaagcctttaatttgtccatgtattcgtgtagaacaatttatttttaaggacgttactttgcatatatgagttaataaaaatggataagcatgccgttcatttttattattagttcctcttctgttacaaatccatgcttgctttatttttaaatagtagaaatgtggttgtatgtggttgattaagttacagatagtttttatttgcatttttatactcttcttagtcttttataaacatgcattacttttatattcagaagacattaataaatatgttaaaattttgtgcattacaagaaagcttaaaacaattttggtatagtcttttaaagtgaatgcttagtatttgaacactaaaagaataacatgtttaatttgttttaaattgattctttttctatgaggacattaaaagaaattacagttacatatctagcaatattatctaaatgtaattgaagaggacatttattagctagattatactttcttataataaagataattaatttcatatcttaatagattatcatttcaattcaattgctatcttaaacactagtcaattaatgggaagagtatcttctataccttttttacatgccctcagacattcttgtttggaagtaaaattgttttcatttcccccacatccactgtacttaaatgggcggcatttcccaatgactgaattgtagtagaatctgttctcattggcacgacacaatcctctgtctgctggagtgagacaccatgagggaccgtgaaattctaaaaacaatcaggaaaacatggtaagccatatgtgatagtggatttcaggttttcgtattgtatattgtttatagattaatgttgttgcatgtgtatgtaaaacagtaatctgaataaaggggtatttaataaaattcgtgcatttcaattctaggaaaatgcttaacaaaaccatgtgtccagtatattgagatctttctccaatgaattaaaaaatctcatttgctaaagagaagtgttatgattactctttatatgaacaaactatttgtacataataaaaaccactcttcaacaatgtaactgctgaaaatttcttacagacacacacacacacacacacacacacacacacatcacacatatatattaatttacatatcatttgttcacaaatatttggctttaaaaaattctaatgagcaaagtttttatttgtgatgtaacaaaaacactgaagctgaggaagagttacttctcttgactaagcacatgctgactgatgtaatacaagcacagtttaaagtggaggaattcaggtatggcaagttttaagtttcaaggaatgagtccagatgagttgtttgtcttggtagcattttttttctcatatttgaagcttagttctagatgagttaaatgtttttgcaaaggaagcaaattgatttggatcagacagataagctggtttgtcaatgggatcaatcaatggttttcaaaaacagaagagaaaaatacaattagggtaataaaaggagcactcatttgccaaatcaaaagagaaattagtttcagctgaatgttagtttttagctctctgggaattactgtcagtgaggggcaccgagtactcttcggtagcacagctaaactgcttgatgttaataaaccagtactacaggtaagttgtatggcaaggaatcaatacaagaaaactttaatggctttgtcaaatggtgagatgtgatacaagcaaatacagaggaggaagatttgctaaatgtccaatattagcagaaaatagaactttgaggaatccagtagttaatgaaggtgaatagattgtgctttaagcaagaagcagtcttttggcaaataaaccccagatgaacagactgtaaaagaaaagaaataaaacaaagtgagaaaaaaatgaaaaaaaatctcaaattgatataaacattttttaccacctcctgccttctagatatttaaataaggactagagtgtcttgatatagtaactcaggtaataaaaaatattctgggaaatatgagagggaatgaatactgtgagaataatttatgagaagaaatttgagacaggtgatatttttgtgccaaactatatcaataagatatcagaactataatcaaataaagagtatttagttttacttaggtctttgactaggtatatatgcagtgattttaagaagaccttctaggatttgtaaaatgaaaacatcgttttaaatcatatgtagccctttatgttttaccttctcctatgtggggattatagtgcgtgatttttaaaataatttttattgtgtatatgtgaggtttacaaaatgatgttatgggatacatatagatagtaaaatagttgctgtagtgaagcagattaacatacccatcttctcacagttacatttttgtgtgtgtgacaagggtagctaaaatctacttatataacagaaatccctaacacaatactgttttactaactgtcatcttcatgttgtacattagatctctaggcttatttatcctacatgcctgtattttgtatcctttgacatgatgatatgccatcataaatcaaagttgaatggtgagaatgtgtgctagacattctagaaaatgttgacatttcctgtcactaagaatcatttatattagaggaattttctagcagtctaggagagttatattgtaattgatttgtactattgtacacacttttccaatgtgtgggatgtgtattatcatcatccttgcacagtgtagaatataaaatgattattaattgccaccactttgatctcatgagcttccagttatcacctatgttcagaaacaaaagagatgcactagatgcaattaacctaatttgagaaacagagaaaacaggaaattactatcgctttttttcctgtttaaacacccacagtaacttcgaaatagatgtgtatgataaaatgatatatgacttatacatcaatttcactttagcattttgtatgtaagatatatctgcccacagtaagttgcagataatatgtgtgaatgtggttgtaagttgtatccttctttgcaaatgttagttgttacgtctaaatagcaatgccagacatcaagcccccttattccagaacagagaaaattttctgatgacagggagcaaacttcttctcttttcccacatacaacctatagtaaacatggcccaatcataaaatcaaggttatttcaaaatgggaaaaagctaggctagtacatatggggctacagtccctagattggacgtatgagaagaggagcctctgttatcatagaccaagaacagcaggtgaatcctagaaccatttgggcctttccattgaagctgaaaccatggaagatacaccacagatgtggtggagagacatatgctagcttcagtcttcctttgactatccagtcatccaacaaggcctgccatttaccaaatcctttcagaagccagaggagaaagttccccataaaaccacatgagcaggggattggtttgagagcaaacagacagttgaccagcatagatgccagcagagaaaacttcactaaattatccaaggcatcagattgcctctactgacactctttatgacttctgaatcagagggtgtctggcatgctgcttctgacagcctgggatttggtatgcagatgcacctataatcagatacttgctcctacttgtccatgactgatgcaatgtcagttgtttatctatcttactttgccctgatttcaaccactgcttacgcagatcattcaacacaacagagttttgacccagatcaacagtgaggttcctaacactagaaatggcaatatttcgatagtgcattaaaatgtgaagttaatcactaaggatattgtattatgtgtaattaacttttagaggtttttaaagatgcaataaattattgtcagttaaggaatcattataaggcggttattcttcagaacataaattttacctaatacgtaaactaattcatttatcttaagatcattttaactctgagcagtaagactatcattgggttactataccataaatgacagtaaaattaaagtaatgaagcaaatggtttcttaagaacattttagttccatttgaatttttttcacttcttgaagagaaaaacttcattgtttccaaatagcaaatttattctacatatagatcagcactcatctattcaaaatccagaatttgctatctacaatgaaagaaaatataaaggttttgcgaaatgtaatttttttagttgagattataattattgacagaaagttaagatagaataaaaagacactaacctgacttttgttgtttttccaaagggaatttaataatcaaatgcattctgtcttgattctgccattaataaccagttgtgtaccttctgtctacagggtttttgataggtttcagaattcagggtacacttttttttttaaatcaggaactatcatgatctagtgtgactgctgaactgtaagatggtgctctaaactcagttttacaggtaaagttgttaatgtaaatttgctttgagatttgtacagtaaactttgaatcatatattcactttgaatctttactgtggtatcttttttatgattcccatttggcttgcctacttaggcttttgttttactaaacaaactaggttttaagaaatatcttacaacttgttaagtacatttattttattcttctaagactttttagggaattgaataacaaatcttttttaaagtttttttctctataattttgtagtaaagagaaatataaattatttactgcaaattatctttgtaaaactttgaaataatataaaagtataacaaatgtaaaacaaaatttatccataatttgattcttgccctttaaccactaccaatggtttacatatctccaaattgtttgcatattcaaatgtattaatataatattctatattactatacttgataatattttgtggctgtgtctccacatttttatataggcctcactctttttaatgtaggtacagtatttcattttatgagttgactacagtatatttagtcaaatggacatatggattattataatttatttttttcagtaccagacagtggctcatgaacacccatgtacactggttcaggtgcttccagaggacatacttctaaaattagaattatgcaaaatctatattcaatttataacttggtagatgttgctgaattttccactgaaacttttcacaaatttatatgcctacaacgacatttaaagtgcctaaaccatttagcaaaccatggaccttactgctatgaatttatctcctattcaacacttttttcttccccatgccaacaaaagtagaagagtactatgtgggacaagaaactgcttatagcttgccaaatgttatatgaaatatcatttatatgaaatccaaatgtcattaatttgaagatgcactattattttatgtactattcataaacaaagaaagacacggccaggcgtggtggctcacacctgtaatcccagcactttgggaggccgaggtgagtggatcacctgaggtccagagtttgagaccagcctgaccaactaggtgaaaccctgtctctactaagaatacaaaaattagctgggcgtggtggcacacgcatgtggtcccagctactagggaggctgaggcaggagaatcacttgaactccggaggtggaggttgcaagtgagctgagattgagccactgcacttcagcctgggtaacagaacaagactccatctcgaaaaaaaaagaaagaaaaacataattacactgttatacactatcagttataagtttcatcatcattagaatcatgttaaaaggtagaaaaacctgcatgttagaatcaagaaaatataataatttatattttgtaccaacacacaatacatacatatatatacaagcacatataaatgagaatagaatttatatatgtatccattgggcaaatatttaagaggacatgcaatcagttgggaggatgattactatagagatagctttattaggtagggagcttagagatttgctaggttaaattttacaaaaagatacttttatgctgagcttattctatattgttcgggctcctccagcagctacttccagtcttgaactttatttactttgtggtaagttgaaaaaaaatacaagaaaatagtaaatgagatatgctagaatgccaacagtgattgtttctgcataatgtggatatggccagtttttcttcttttattttcttttttattcaaattctttgcaatcataatgctcaagatatatgatagaaataatatgttagagtgagtccagtgtcctgaggtaatagataaaagcctagagattagagattggaatctgtttctgagtaggaatgtgtggtaaacttgtccctctctctgtaaaaaagaaagagtatgtatctctattcattaatcaggagaagtggtattaaattggtggaaagtgatattctataaagaaaaaaaaaacggggaagggaatggaaaaacaagcactgtggagcttttttttttccccccgcatgtgtatactgggccacttacctgaggataaagtatagaaggagggttgccagtgaacttaaaattgaaaggtcataaagaatagactgagtgaaaacctgcccagacagaaactccctccacatattaagagggaaggaaataaattgggtagatgttctctgggttggatttcattgcctagatactgcgtaatccatggacagagtccataaagtcatgtttcttcagggatttgtctaagcaaggccacaaagaaagaaagccatggtaaaattatagattatacagctattgagtatactttattctaagataattatatcttataatgcattagaaaaactttcttcatgacatatatgtaaaattttaagccctacaaaattttagtaaaagtaaaaaattaacatttagtctgttgatcagctttttaggaagaatgggattttagtaagcagagaatacagagaagcatatgggtgaaggaaagtgaaaacacaaaggtcagaatgtttctggtttgcttgggggtacttcgcaaactccaggctatctggagaacataacacaaaaaagagtatagtgggatacaaggctggaaaattacatttaggtcaaattaagaagattcttgaatactattatatttagatttttataatgcagacattaaagagccactgaaattattgaataatgaaaatacaagttctgatcttgttgaatacatgaagcaaactcaaccaggcatgcttaggttgaatccagtaacttctaatagagaagaatataaaattaccacaaccgaagcagttaccatgggagtagctaaaattaagcaccagattgaatttgggcaggtagagagctagagatgaaataattctagtgtttctacattcagaagatgtaatacttgtctaacatgttatgaaacattatagaataaattctacttataatagttgtaatttttgtaaattttggtggcttttattcattgtggctttacttagaaaaatatctgaatataaagaggaaattgtagactatgtccatgggttagccagcatccaggcaaacgagtttgaagtggaagatgaagatagagctcaagttttgagaagatagaatattttaattatgacattgtttaatgaatgtaaaatgttattgtgactctgttctcccgtaacccttgtgcaggtctctgtcttagcacgtaacacaggcattgaagtcacctatttatttatcttcttccctatttgacaaaaacacctataaaggacaaacttacacttttattattctcatactcccagtacctatggtagtcccgtgtaggagacactcaatgtttgctgaaatgaactgaaattaggaagtacacagatctgtaccttaggtcataagataaagttgaaaatataggtgtatatgtccttcaattagttataagatccaaagacaaaaaatatgtataattatgtttgaattttcaagtgctatatatgttatttcaaagaaacttagaataaaatttgttaaatgaagatatgtcagatcaaggttacagactttagcttcattaaaaatgatcaataacaaaatgtatacaaatagtactcattttttgactataaacctcggatgaaaataggtcgtcatcatcatcattgaaaacaacctcaaaaattaatactttgtgctttaattgtgtgctcaacaactgggttaagaattttatgtctcattacagttttccaaaagttttgagatacttcttgccacatagaacaaatgaggaacctgaagccaagcgaaattttgtgatctttttttcaaggccacagactgagtcagcaaatagcagaactggaattaaaaaccacatctttctttctataacgtcaatgctctcaaccactaagatatgtcattctgaaaactaactagaaaattaagaaaataatacctgagcaaaactattttaataattttatcagataaaaataaaattgtcacaacttctcctttagaactgatgtccaaattccctcttttctgaagctcaggttcagaacatgctaaatgtaccatagtccacagttacaaacatgaagttgaagtttcctaagtttgaacaggagaaagagttctaatcaaaatatgtcatcatacaaggaggctagaaacaaatcttggtgcaacagtgctgattcaaacagtatttagagagcttgaacatttgaaagtaacaagtattgagttggcatggtcaacagggactgattctagaaacaaccacaccaaagttccagtcttgcatccatgtgatcatatctgcactggtcactcagatccatgtaatgcactggtcaatcagatccatgtagtggtattagatataatcaaaactggaaaccccacttttgattagatataatcaaaaactggaaaccccactccactgtgtccctagaagaggcagagttggaattttcctgatcaacagattttatttatttatttatgagagagtcttgctgtcatccaggctggagtgcagtggcacaattacagctcactgcagcctcaacctccctggctcaagcaatcctcccacctcagcctccagaataagtgggtctacgatcacaggccaccatactgagctaattattttatcttttgtagagagagggtctctgcatgtcacccaggctggtcttgaactcctgggctcaagctatcttcccaccccagccttccaaagcgctggtattacaggagtgagccactgcacccagccaccattttgtattaatacttcttaatttcatttctgcaaagattttccattactcaaatagaaaaaaggtagagaattacacacaacttagagtagctcaagtttgtctaagctatttctaccacattactaagctgccctacaccagtcactattaaattcatattacaataaggatttttcttttttttaagcaaaagaagtcttatcaaattagtattatttattagtttgtagcttgcatagtattaacttgtaaacaatttttggtttatagttgtataatgatcataatgaatttattcctactatgttactggttcatacaaaatgaaagttattttaagtaatttggcttacaaattggaagtctgtgattttttttccttttaaagatatctatatattattcaagcttgagaaacacttctctggaggacttttatgactggggcaacaaattatcttgtgttaagactaaagatggtccaggaagaaagggattagaaaagtagacagtggtcatctagggtgactgcattttgatggcagtgattttggcagagatgaagtgccacatttttgtttctcatcagcattcctgtcaggaagtagaaaacttgctgggtgctgtccaaaacttgttatctatttttggaaagccaacttgtcagaaaatcagaatatgaggctccagatttactatgcaggcatctttagattatgagggatgttcctgtgcttcttggtcttagaacacattatgaaagtcaagatacttctttagaactatgaaagtggactgtggatgaagtgggttttttttgtttgtttgttcgttttttaagaactgtaaacagtgcttgtgatggcctgtggtatgcagctggatgtggaactctttagccggtgagggagagtttctctccagaaagttctcatggtttcagtattcctctacatgcaatcacacgttcaacaagaggcgagataataacaaggagataataacaatctcatgcagatttataaattgattatatcagtgattgtgtttggctgtccattaggccctttgtgaacataacacctgtttcagaaggctagtgataacaaaaatcttttaaaaatgtatttatgtatgcatagattttattttctattttttccacataaatggaatgtatgtctggaggtcatacattgaatacattcaggagagggatagagtttcaagtagcaaaaggatcttcaggatgtcatccaattactttccctggacctggaggctggcaggaggcaatgtggaactgggtcaggtatataggagttccctttctcagtcagtggccaaatactagaattgggttggcagtagctttttaagtctacctgaattttcttccccccagaatatcataaagctgatgtagttccaaggcccctctcaagagttgatgtatggggccaggcagagtagctcatgcctgtaatcccagcactttgggtcaggagttcgagactagcctggccaacatgatgaaaccctgtctctactgaaaatacaaatattagcggggcgtggtggcacatgcctgtaatcccagctactcgggaggctgaggcaggagaatcccttgaacctgggaggcggagattgcagtgagccgagatcgcgccattgcactccagcctgggcaataagagtgaaactccatctcaaaaacagcaacaacaaaaaacaaaacagaacaaaacaaaaacaaatagttgatgtatggaagcaaagggatgtataaaaatcaggaaaaaaatgactttttttccatgaatagttaggtccggtcaaaagactcacaactagcacgaactcctgagaatattcatttttctttgctagttagacatttacaagtgaggtgcagtgagaagactatgtttactatgcatgtaaatattaaaactttattagcagtatgctatcaaaggcatcacgtatacatataaatattaaggaaatgccaaaagcacaaatattaacataggcatgaaatgctatccaatcctagaaagaacatggatgcatgaatgcagaaggcgttcagaaagacttggtaaatatgagccgcattcttccaaccatcatttgttccttcttttgtaactgtggatcacaaaattgataaataaaaaatgtgagtcatctttatatgtttaacactgtggtcaatgctgagggtgggggaagtctataaactgtatagtacattatgtttttcttcaaaaaaatcttgtaatctagacagtgaggcagagcaaacacaatatctaatagtacaagtattgaaggaatcatagtaagaagccaggggagagagacagaaagaaggcctccttatggtagtgaaaaggcagattggttaagaagattaggagggtcagtcaattttaggtggggaaaataacataaaacatcctttagaataagagtgagtaatttgtgtttaatgataatgaaaaggccaatttgaatggacggaaaaaagttatatttaagggacagaaaatatctgcaatagatagaggactagtggacaatgcagacaaattttaggcaagtggatgaagctaaattaccacatgatcgatgactagaaataggacagtgatgtcaaaaaggtcatgtataatttgttacatatgactgttcctttttgtctctctctctctaatatgctttagtttacttatgttagatatataattacattatgtgttatatacaatatctgagtcatatctgagctttctgatatctatttatttatctatttgtctcatgtctatacagcctggtttgcctaagcccctattagtttatgcttattttggggggatatcacgttcatatatatatatatatatatatatatatatatatatatatatatgatttaaaaatactgaaatacttttaaatataaaactatttttgtagagtcaccaaaacgacaattccatttttaagtcaatgcatacatatatttaaaatagacatataccttaattttttagcaccctctttaactatcattagtgttccaaattggatgacatgattgtttagggaatctaaccatgaaggattgatgatctgaatgaaataaataggaatgaaaatggaagagagagaaataaacatttcataaaaagcaatgaaatttaatgaatgactggaagaatataagtgatacaaagaaaattactaatcattcaaattggaataaccagaaaaacagtagaagaactcaaaaagttcggaaagttggaaatgtcgaaaagataaagaacaattatacaaataaacatcttttgaccttgaagccccatgatactcctctgtgacaataatctcaacttgtttctaatgaacacattcaaactcttcgagtttccatatatgcattaatttaattctagtatgaattcttcttaaaatattagtcatgattttgagactgtatatttactgatgcatttatctgaataaccagagactttatgagtgtctgaaatataaatttcttctgcaaatgggaacttacaaagaagttgtttaacaaatgagaatctaaggcctggtgaattaagtgtattactctgaatcacatggataataataatgagtaaccctacacgaactgactagatatcaggcactgtcctaagaaagttatgtattttgactgatttaacctcacaacacaacctatcaacttagtactataatattaccatcctcattttacattggaaagatgaaactcaggttaagaaatatcttagggtcacacagctattagttgaagagttgggaatttaacgcatgtcttcaggctcaaaggttttttatctgctatatcattatttcaatcatgggggaaatcaagaagaaccagttgtgatggctttcagttctagcgtttatgcgcaaaattgcacacatttagggaaattgctttagaaatatttcaggtggagagaacacacatttattttaactacatggatatactcaacacagccaatcaaactgaaataatgcactcacgctcagggatatgcttacaaatcattatttaaaatctctttaaggaagagtaagactgtctttgagattacctaaataacttgttaatattgaaatgtggaaataaaaagaaaaattacaccggaattgtgcttagtaagtattcaagtatctcgaatcaagaaagcttactggaaaaatatatcttgaaagccatttacaacattccagtaattaaaaataaatagcaatttttaaaaagtcatattatgataatgtttaactaaacttctaaaatgcttccataatatcatgaagaaaaacattaaaattatatttataaatatttcacttaataataattgaattttagaatattcaaatactctacttaaagattgttatttagtggaaagaatttaaagactggtattccatttatgttgtggggcagattattattcctgtacattgaattgaaactttaaaggatttacagcttttcaaaataacctgataccacagagaactttacacgtttgataaaacccttgaaaaacaaagttttatgtaaacaaagaattgcattttcttaaactacaatagaatgtattaatataattgtaagcagtgacagatgtaattatatttgattggggaaattaagaggtgtctgtagatctcagcaaacccctcagacagaagtgacaaggggtcatctaggttttagaacagagtacagggacatctgcattcccacttccgcatcttggctggggcagattcgaaatcacgtaggttttaagaagaatggcaacatagcttcattgacaatccaccttatgccatccttaatatcaaatgtctcctagttactgcaacattgtttcatgttttagattaggaaggaagaaagggagggaagggaggggaggggcggggaagggaagggaaggaaatgctcttagaaaaaggaaaaggggtcaaattggccggaggaatgttgattttgaggccaatatatacaatcaaaaataaaacagttttttagacaaataaaggagacatttgccctaattttaaatgcagttacgataacattattccttaaatgtctattattctgaataaattattgttaatattgttttcttttaaattcatgttgtcaattcttactgcttagttaataatttacttttacaagcatttatttatttgttacaattttcaatgtgcatctacacaataaactaaagaagacatatcagaggccatttaaaactcattaatattactttctcacactaatttttattttgccctttctaacttggtagtatgcttaccaaaaattttaaattttatacttcaaaaaaacttaaggcaaaattattccctaacctactctactcactttaatgataaatgactgcagatctccacttgaattggtaaaataattcaaacaaaagtattcaagcatgttgcaaactgatttcatacatttcttgtacttactgatatactgtgtcacatgtatatttaaacctgttaatttagtcattctaaattttcttttacagcagtaagatttaacgtgcttttgaaaatataataactgaataaaacaaaatacgagtgaaaaatacaaagctggaaagacataaagaaataatgcaacgatagtacttaatttttcagataagtcagaatcacaaaagtattaatttttacgaacgaagtagtatttaaaaattagactcaagttcatctggcattcaattcactgctctacctattgaatgtaaggacctgaagtcattttgaatatatcgtattttccaactcccactgaaagtttgcatccccttaatgacctcttaagtgttaattgcacacttattgaatgcctacaatttagggaatttattaatacctgagacagccatcaattttttaagatctcacataagaaagaaacatattatagaaaggcatttatactttagttctcacacattaatcctcatgcttaggctgggttgagggggataagggaggatggggatgggggtctggggagggtgtgaaataggcaggactaaagggtaagtcatgtagagaacttaattctcctttcacataatagtgtttcagttattaaaagcacatattatgctccctcgtagatctcatgtctctttacacttttcatttcctctttaatcatgtttcaaatcctccttgtgatttccaaggtgtgacattcagtgctgaagcaagacccacaaatgattagatcactgtgggactcagctgaacattcacagactctttctagaaaagtcggagtcaacattttaatgcttcaaatccacgtgggcagggattttgtttgcgttctgttggcttgcttgcttagttgttcgtttgtttgtttgttgtaaagaggagtagctcaaagccaatctgattctgataaatggccaaggtagagaattcctggcccaaacactgtttcttttttttttattattattttaatcctaagattgcaattttaatagttacagaattcttcacactcaggctaagtttatatataaacatgccaagtttacctttgacatgttcacatggactacttctaaacaaaatcttcaatatctgaataagaatatgtgatttttataatttagctaggatctaacaattttacactggtaatttttagctgtttatgttatttctaactgcccagatatttgtggttcctgattatgttttccagtattttcactattttctcagctctgcattttgtggaaatatttcctgtatattcgtttaaatctgataaataggttaacagacaagaacataaaaaagagtcctgcagaattcaaaagaaaattccctccagagtgacataacatttaggcatggttattcaatcaatttctaatctgtcctgtgagtaacaccagagaccttgcctagtgtcatactgactttaaaagcactttagactgcgtttgatgcactgctgtgccagtacaatgatttaccatcttacactgaggctgataattcctagcaccattttacaaaataaatttggcatagagttaaatatcatatgaaagtttttcatgtgatacataatcaaaagcttacttcaaagcatactttaaaatagattaggaaaattgttgcttttatgagattaaatgtcttaaacaatttgaatctcagtatttcaacaaacacattattaagcaacaacgcaggtatatatatatatttaaagacatacttctaatacacaatccacttcattgttagcatgataatagtttcctggaagcaataaaatccacaagattcttaccaaaaaggctgggaaccttggttgattgcggagtcagggagttattcacagcattgagctgggttccataattatccacctggaaaccattcgctggaaaaaaatacagccaattaaaatagataaacattgtcacaatctcatatttggactcatgaagcgtacaacagttaaaaaagcagacttctggcaatttcattcacattgctatgttaaattagcaaacagtgaatctttaaatataattgtaaggtaatatttccatgagtaactgtagttcttggtcaaaaaagcgtagcagttaatgtttaagtcatccctttaataaatgttataggcagataaaactgagtgactttaggtggtggttttcagtaactgtttgctctcatatttgtataaatgtgaaagatttcagcaattctattgtgccaaaattgtactgcagtattctcaggaagaagaattaaataatgcaacataaaaagtattagatctatgaaaataatttcttaattttctgtgctttttaaaaaactacagtcacaaatctcacattgaatgcacacaaatatatcttcatttgcatggctcaaacaaaacctgagtatagaatgccatctgagatgccttagttttaaaaggatgcctataaatgaactaaaatgaaataagaaataaacttacgaccatcttcacaaatgttcttgcattcttccagtgtctcaaaattgttcatattgcccaggcatccaccatacttgaaacgttcacactgttttgtctgattgttataaaaatacctggtaatataacctcgacatattccaggatcttcttccaaaaagcagaaatctggcttttctagaaattataaaaatgtcagaaagcaatattcttttgtgtaaataaattactgattttaataaaatttataaatacctggctaagttattgaaggagtaagcataaaaattaaaaagtaaaaatctaactttatccataaatatacactattaaaattatctaccatattttgggattggcatttcaaattctaaatttctcatagtaaattaatagggaattaactgtcatttttttacaaatttaaggaataaaagattattttaccatgtaccactcttgctttgaaattacaaaacattatggcaaaaatgtggtttaattatttttaatatgttcatgtgtattaacatttagggaaggtctatgaacatttcaagctattgagggtggcttctcaggaaaagcattgtagtgcgttgctccattaagaatggtttaaatttttaaaagttgaaaaagaatatttgaggggtaggaagttttcatggctagccttagaagttcctgaattcttatgcgggaattaatatctgtactaggtaggacatcctttactgctgtgtcatttttattttttccttcttcttgtcattggaatgacttcaataatgcagaggcagaaaggaaatacatgttcaaggattggagaggcttttgcaaaagactaatacttcttctttgatagtgctccaaagcaggctaaacacagctgtcataaaagttgtgccactgtgatctacatcaccagctctgtctacatgcatgcactgtgaaaagaagtgagctaattttcaaaattattatgctcacaggcgtattgggcttgaatttttagaacaaaattccaatttctcaatttttttcctgcaagtatattaccatattggcaaaactgaactgtggtaaccttttttcatcttaaagcaacttgttcttctatgtcagggaagcaatacccacaagtattttacaataaaaaagaacatgtatttaataatgttaatgatttctgcaacagttgcagatctgcaaaagaacaaactccttattgaaaagttattttattaagtaaaacttcctactataatatagttttaaaagtctattttctgtaacttttcaatgtattaatttgaaagttaactttgtttcttctgtattgcctcttgatctttcaaatgaatgtttttatgatttttagttaattgtaataatatgtgggggaaaggaataaaacaattctttaaaatgttataacattttataaggtaaaaatacattgaattactatcatatgatttgttttagtcttaatgtgtactttttatgaaattttaaatgatctgaacagaggatacaagaactttatgtttgccaaaagtggatggaggaaaaatattgcatataaaaaacataaaggtataaaaaattatgctgataagtataattaagaaattatacatgtacataaatatatacacctaatatgtacccacaaaaattaaaaataaacaaacaaaaccacaacaaacaataaactgtacaactgaaagttgttatttttcatatgaaactacattgggaaacatgaacttatgtgaagacaaagttgaaaatggacacatgtaaaataattctttttttggcctgcagtttaaactacagttgcaaatcaaaaaattaatttcccattttcttcaggtaaataaattaaccttcttattgaatttgcatacataacccttgctctaagttggtgctcagttgcacttgagtaacacagaatgcagactggataagctaaagcattatcactgtcaacttttgtttgggcctgaatacttgggaattgtcttggaccaaactttctttctaagggattgtattaaatctcaaatctctttataatggtccaatgctaggaagcataatacaaagttcactcgaaattgatcaagtctttgttacaaataggtgttaacatgtaagcatttttaacattcatgtgaacacagctttattctctaactttcatatataatatgagataagaatgattgaattctgaattataaatatacactttatagcataattttacctaaaaatagtacctgtatttaatttttctctaattttatgtttttggtaaaaggtcctaatatttaaaggttggtattttctttcacaaaaatatttattctcctttgtagacaaaaacttctttattataaatatgccattttgatattacagataaggccttcatttaattaaagtactaaacattttggtcaagattattttaatatttataggaatctattttttaaaattgtaagtacatttagttatgtttcttgtacaaactttgctattatctttattttatacattttgattccaattctggtcagtgaattgagcctaaagattatcaatgtgtcacagaaattttcaactctttcccacataaataaatcaaaataaataaaattaaaatgcactttgaattttgtggtctttcatgttgcggtctttcatgtcctgagttaaacaatttaatctctttgttcaatattttctcattgaaatgtaaatgccataactgacaattggaccaaatcagtttccaggcctttattaaaaggacgttggtttccctgatccattgataacattttttcttgtgctgatatatttgtgaaaaagtaattatttttagctaaaaacaataaatgatatgatttaaattacacaattaaacatacacatacatgctagatatttatttttaaatatctctacttacttttgcatgtataactgctgacaactcagagacatacatccattcaagggaatatttggtgaaacttgctaaagccacacaatgttgattagattaacaagtgattagagatcagagaaataaagttaagactcaaaatatctaaatctctatctggaaggtgttaaaatagcatgtgtggctctggactatgattgaactaaaactaaatatcatactacattagaattagagtaaatacggtgtttggagcctcctctgacaaatataatgtatatattttcctaatttttgattatgtccattgaatcatgcaacaaatcatttcaaaaatgacatgatcaatctgtcatatgggtttatgatcaatctcttttatggatttttttaaatcaatctcagagaaacttaagaattgaatatctatactgaatcagggaccagaaaaaacaaacaagcaaacaaacaaaaaattgaatatctaaatgccttacataaatgcttcaaatttacagacaaataaatgttcaccttgttgcaatgttgtctttataatcctgtttgcattatctgtaatcaaaagaatatatgcatatcaattgtcacaatttataaagtaatactatgaatttgaatttaacaaacaagagtgacatatttattaccattaaaattattcttatacagaatgtcttaataaaaattgaatttctttttcttttctctaaaaattaatcttttctatttattgtaaccatgaagccacttcatttcaatagagtaatgttttagaaactatgataaaactttctaacacacttacaaagctgagaattcatagtgactatgtttactgttcaggatatctatacttaaaacaattattttaaaaatgtgaaatatgaaagtaattcaagcagcctacattacatataaaaataatttgttagataactgggaataaaagtgaaattaaccagaattatttcctttccttattctttcccctgcttcgttgtctcaatccaattgcaagtttcattattattaccaatgtagagaagaaatgaaacaaaaggcatctgggacacgttgtttggtttaacatttgattaacggaatcatttccctctaaaactggaatgttagttgtctttgtcctaccatattccaagtatgaattctaagttctaatttaaatgataggtaatgaaatttaaattgacaaaataaatctatgaagttttaatttgctcgcatagacattaggaaagttgagtggtatttattttgttgtggaattatttgttttgcagagaaaatctttggtcaaagcaggttagcattcgttatatgaccagagagatagaaagggagcgagagagagaagggaagaaagaatgagagaaataatatgaattgggttataagcctctttcagcaactgcatcatcctttttttcttgaaatagttaattcttctatggagagtaaaatgtctatgaaagtgaaactaacggacccaaacttcttttctaattgtactatgttttattcaatagccttttaaaaaaagaggtgtgtgtgtgtgtgtatatgtatagctgtatctattgaggtaagttttttggtttactttgttttcactgcaactaaccaacttcatattaatgttttcaactagattgtagactgtcatataacctgacattaaaatatttagatataaaactaatatgatttaattgataagaagaaagaaatgtatacatataatgagtacataagactagaacactaagcaattttcattcctgatttacctattgacaatagtcataagatgggaatatataaatgcttgattaatacaatttttaaaagaacatctattttgtttgtttactgttacattgtaaataggattaattcaggtaatatacatgccaattaactcaatgtggtttagcacactagaattttaagtgtatttatattaccaataattgtctttgaggactaataataataaccttggacacgataatttgtatggcaatagcagtatgaaagcgattaatagttagaaaagatttacagcaaattatcaagttttcttagatttagacaggacgaagcatttatcaatgctttttaaggagcaatgagagaatgttagactaatttccattctagtactcttttgaatttcaatttatatgaatttgttttaatatttcattatgaatattaagatgtaagactgacaagcaaaaatatcccaaaatttgcatttggttgacacacattggcatatgatatttatacctcaaactgacttatttatttttgcttctaaatccattcaaaagtgtgccagatgtaaataatgatattttcttctgggtgtgcaaggagagtgttagataaataccaattgtgtgaagttggtagagagtgttgttcaaatcttttatatccttagtgattgttgtttactttttctgtcagttactgaaaaaaggtgtcttgaagtatgtaaactgaactgaataattgtatactctcacttctgccaactttttctttaaaaattttggagttttgtaattaggaccatgcacataggaattaaggattgttgtgtcttttttattaatggacccccattataaatatctttctttccaccaggtagtattttttatcctgtagtctacttttactaatcattcttatgattagtgcttacatattatatctttttctatcctttcacttttaatctctctgtccttatttttaaagggcctttcctatagacaacatgtagttagttcttgatttatttttgcatacagagtgataatatctaccttttaactggcgtgactggaccattaaattttaatttaatctaattatcattaaagttgagtataaatatcactagcaatttgatttctgtttctcatttcttctttgtttctgtttccctctgttcatgtcttctttagaattactgtaattgaatattttaataataatttcatcttcattatgggcctatttgttatttctgcttgtttcatttttttaatggttgctttaaggattataatgtactaatccattacagtctagtgccaagtaatgtatgtcattgtcacctgtagaaacctcagaactttacaacaataatctcatatttttctccttccttcctgtgtgctttaattctaaatcctttaatactaattgtactgctgctctaccaggaataaatttccccagataatgctgatttgaaaagcccttattttaagaagtagattactgattggcactttttttctctttcagttctttgttttttctttttaaaaatttatttcttttttattttcatagatttaggggctagaagtacgattttgttatgtggttatattgcatagtggtgaagtggattttagtgtaaccataacccaaatagtgtccattgtacccattagatagtttctcattccccagttccctttcatcctcccatcttcctgagtgtccattgtctattattctactatgcccacatgtatgcactatttaccccccacttataaattagaacatgtggtatttgaatttctgtttctgagttatttcacttaagataatagcctccagttccatccatgctgctataaaagacatgattttatttttaatggctgagtagtactccatggagtatatgtgtatatataaatatcacattttatttacccaatcatctgttaatagacacttacgttgattttatatctttgctactgtaaatagtgctgtgctaaacatacaagtacagttatctttctgatataatgatgtatttgcttttgggtagacagccagtagtgggattgctggaacaaatggtagttctattttttaggtctttgggaaatctccatactgttttccatacaggttatactaatttacatttccagcaacaatttataagcattcttttttctcctaatcttcaacatctgttattttttgactttttaatagtagccattctgactggtataatatggtatctcattgtggttttaatttgcatttgtctgatgattagtgattttcagcattttttcatatgcttgttggttgtgtatatgtttcttttgaaaaataccttttcatgtcctttgtccattttttaaatggtttgttattttcttgttgaattgtttgagttacatgtacattttagatattagtcttttgtccaatacacagtttgcaaatatttttctcattccttaggttatctgttcactctgatacttctttggctgtgcagaacatttttaatttaagttacttgtggatcaacttcaatttaactctcatttggctatttttgtttctcttgcatttgcttttgaggatttagtcataaattctttgcctaggtcaatatgtaggagggtttttcccagattttcctctagaattattatagtttcaggttttacatttaagtcattaatctattttgagttcatttttgtataaggcaagagacattattccagttttattcttctgcatatgattatccaatttctcaacaccatttattgaatagagtgcccattcaccactgtgtgtttttgttgattttgtcaaagaacagttggctgtaaataagtgttacaaccaggagggaggctgtaccctgcaaagtcacaagggcagagctgcccaagaccatgggagcccacctcttgcatcagcgtgacctggatatgagacatggagtcaaaggagatcattttggagctttaggatttgactgccctgctggattttggacttccatggggcctgtagaccctttgttttggccagtttctcccatttggaacagctgtatttacccaatgcctgtacccccattgtatctaggaagtaactaacttgcttttgattttacaagctcctaggcagaagggacttgccttgtctcagatgagacattggactgtggacttctgagttaatgctgaaatgagttaagaatttgggggactattgggaaggcatgatcagttttgaaatgtgcaagtgcatggtgcaagctgtcaatggatctaccattctgtggcctggagtatggtggctttcttctcacagctccactaggcagtgccccagtagggaatctgtgtcgggggtctgactctacatttcccttctgcactgctctagcagaggttctccatgagagccccacccatgcagcaaacttttatctgcgcatccaggcatttccatacatcttctgaaatctagatgtaggttcccaaacctcaattcttgacttcggtatactctcaggctcaataccatgtggaagttgccaaggctcgaggcttgcaccctctgaagctctggccctagctctacgttgacccctttcaatcatggctggagtggctgggacacagggcacgaagtccctagactgcacacagcatgaggaccctgggccgggtccaggaaaccactttttcctcctaagcctccaggcctgtgatgggaagagctggcacaaatgtctcacatgccctagagatattttccccattttcctggtgattaacattcagatccttgttacttatgcaaatttctgcagctggcttgaatttttcctcagagaatgtaattttcttttcacttgcattgtcaagctgcaaattttccatacttttatgctctgtttctcttttgaaactgaatgcctttaacagcacctaaaccccccttgaatgctttggtgcttagaaatttattctgtcaattactctacatcatttcttcaagttcaacattccacgaatctctagggcaggggcaaaatgctgccagtctctttgctaaaacataatgagagtcagctttgctcaacttcccaaaaagttcctcatctctatctgagaccacctcaggctggaccttatcgttcatatcactatcagcatttttgtcaaagcctttcaacaagtctcttggaagttccaaactttccaacattttcctgtcttcttctgagccctccaaactgttgcaacctctgcctgttacccagttccaaagtcacttccacattttcaggtatctttccagcaacaccccattctactggtaccaatttactgtgagcaagtcacatcttacatggatagcggcaggcaaagagagagcttatgcagagaaactcctgtttgttaaaaccataagatcatgtgagacccattcactaccacgataatagcatgggaaagaccaccttcccccccgccccatcccccatgattcaatcatttcccaccagtccctcccacaacatatgggaattatgggagctacaagatgatatttgggtagggacacagagtgaaaccatataacacacattgttagaaaaaccacaaccacttctgctttctaatctctaatagccatctcctcttttcagagagaccaccatgctgtacttgggtttctttcatgtaatggtggttctgaatgccttcacacaggaagcaggggagactgcagggctcatcttatgtatttaccttctcccagaggtcacaatcctgcactgccttttgttcaatgcttgcaaacagtagttttttacattttgtccagttttatagttctttatgttggggagagaaagtcttgttctatttatccatcatggctgccgattaaattctctccttaggtgcgtttttaaaagtctagccatattttttccatataccagttatatccttatcagtagtctgctgtataaaacactcagacattcatacaataattgcaagtgacttttctttttttttcatggagtcttcctctgttgcacagctagagtgcagtggtgcaatcttggctcactgcaacgtctggctcctggttttaagcaattctcctgtctcagcctcctgagtagctgggactacaggcacatgccaccatacccagctaatttttgtatttttagtagggacggagtttcaccatattggtgaggctggtctaaaattcctgaccttaggtgatccacccacctcagcctcccaaagtgctgggattacaggtgtgagccactgcacccagcctcaagtgaattttgatagataatgaggagatgggggtaagagagttacatttacatgctagccagaaatgatattttaaatgatgataagcaaggctatcactgatgagcaaaatgattacatttccctaacctttaaagaaaagagtaagttttgcacaatgataaaccataagacttgaactatacacatatataaaaagaacaggtatatatttcaggaaagaggccagttgatgaaaataaatagcctgctaaatgaaagagtggggattacaaagaatgaggcaaccaggcttctagccaaggtactgacaactaagaatgattttcaactcaacacaaaaggatacttggcccaatatgtatggaagaaaatggggtatagaaatctgtgatgaatgggaaaagaccaagcaatcacaaaaaccaaaagcaccactgaggaccactgagctgcctaaactgtgttagtaacattcctagggcatctatggagaggaaacagagaaatcagtgctgtgaggttaaagaaatatattcgtgtctattctcttctttcagcttgggagcatacaactaaacatcttacagagccacagaggagagaagttcactcttttcaccacatggaagttttcccacaggccaagagcaccatgatgccaaggctgtttagtaaaagctatttagaaagcagtaacagagtgagaatgcagagctgcctgatttgcaaaaaacaagacatctagtgttactaaccagagatatcatttctgtatcacctcaattgtatccaaccagctctacgaacatgctatggtagaatattggtctagaaactagggaaataaaagcaactcaacttattctatcccttgagtaacttacaatttggaagaatagcctgacattaaaaaaaaaacattcaaaattttggtcagtaattatttgtaatttatcttagtgagaagatataaaatcccatacaataaagtaattagcaaaatttgcaaaaatgttaaattttagtaggattaatgcagagtaaaagtttaatataatatgacgtacttttgaaatttataacttagtaatattaatataaaacattgggtttagtaaagtccacaagggtcatcagggatgatttttcttttctatggtattctatttttatttcctgtagtattttaaggttccaataataaaaaaatcttaaatttcatatatagttctactattttatgcagcttacaattttgtaattaagagccatagagcttcaatttccagattcatgatcttgagagagtatagcgatgagaccattgtgttgacaaaggaaagactaagtcaatgtgactaacagtttttcttctgccaactgagattacaagtctgggaggccgaattacacccactttattttaaaaatacttcacaattctttgaacatgagttgaggtttttttcttctgtctttattatggataagagtataagacaataaatggggcctcatattttataattcactgatatgaagaaaatgaaaaatgatagttgaacatgcaagttgaccgtacctaaaatttgataatttgctttaaaatgtctctcgggcatatagagagtttctggtacctataaatgtgggtatttcatggtacaattcagaattatcattttccttaaatgtttttaggattccctgaaagtctaaaaatgtggaaataaaagattccttggaaatattaaaacagcatgaaattacttttctccctaaattatcaaatccataattagactcaatagccctaaagggtcttgagtaataagggttcccagaaacctacctcttgtacacatttttttgcactcttccagactttcaaatcgattctgatttccttcacatcccccatatataaattcttcgcactgtcgagtgaaaatattgaagaaaaatcttttcatgattgctttacatgggccatcatccgccttgaatgcacaaaatgaatgcataagtttcagtggtggcaactccgtatctataaagtaaaaataaaagatataacatgtaatctccatcaacactgtaataatgttctttatttcctttttaatatgtcctgattttaaggaaaagtacaataaaacatactaagaaactataaaaagttattcagttatcaaaatggtagataaagttaataaattcaccaaatgaaacacaacttctagactcttgttagggaggtattgcttaaatcgtaccaaccgaactgggagggaattgagtagtagttgtaaggcaacttcattcaagtggatgtgtccacaatagacctcttttaactcagctaatggacagttctttgaatttctctccctaacccacacttgtgtcactttttacacataaaacaaccctttaaaagcaacagcatattcacattcacatatatatatacacacacatatgtatataacactatattaaaccattttccctaattataaaaatttatgtgtttgatgttctgaaaaatatacttcatggtgctttttattttaacttaccataccatgcttgggttttaataatgttgaaataatgtaaataatgctttctatgttttaaatagaatgaggcaattcttttgacttcacgttatatattttttctttaaatatttaactcctaattttcataacagaattttctatcctgggaatggacatagaaataggggaaactcaactagattttttaaacattttatttttttcaagtccaataaaattaatagaagcctaatgttaagtaaagtctatttgtttaccagtaaagatagacactgaaaattgtgggtggtgcaaccaaaagaataatgacaaaaatgccatataatacttcttgaatattttctgcatattgagtctatgtattttctatgtctttggcaattgatttattaatctcttatggggaatattgaaacctataaatgaccgaaaccaattttgcctctagagggcagcagtattatattgaattaaacagatgagtataaatatcttgaaaaaaagtgttttcatgcattctaaaatagtttactttgaacaacaacaaaaaaagaatgagactttaatattttcacataaaatatttttaaagcataaaatacaggataagtttttggagtatgattgtctcaaaagaaatcagttttaaatttcctgtaatttcaaaatgtgaattttttgaaacagaaaatatgtgtgtaataaaagttaaattagataattttattaattgcactccacccataatatattattattctaataatcaattttgaattaatagcaagtattagtcttattttagtaatgttaaaactttttgtaacaaaatgattgaaatgatattgttaattttttatatgagtcataaaattgtaagtagcctttacaatcttggaaggattaaagatacagctttctatacataagttggcattttcatgctgtttgattcatgtgacactaattatttttgaacacgtaaattttatctcaactactaacactgctttcaatttttaaaaatactagttaaatttacataataccatctcattattttgatctatttgataagttaattgattatttttttcaattgaaataaattgagctgacagaactgatagaagagtatgtttttcaggtccagaatttgttaacttagaataacatatgacagagaattattatgatacggggatagtttcagcaccaaacacaattgtcataaaatagctaattagcaagtaagaatgttgatcaaatctttaactaaagttgagttttatgcacatatgcatttgtgtgtcttcaaatttttctggagttatattcaattgacaaaatataatgtttgtgtttaccaacatgatttttaaaataattttaaaccaataacagtgtcactaaatccaataaatatctatagtatatatacaaataattgtatcaaagtgagttaagaaatattggtgaacattgacaagtttaaatgtcatttcttttttttttcaaatcctttatctaacatttcatgttgatgaacatatctaaaatacgataatttgctttagaaggtctctcaggcatatagagagtttctggtacctataaatatgagcacttcatggtaaaattttccatttttcttaaattagatacacaagtactttttaatagaaattcataacaaatataattgaggattgctaaaaatactttctaaaaatcgaaaaatgtatgaaccaaaatgacttgttaaaacacattttctctatcactgaagttataattgtcagttttaaaaatcattgaatttttttttctgagtggcacatttatgaataattgtaaatgctgtttatatctttttgtctttacttaaggattttagaatgccaagctgacattttgagtttttatgagaaaccagaaaatttggtgtgaagaccctaagtggtgtgtctgacttacagcaggcccacagtaagtatcatcaaattacgtatcgtgagtttctgaactctagacatgtttgttttgaaaccaataaaaatgtgacctatcagctccttaaatatgggaccccagaattcacataacaaagcaggaataaaaatattctggcatttttaattttacagctatataccattatctcaaattgctgtagaaattctcatataatgtgatgttattcattcccaagttaacatgactttagaactttagagacaagttattgaggtagtgtttcagatagaaaacttgaataaagatctgtatctgcagaacacagggaactttacctaatacctgcattgccatgtatattcagaaaaatcatttttcataaatcaataattttatcagatactaattgatgatttttctactttttattcttaatatatttgatagtatttattatcaagctaaatcttttttccattttctgcattaaagatataatcacctctagttcaatctgctattgagtaattttgccagcaggtggtggcagtgcaccacaaaggcaaaagctgataaactcgctgtagtagttgtacctagcaacaatagctaatgttgctcactgagtaattacaatacccttgacatttttgtaattgtaccctttaatgatcataaccacctactgagttaggcattattatcttcattttataaattataaaatagctttcagaaattaagtaaataacttaaattcataccataaatgatgggtttaaaattgatcctcatatggttttacaacagctatctcacacattcttaataactacatgatattgtcacagacatgtgactgagattcctaaagtagcatttggatcaagcatacggttttaattatataatttccactcaatcaacaacattttttttcaaacattcacctttatgaaactaaaaatggtttcaataatggaagtaggtgataattttatagaaattttctaggagaaacactaagtattaacttttatgaattatattttgttaattattaggtgattatttgtctttattcacactttaatgtatttcttatagaaatcctgtattagaatattctttgtgcagtgatcttgcagcccacacctaagcacagcatccctggactcaagcaatggccaggtgtgctgtgtgacccacagtgccatgccacttcacccaaaagggatggaaatctgcctcggttttcatttcttattttgaataaacccttttgaatgttaataattgggtattgaccatgcgtcaagcactgtgctgtcactacagatatgacagtaaattagatgacagcaacccctcgttcatggagcatatagacactaaggacttacataaacattcagaaagtcctgggtgctgtgcgagtgaacagtaggatacctaaattagcctgaaggggtcagcgataactttcctgagacttgaaattgagacttgaaggaaatgtttacagaggtaataattatctgccagcggccatgagaaagcaaaacacatagagggcaatctaaaaggaatttaatctgatccagtcatataaatagaattatggtttatattgaatcatttgcctttgatgtcatgaattttatgtctcatagtctaaaggttacaatcctgccttccccttccctccccccgccccatgtcctgggatgttggatagaagcttactataatatttgctgcctgaaaacatatcatgcccttgactgtaagaatactcatcctcttggaacttatttgcaaatctagggctttcaggtaacttaccatctaagaatccacatgctgctagactctaattaaaggattttattttattttattttattttctggcagggaagaacaaacacatgtaccttttgccttctctgtgtcagaaaatgtgccagatgcttttccactttttatataaaaatcataggaaattagttatttacattattcatttacagcttaggacactggtagtcagaaagtttaacttattcagtctcacaaaggtactaggtggcaaactacacctgcaaactcaggtctgtctgattctaaatcctacaaaagatacttgcctttcactaaatgttcactcttaattttctctctcctagcccaatggaattgttttaaaaagcttatcactactctttttattatcatttttgccttatctagacgttaattctagattatcctccctgctgatttgactgttaaaaaaatcatctactatttgcttgtgagagaagcaataaaatttgatgtatttttctattaataagagtaccttatttcaattaaataatatacttctataaaatgatgttatgatcttagcatcatgtgataaattgtatctcctaaatagaattttttcagatgtgagataaggttattataaaaattaattttaaacaaaaacaaaataaaactagataaaactgcaactagttggtgaagaggtctttaagtctagcttaaatatcaaaattctttgttaccacctaggtttggaagctaccttatagtaattttaaattctggcttaattactgataacttaattctggattattgattgacagtggcagcagccacaatttcaggaacttcctggttaaccaatattcattttctcagtccagttgaggaaaattggactgggacaaatacagggaacacttggatctatttgcttctcacttcccacaagtgagattgcctgttttttccctgttaagacttattttatcctccaccttccttgtttctgtaacctccagaatgttagaattttaacccaccaccttttgagaaaaaagccgaatgagggattgaaactcataatgttcaaattcttattttcaaaaaggtacattagggtttttactaaataatgcttcatctctaggaaatttttataacatgacttccccttgtggagccctcagagagccaagcttgattgaatctccttcctcttcccatcaacagcagcactctccatgcttctgtcactttgtgtactactttatacggaaataaactgtccacccttcacactcccctaggaaacagtgagattcttgagcacctcatctcagccatacctgtttctctagcaccttccacagattcaggcccagaagatgtatttattcaaactttattaaagtacactgaacacagtcattttaaaaagctattaaagctatcaaataagaatgcatttatggaaatcttttttacatcttaaaccactatacaaaaataagctatcattttgttaatattctctcattaataccaatgcttgagatttctgtcaacaatttactaatttgccacaaaatgttactttaagaaaggtatatatccacaataaccatcaccatacagtcttctccttgctctattttttattgttaatattctcatttttagacacagagttttatgggattagatctaacttatattactagatcctttggtgtcctggttgactagatttttatattagtctcaactgggaagttttgattttggaaatatggggaagaaagagagaatagctgaaacctcagatgtctgaagttccctttcctcctcacacttttcctagccaaagggtagcatcaaatgtcatagggagttgtttttacaacattttgctccttgcaatagcccggagctactccagtgtttaatattgtatgctgaaaaaaaagagagaagtgtttcagctaaagttacttggtttcggactgtttaaaacacacatgtgcatgtacacacacacacacacacacacacacacacacacacacatacattaggtataataaatttccaaagaaaaatatcacttcaataacaactaatttccctccacaatggaaaactatggtagattttttagattaaaattgagagctttaactagcttaaaaagataattgcttctaatattttacctgtgataattgtgtgttcttcatcttcctcagaatcagcattaagaggggcaggggcaagattaagcagcaggcatacagaagcccaaagtgcatgtactttcttcattgtgtaaatcatctctgaaatacagaacccatacatatctaataaataaagtgttaatatgcactcatttacagactagtaaacatcatatgtgtacctcatatgcaaatttctatgccattttatgtgtatacacatacatttctctgtgcatactcaatgagtcatacttaaaatgtatatgtagtattcagaattatgggcaaacacattcagtgcatatatttattaatattcaagcaaacaggtcatatttcaactttgaaaatataaataaaaaggacagtaattgagagacatgggtaaacgctgatcaatatggcgaagtatgtattaaagtccatttccatgtgcaattttactttccacatctttcgcacagctattctttctcagtcagaaccaataattatttaggcatttttctattatttctttaatgcaacttttaattcctgatttatctttccctctgctctagttcttcttttaaaaaggaaacacattttcagaattttcatctttgtttcctttaaaaaatacattatttacatcaatttcctaaccaggttttctgtgagatagcagacagccaaaacagaggacaaaagaagtgtctgacattcgagttagtcctctttcccagttcattattccgcagtttagggagttatctgattcaaaaagtttcacagaaaagtgactctaagtgataagccatcactcttacactctaaaggaatcagatttcaataggagagtgagacttttcctgtttcaacgttgtttaaagatctatcgccaaaaaggaaaaaaaaaaaaaagaaaagaaagaagtaagtcacctttatttttttaaagacgacttcttctttggatttaaaggtggaaggaaaagtgtaatgatcatgcaacacagaaaaataaaagaagagaacacttgcttccttcctgttctcagccaccagtgcccttccagtcaggaaggaaagcgagatcttatcagcaaacattcacaaatgcagggacagatactccatcaaaaacaatctagagaattatctggttttgtctgtagcagatcacagctgcaatatacaccattgtgggtagccatataataattaagtaataaatgttattatgctttaagtttcattaaaatcactagtgagatacataacctttttttctcacaacactttgcaagtgttaacatacatttgatttttagtcagtagagatctcatatatcttgtaaatcataccataaaccatttgaattcacaaatatatatatatatttatatagatacatgattttgaagaatcttgaaactaaacttctaatccttatcgcatttttgaacacgtttttcagagattcatttatttccatttgattctttgaaatatactatcctgctatactttgagtataaaatacagagtgtactctgcatcacacagttcaggaagcaggctgaggttgggggcctgctgaagcccttgagagagagggctctaaattcagcaagttcctgtcttaaaaaatggcagcctagggtattgcctaaacttagtactttagactttcgttgggtgctaggattagaaaccagctctgacaaatttggatcatcagtttatttattctagaatatgtggaacaatctgagatgacaagggcaggcttgcattagttctcagaaacagctagagctggtgagctgagcaccaccaggtatttctcattgtggctacactccttagacagctttattttctctcagtgtgacccaatcttctctgcatagcatgatgcatgaacaatgaactgtcctgggttttaaaccttaagagtttttcaatcaaaatagtgtgactacttctctttatggtccaggcttaaatagcttgagactagctctgatagttttagcatgaaacaagggacaccttttggaccaatccatttgagttgggaattgtaggagaccatcatagatttggtggacccaaaaccagtctggggtcaggaataagaaaatgtaatagcatggcaaatattaatggaaccatatggtttgggtggtggaaacggacaagtgtaactcccagaaggaggaaattgttgctttcagaagggaagggtgttagacagataaatgactatatgactatatgactatataccacagcaagccatagctaaatagtagcgtatgtaattttttttttaaaaaaaagaaaagcaaaaggcaaataaagtacatgaattgcaggaggaatcaaatatctaaatttttactcaaaaatgctgtctggttctgggtgataacagatttaatgtagggatgaatccatgcaccaacttctatataccatgcaaaatctttttccttttggaaaaatccagctttcttaaaattagaaaacagagatttataaaacaccatttgcagatctcctccccccatagttcagcagagaatttgctgtaaacatctgcttgataagcccataatcctggctttctaatagaaacatcttcttttaaaaaaattgaccccattatttaaaatagttttagatttaaaaaaaaatagagaagaatgtacagagacttctcatacacctcacacccagtttccctattaacatgttacgttagtatggtgcacttatcgttaatataccaaaattgatacattgttactaactaaagtccatatgttaatcaaatatccttatcttttccccagcacgtttctgttctagcaacccatccagaataccaaattgctctagttgtcatctctccttaagttcccttggctgtgacagtttctcagatttttcttatttttgatgatcttgacagttttgaataatactggtcaggtattttgcagggtatccccttaatagaatttatctgatgtttttactcataattagaccagggttatggggtttgggaaagaagataacagagttaaagtgccatttttgtcacattatgacaaggatacatactaccaacataatttatgactgctgatattgatcttaaacacctgactggggtaatgattgttagatttctccactatgaagttactttctacccctacctttccatactgtttatttatttatttttttatactttaagttctgggatatatgtgcagaacatgcaggtttgttacataggtatgcacatggcatgttggtttgctgcacccatcaacccatcatctacattaggtatttctcctaatgctatccctcccctagcctcccaccccctgacagaccccggtatgtgatgttcccttccctgtgtccatgtgttatcattgctcaacttccacttatgagtgagaacatgtggtgtttggttttctgttcctgtgttagtttgctgagaatgatggtttccagcttcatccatgtctctgcaaaggacatgaacacatccttttttatgtctgcatagtattccatggtgtatatgtgccacattttctttatacagtctatcattgataggcatttgggtgggttccaagtcttttccattgtgaatagtgccgtgacaaacgtgtgaaagcgtctttatgtagaatgatttatactgggtcaaacggtatttctggttctagatccttgaggaattgccacaccaccttccacaatggttgaactaatttacactcccaacaacagtataaaagagtttttatttctccagcatctgttatttcctgactttttaatgatcaccattctaactgaccagtgatgatgggctttttttcatatgtttgttggctgagtaaatgtcttcttttgagaagtgcctgttaatatccttcgtccactttttgatgggattgtttttttcttgtacatttgtttaagttctttgtagatcctagatattagccttctgtcagatggatatattgcaaaaattttctcccattctgtaggttgcctgttcactctgatgattgtttcttttgctttgcagaaactctttagtttaattagatcccatttgtcaattttggcttttgttgccattgcttttggtgttttagtcatgaagtctttgcccatacctatgtcctgaatggtattgcctgggttttcttctagggtttttatggttttaggtcttatgtttaagtctttaatccatcttgagttaatttttgcattaggtgtaaagaagaggtccagtttctgttttctgcacatggctagtcagttttcccaacatgatttattaaataggaaatcctttccccattgcttatatttgtcaggtttgtcaaagatcagatgattttagatgtgtgctgttatttctgaggcctctgttctgttccattggtctatatatctgttttgctacctgtaccatgctgttttggttactgtagcctcatagtatagttggaagtcaggtagcgtgatgcctccagctttgctctttttgcttaggattgccttggctatatgggctgttttttggttccatgtgaagtttaaagtagtttgttttttctaattttgtgaagaaagtcaatggtagcttaattgggatagcattgaatctataaattgggcagtatggccatttttcaatattgattcttcctatccatgagcatgaaatgtttttccatttgtttgtgtcctcttttatttccttgagcagttgtttctagatctccttgaagaggtccctcacatcccttgtgagttttattcctaggtattttattctctttgtcgcaattgtgaatgggagttcactcatgattttgctctctgtttgtctgttattggtgtataggaatgcttgtgatttttgtatcctgagactttgctgaagttgcttatcagcttaaggagatttggggctgagaagactggttttttaaatataaaatcatgtcatctgcaaacagagacaatttgacttcctctcttcctatttgaataaactttatttctttctcttgcctgagtgccccggccagaacttccaatactatgttgagtaagagcggtgagagagggcatctttgtcttgtactggctttcaaagggaatgcttccaggttttgcccattccatatgatattggctgtgagtttgtcataaatagttattattattttgagatacgttccatcaatacctagtttattgagaatttttagcatgaagaggtgttgaattttatcgagggacttttctgcatctatcgagatactcatgaggtttttgtcattggttctctttatgtgatagattaagtttattgatttgtgtatgttgaaccagggttgcatcccagggatgaagccgacttgatcgtggtggataagctttttgaggtactgctggatttggtttgccagtattttcttgaggattttcacattaatgttcatcagggatattggcctgaaatgttcttttttgttgttgtgtgtcttccaggttttggtatcaggatgatgctggcctcataaaatgagttagggaggtgtccctctttttctgttgtttggaatagtttcagaaggaatggtaccatctcctcttcatatctctggtagaattcggctgtgaatctgtctgatcctgggctttttttggttgctaggctattagttactgcctcaatttcagaacttgttattggtctattcagggattcaacttcttcctggtttagacttgggagggtgtatatgtccaggaacttatccatttcttctaaattttctagtttatttgtgtagaggtgtttatagtattctctgatggtagtctatttctgtgggatcagtggtgatatcccctttatcattttttattgtgtctatttgcttcttctcttttttcttcttcattagtctggctagcaatctatctatttgctgatcttttcaaataaccagctcctgtactcattgatttttgaaaggtttttcctgtctctatctccttcagttctgctttgatcttagttgtcagatataaaaagagttcctctttaaaagtttggcttgtttagcgtccttgctctttgttccctactcccaaagccaaactacattccttatcctttatgcctccccgttttagtttcagtaaacaactttcctatcattccttatctacagagcccacatctgctaatcattctgtaaatcacccctcccattgtccaccagtgtaatcacacccctgcccctttcaagttagccaatcaagttcagtgtcgatttgtacagtccaactccagctaacagagactagacacatgtcagagatgataaattcatcttcaaaaagttttagttctgtgttcttcctgttctttgtttctccagtttctatagttaactgtgctataaacaacccttcccaccagtcctaatctataacttacatctgttctgttcccttagttacgcactctacaactattcttcctgctgaaactacttgtcctaccactgtaacccacatccttgctctattcagattagccaatcaaaattagcttcaattatacagtccaactcagtcagtaaaaaaaagacacaacagtaaaagccccttgtgttaaaaataaaaaaccctgcccacccctcttggtgtgctttcaaaatgacaaatgcaaataacacccttctactaagagaggagaccacccctcatattgtcttatgcccaacttctgcctccaaagaaagaagaagtaaaaactaaaaggcagaaatgaaatccacaggcaggcagcccggcgctgtgccctgggcctggtagttaaagatcgacccctgacctaaccagttatgtcatctatagattccagacattgtatggaaaagcactgtgacaatctctgtcctgttctgttccattctgattactggtgcatgcagcccccagtcacgtaccccctgcttgctcaatcaatcacgaccctctcacacagacctccttagagttgtaggcccttaaaagggacaggaattgctcacttggggagctcggcttttgagatgcaagtctgctgaaatttccagctgaataaagctcctcacttctttaacccggtgtctgaggagttttgtctgtggcttgttctgctacatttcttggtaccctgaccaggaagcgaggtgattaacagaggccaaggcagccccttaggcagcttaggcctgccttgtggagcatccctgtggggactccagccagcttgagcgatgcagatcctgagagcgctcctgggtaggcatttgccccagtggaacgcctcctcagagcagtgcacggcaggcccccgcagagggtcaacgcagtggctgaacaccgggaaagaactggcacttgcagtctggacatctgaaacttggtaagactggtctttggaacttgaccactccatttgagtggaagcgtggcctgatcacccacggcgtgtctgtaccagcactttggtttttgtttttgacttgacttggatggcttgatactttggttttggttttgacctggcttggatttcttgatactctgatttggttttgactctggtttggtgtaaactgtgaaagtgtctgtgtgccctttttacttgttctttgttttgcggtgtgcatgtggtgttttgtctcgaggaagcatgggtcaggcacaaagtaagcccaccccaccaggaactatgttgaaaaatttcaagaaaggatttaagggagattatggtgttactctgacaccaggaaaagttagaactttatgtgaaatagactggccagcattagaggtggatttcccatcagaagtaagccttgacgggtccgttgtttcaaaggtatggcacaaggtaacctgtaagccagggcacgcaaaccagttcctgtacatagacacttggttacagctggttttagatccgcctcacagtggttgagagaacagcagcataagcagctgacagaggcaaggaaagaccagcagagagagagagatagaggaaagagacagagagggaaagaggcaaagagagagagaaagtgacaggaagagacagaaagacaaagagggagtcaaggaaagagagagagagagagatatacaagtagttaagaaaaaaaacagtgtaccctattcctttaaaagccaaggtaaatttaaaacctataattgataattaaaggtattatccataaccctataacactccaataacactttcttgttgtcagtgtaaacaagggaataccccaaaagcattgaggccgctgataacccctagacttcctatcaaaaatccttgacccagtaacctgcggatggcccaaatgcattcactctgtagcggcaactgctttgctaacagaagaaagtagaaaaataacttttaggggaaacctcattgtgagcacaccttaccagttcagaagtatcctaagttaaaaaaaaaaaaaaaaaagacaaaaaggtagcttactaacttaaaaatcttaaagtataagggtattctgttagaaaaaaaagaaaaaagatgatttaacattaactactgaaaattcccttaacccagcaggtttcctaacaggggatttaaatcttaattactatacaaaggttcaaccagacctaagaggaactcccttcaggacaggatgatagatggttcctcctgggtaattgaaggaaaaaaaaaaaagccatctataccaattctaagttaatttgaactaaacaagttcttattaatagcaaaggataattgaaatcccaaacttacaaggttttcagcaaaagtaaagtgtgctaaaagttaacagtgtaacatatattatagtaacttctaatcttgtggccttagacagtctagtccacagacataaaggaagtccactttggaaaagaatggttatcatcttcaaaaaaaagggaaaaaaagttggggggggccgcgaaatttatgtaaaaagaatgttatatggtaaattcttatcctgaaataaattaactggttgtttaaagaaagaaatgtttgtaataagtcagaaagttaacgcatgtcaaagaattgtctgtgaaagtcatgaaagagaaaaaaaagttataaaaaagaatttatgcaagaaatgttgtataatttaaaagtaattgggcctcctgaatgtaaaactattgaagaaacagtttatgtgcaaggtgtataaggaaagtaaaatatacctttggtaaagggattataaggaggcataagaatgtggatttttacctacattaaaaggttaaaaaaaagttttcttttgaaggcttaagcaagttttaaaacattaatcataaagaaaattctgtgtgtaaacatattagctaaagttaaagaggtatcatccagtttttctgtgaactaaacattaaaataaaaacacaacgggttttttcttaaatcactaacctgctctttaacaaaaactataaaaggttaaaaagagtctataaaaatcttaccttatggtccaacattaaaaattgaataaatatgtctacgaagttttatgaaaactaagtttaacattaataacacactaatataaaggtgaaatttacttatctggtataaaaatcacacaagaagcattgtctaatttcttaaaaattatatacactttcctttccctcaaaactaaaagtcttttagcacacgtaccacccctagaatttctggtaaaccagctccagcctaaagatcacataagaaggaaaacttgagccatcctgtgaaggagcttaccttgtgctgctaaccgctgagactgctgttcctacaatggaaaggggatggattcatcacacccaagtcaagaaagcaccaccccctccagagtcataggccatagtcccaggggaaaaccctaccaaactaagctaagaaaaatttaactctttcatctattctattactctttcttctttcctcactctattgctgaccatctagttattaacataaccaagtcaattttgcctcaaactattgcatttaatgcttgccttgttataccctgtggggacttaccaagtcaaagacagccctctacttcagaaaagtacctctgaccttcctgactctcctcagactgggcattagtaaattgggaccatttaatccagggagatttccataaagaccccagtgccaactaggagtcttgccccccgatgtagagcttttatgccatagttggtccaacattccgtggaccactacagagcaaggatggacttccccaaccggtttttgtaatttcctaaaaccatatgttcattttactagaggatcatagaagttaaagacttaatacaaactttggcaattaagcaggttaccaagatgcaaatgcctggttggaatggatcaaatattccctccacatgttaaacaaaagcaattgttatgcttgtgcacatggcaggccagaggcccagattgtcccctttccactaaggtggtcctccagtcaaccaggcatgggctgcatggtagctcttttccaggattctacagcctggagtattaagtcatgccaagctctttctgctatatccggaagtcgagcaccctgtgggtcagccctcgagggccatcccgcttccgtcttccaacactaggttcacttcgtgtctctcatgacagggagaaaacttagcattccttggagacctgaagggatgcagtgagcttaagaattttcaagagcttatcaatcagtcagccctggttcatccccaagcagatgtgtggtggtattgtggtggacctttactgggcactctgccaaataactggagtggcatttgtgctttagtccagttggctatccctttcaccctggcatttcatcaaccagagggaggaaaaataagacattgtaaagtgagagaagccccttatgggcctttcaactctcacatctatttagatgcaattggaatccaaaagggaataccagatcaatttaaagcccaaaatcaaatagctgcaggatttgagtcaatattttggtgggtgacagttaataaaaatgtagattggataaactacatctattacaaccaacagcaacgagcttttcatgagttaaaagaaaaactcatgtcggccctagccctggggctacctgaccagacaaaaccttttacactatatgtgtcagacagagaaaaaaaaatggcggttagagttttgacccagaccatggggccctggctggggccagtggcctacctctctaaacaactagatggcgtttctaagagttggcccccatgtttgagggctttggcagcaacagccctgctagcataagaagtggataagctaactcttgggcaaaacctaaagataaaggccccccatactgtggtgactttaataaataccaaaggacatcattggctaaagaatactagactaactagataccaaagcttgctctgtgaaaatccctgcataaccattgaagtttgcaacaccctaaaccccaccaccttgctccccgtatcagagagcccagttaaacataactgtgtagaggtgttggactcagtttattctagcaggcccaacctctgagaccatccttgaacatcagtagactggtagctgcacgtggacgggagcagcttcaccaacccctgcaaagtgactctgaagaagatgacaagcgctgctccagtcacacccagaagctgactggtccacgcacagccgaagcatgaggaaactcatcatgggactcattttccttaaaatttggacttgtacagtaaggacttcaactgacctttcccagactgaggactgttcccagtatatacgtcaagtcactgcggtaggacaaaaggttgctacagttctattattttatggttattataagtgtaccaggactctaaaaggagcttgtttgtttaatgctattctatacaaggtatatagccctggaagtgaccagcctgatgtgtgctataacccatcctttttcctagtgcccataaaaacaggcacacttctaggcttcccagtctgtgcttcccgagaaaagagaagcatagctataggcagctggaaagatgatgagtggccccctgaaaaaaatcatgcagtactatgggcctgccacttaggcacaagacggctagtggggataccaaacccccatttatatgctcaaccgaatcatacagttaaaagctgtcttaaaaataataactaataaaactggtagagctttaactgttttagcccagcaaaaacccagatgagaaatgctatctatcaaaatagactagccctagactacttgctagcagctgaagaagtagtctgtggaaaatttaacctaaacaattgctgtttgcacataaatgatcaagggcaagtagttgaagacatagttaaagatatgacaaaactggcacatgtgcccttgcaagtgtggcatggatttaatcctggggccatggttggaaatggtttccagcactaaaaggatttaaaactcttataataaaaattataatagtaataggaacctgcttactactcccttgtttgctacctgtactccttcaagtaataaaaaacttcatcactaccttagttcaccaaaatgcttcagcacaagtatactatatgaatcactattgatctgtcttgcaagaagacatgggtagtgaggatgaaagtgagaactcccactaatgagagaggttctcaaagagagggggataagggaggagaccacctctcatattgtcttatgcccatttctgcctccaaagaaggaaaaagtaaaaactaaaaggcagaaatgaaattcaccgacagacagcccagtgccacgccctgggcctggtagttaaagatccacccctgacctaaccggttacgttatctatagattccagacgttgtatggaaaagcattgtgaaaatccctttcctgttctgttccgttgtgattatcagtgcacacagcccccagtcacgtaccccttgcttgctcaatccatcacgaccctctcacgcggacccccttagagttgtaagcccctaaaagggactggaattgctcactcggggagctcggcttttgagatgcaagtctgctgaagttccaggctgaataaagctccttccttctttaacctggtgtctgaggaggagttttgtctgtggctcgtcctgctacactacaaaagtaaaattgccttactaagtaatcttttattgagcacacgttttcttcgcagcaccaagcacttgtttctaaccttagttatttcttggcttctgctagcttttgaatttgtttgctcttgcttctctagttctttaaattgtggtattagggtgtcaattttagatctttcctgctttctcttgtgggcatttagtgctataaatttccctctaaacactgctttagctgtgtcccagagattcttgtatgttgtgtctttgctctcattggtttgaaataacttatttatttctgccttaatttttatatttacccagtagtcatttaggagaaggttgtttagtttccatgtagttgtgcagttttgagtttcttaatcctgagttctaatttgattgcactgtggtcagacaaactgtttgttatgatttccattattttgcatttgctgaggagtgttttacatccaattatgtggctaattttaaaataagtgtgatgtggtgctgagaagaatgtatattctgttgatttggggttgagagttctgtagatgcctgttagatccactcggtccagagctgagttcaagtgctaaatatccttgttaattttctgtctcattgatctgtctaatattgacagtggggtgtttaagtctcctactattattgtgtcagagtctaaatctctttgtaggtctctaagaacttgatttatgaatctgggtgctcctgtattgggtgcatatatattaggacagttaactattcttgtttcattgatccctttaccattatataacgcctttctttggctcttttgatctttgttggtttaaagcctgttttatcagagactgggaatgcaacccctgctttgttttggtttccatttgcttggtcaatattcctccatccttttattttgagcctatgtgtgtctttgcacttgacatgggtctcctgaatagagcataccaatgggtcttgactctgtatccaatttgccagtctctgtcttttaattggggcatttagcccatttacatttaaggttaatattgctatgtgtgaatttgatcctgtcattataatgctagctggttatcttgacttttagttgatgcagtttcttcagagtgttgttggtttttacaatttggtatgtttttgcagtggctgatacagattgttcttttccatgtttagtgctcctagaggagctcttttaaggcaggcctggtggtgacaaaatttctcagcatttgcttgtctgtaaaatattttatttctctttcccttatgaagcttaatttggctggatacgaaattctaggttgaaaattcttttctttaagaatgtagaatattggccccactctcttctggcttgtagagtttctgcagagagatctgctgttagtctgataggctttgctttgtgggtaacccaacctttccctctggctgcccttaacattttttcctttatttcaactttggtgaatctgacgattatgtgtctttgggttgctcttcttgaggagcatcgctgtggtgttctctgtatttcctgaatttgagtgttggcctgtcttgctaggttggggaagttctcctggataatatcccgaagagtgttttccagctcctttccattctcccagtcactttcaggtacaccaatcaaacgtagatttggtcttttcatatagtctcatgtttcttagaggctttgttcattctcctttttcattcttttttctctaatcttgtcttgacacttcatttcattaagtcaatcttctacctctgatatccttttttctgctagattgattcagctattgatacttgtgtatgcttcacgaagttctcatgctgtgttttttagctccatcaggtcatttatgttcttctctaaactggttattctagttagcaatttctataatcttttttttaagatttttagcttccttgcattgggttagaacatgctcccttagcttggaggagtttattatccaccttctgaagcctacttctgtcaattcatcaaactcattctccgtccagttctgttcccttgctggcaaggagtgtgatctgttggaggagaagtgttctggttttgggaattttcagcctttttgcgctggtttttcctcatctgcatggatttacctacctttggtctttgatgttggtgaccttcagatggggtttctgtctggatgtccttttcgttgatgttgatgctattcctttctgttcgttagttttccttctgaaagtcaggctcctctgctgcagtgcaggtctgctggagtttgcctgaggtccactccagaccctgtttgcctgggtatcaccagcagaggctgcagaacagcaaagtttgctgcctgttacttcctctggaagctttgtcccagagggcacctggcagatgccagctggaattgtcctgtatgaggtgtccatccgcccctgctgggagttgtctcccagtcaggagacacaggtgtcagggatccacttgaggaggcagtctgtctcttaccagagctcgagtggtgtgctgagagatcctctgctctcttcagagctggcaggcaggtacatttaagtctgctgaagctgagcccacagcctcccctttccccaggtgttctgtcccagggagatgggagtttgatctataagcccctgactggggctgctgcctttttttccagagatgccctgcctagagaggaggaatctagggaggcagtctgtttacagaggctttgctgagctgttgtgggcttcgcccagttggaacttccctggggctttgtttacactgtgaggggaaaaccagctactcaagcctcagtaatggtggacgcccctccccctaccaagctagtgcgtcccagggcgacttcagactgctatgctagcagcaagaatttcaagccaatgaatgttagcttactgggctctgtaggtggtgggatccgttgagctagaccacttggctccctggcttcagccccctttccaggggagtgaacagatctgtccactggcattccaggcaccactggggtatgaaaaaaactcctgcagctaacttggtgtctgcacaaatggcttcctgttttgtgcttgaaacccagggccctggtggggtaggcacctgaggaaatctccgggtctgtgggttgtgaagaccatgggaaaagcatcgtatctaggctagagtgcaccattcctcagggcacagttcctcttggcttcccctggctaggggagggagttccccaatccctggcacttccctggtgaaacaatgccccaccctgccttggcttgccctctatgggctgcaccccctgtctaaccagtcccgatgagatgagccagatacctcagctggaaatgcagaaatcacccaccttctgcgttgatctctgcgggagctgtagactggagctcttcctattcggccatcttgccagccacccgtactgtactttggaagaaagtcactacatatagccagcactttaaaagaatggagaattatggtccctatccttaaggtgagagtatctatataaattgttcggaatacttttgcaccagatatttgtctctctgtattaaattatttaatcctttatttatataagtatggactcatggatatatattctatactttatgttataattcactatgactttacttacattgttgctcaaatggtctcctggctttggcaaatttgagagagcattcagttggctcctgtacttctttgagatagctccatcaatatgagtttttaattttttctgagtgccttactttttgtcactactagatgccccagtctcatattgtatattttatgccccactcttataatcacagacatttctccaagaagccctgattccttctactagagattggtattagaaacccagatctgggcactaggcatgctcattgttattgggatgtcatttcttttaggccttctttttggcagattaaaggaatatatgtgtatattctatcctatctgtaaaggtatactatctttaaatacatcaatatgttctgtgactggcttattttacttagtataccatccatgttgtcacaaatagcagaatctcctattttaaggcagaataatatttcactgtatatatgtatataccacatttcttcattcatttttaaaaagatacttgaattgtttccatatcttggttattgtgagtaatacctcagtgaacatgggaatacagatatcttttcaagactctgattttaattctttttttatatgtacccagaggtagaactgctgggttgtatggcagttttatttttaatttttgagaaaccttcatattaatacccatagctactctaccattttacatccccgccaacaatttgccagcatttcaatttcttttttttgagacagagtctcactctgtcacccatggtagagggcaaaggtgcagtctcggctcactgcaacctccacctcccgggttcaagtgattctcctgcctcagcatcccgagtagctgggattacaggcgcctgccaccatgcctggctaatttttgtatttttagtagagacagggtttcaccatgttggccaggctggtctccaactgcggacctcatgatccacctgcctctgccttccagagtgctgggattacaagcgtgagccactgcaccaggcccagcattccaatttccacacatccttgccaacatgttacatttcgagtttttagaaaaatagccattttaacaggcataaactgatatctcattattatttgattttcatttccttggtaaataatgctgctgagcatctttatatatcttatttgtacgtcttcttcggagaaaaatgtgtttaactcctttgcccattttttaaaaatttctgctattgagttgaaggagttccttatgtatcttggaaattatcagatatatgacttgaaaatatgttctctcatttcagtttgtctttttattctgttgattgtttcttttgccacgcagagctttttaatttgatgtaatcttgtctatttttgcttttgttgcttgtacttttggtctcatattcaaaaaatcattgccaagaccaatgtcaagattttcccctatgcttttgtctagaagttttacattttcaggtagtaactataatagttaaactgatagaagaagagaatacaatagtggttgctagggcctggagagtggggaaaatagagtgcttgttgttcaatgggtacaaagttttagttatgctagaatagtaaattctagagatctgctgtacaacatattgtttattgttaacaacatggtattttgtgtttcaaaatttcttaagagggcagatctattttgtcttcctatcacaaaacaaacagaaaacgaaaacaaaataaaaaggcggggtgtggtggctcatacctgtaatcccagcactttgggaggcggaggtgggtggatcacgaggtcaggagatcaagaccatcctggctaacatggtgaaaccccgtctctactaaaaatacaaaaaaaaaaaaaaaaacccaggcacggtggtgggcgcctgtagtcccaactactcgggaggctgaggcaggagaatggcgtgaacccgggaggtagagattgcagtgagccgagatcgtgccgctgcactccagcctgggtgacagagcgagactgtgtctcaaaataaataaataaataaataaataaataaataaataaataataaaaaacagagacacaacaaaactttggaaggtgttgaatatgtctattattttgattgtgttgatgggtatttatttgcatatgtacaaactcatcaaattttacataacaaaaaatgtgcatgtttcactgagatacaatcactatacaaggaactgcacatattactgtctaaaatttgatgagtttgtgcagtttttaaatagtgattatatctcaatgaagttgtttaaaaacttcagtgaaataaataaatacataaataaataaggaaccaactttgtttaagtgaaacatgagttcttatgcatgtgttcaacacatgaattattttagcccttgaaactcaactatcactatccaccaactctttaattaattgttcaattaaaatatacatgtatagcaataggaatattgttaacccatatgtccatggaatacagctttattaactagagggcagtgtctgtgtgcagttccttttacctttagacttataggctccacttattttcaatgttatttagttcagccctcctccacccccaaactccttcagtgaggttgccttaaacattcatagcagagtgagattttcttgtcacagtctgcattccttccaaattcctgaccttttaatttattttttttaaattgtataaattaaggttcactctttgtgctgtagctgtctatgggtttcaacaattgcatagtgacacatatccacagaatagttgtagtatcatacagaatattttcctctaaaaattctctgtgcttcatccattcatcctcctccttccctcctctattccctttgaagttactgatctttttactgtatctatagtttttaagtaattcaatcattcacaattttgtacaaatattattacagtcaattttagaatattttcattcccccataaggaaattctccaccctttaggcttcaccctcttcccttaaagttctccatctctacattagtaggaaacaattatttggcttctgtctctatgtattgccaatactgaaagctttagttaaatggaataatataatatctggcctactatgtctggcttctttcacttagcatactgttttcaggctccattcatgctgtagcatatatgattgctttctttttattgctgaaaatattttatagtataaatataccaaaatttatttattcattcatcagttaatgaaaatttttgctgtttctactttttgcttattatgaataatgctgctatgaacatttgtatacaagttttggtgtgaacataggtttgcatttctcttgggtatataactcggggtaaaattcttgaatcacatggcaattctatgtttaaccatttgaggaatttccagactgctttccaaagtagctgcaccattttcctttcataccagtaatgtcttcctttcttttttgaatgacactcatcaccatttatatatttatgtgcatttatatatttatgtgtgctgtctccaccactaaaatgttttctattcttagcacaggcactttacataggattcacaactctgtgttcaataccccaaacaatgactgatacaagtaatacttgatgaataattaataaattagaataaactttgtgagttaaaattaggcggcagtacagatctttggatatatgcatggtgttttattactaccaattccaccaaaaaataaagagatcagaaacaagtattgtgaaatggtgccataaatatttttaaaattgtgtcttgtattgcttttcattttttaaaggtatgaaatacttcaattaaaattgttttaaagaatctgtaatgaaaatgaaacaaatgacatagatttaacattttttaaattttgctgaaatgataggtatttttcaagtcaaagaaaacagataagaatgattgctgaaattccagcaaaagagaaatgtgagtctgtgggaaagatgactaaagaaaggtgggcttagaaaagagataattaggtagaagaaatgcataatttgctattttactctttctttataatattaatatttatgagagaatatgtgaaagagaggtcaatgttctgtattgaatctactaagagaggacacaagaaaggaaaggaaagaaaaaaggaagacctttgagactttcactttttatgaactcttctatgaacttcatatgaactataatccccctaatagccctaacctataagaagtatgatgtgcatcttaagaaaactgaggttcataaagggaatataaccttccaagtagcataaaacagagtaatatttgcactcataactctgtgagtccagaattcatggacacttcaccatacaaagctgacttcccaataattactttgtctccagcatcatctggaaagcattctgcctccagttgtcttcataattattctggtttgcttggcaagtagctcctttctttctcccttcctcccttcctttttttctccttcctccctctttccctctctctttctcagctcttcctttcttttttaagttcgtttagtggttaagaagagggggtttgtagtaagactgttttaggggctgaattgtgtcccctttcaaatttatatgttaaagttttaactcccagtacttcagaattcaactgtatttgaaaacaaggcctctaaagaggttactaagaataaatgatgtcattgttgttgagtcctaatccaatatgactggtatccttataaaaacaggagattaggacacatagaggaaagactgaacatctataaatcaaggacagaaggctcagaagaaaccaatcttactgatcaccttgatctcaaacttatagcctccaggaccatgaggaaataacaaactattcatttttagcactttgttatggcagccctagccaactaaaacagactataaagcttcaaatatcagttccgtaacttactaattatatgaatttgatactatatttacttcctatttgtctctatttacttatctataaaatgagtattttactagaacctactacatagtattatgaggattaaatataaaagaattagaatagtgactagcttgataatgttagctattataatttttataagcaatccttgaaaacctcttgggtacactgtagaaacagaagctcagtatttatagatcttattctgcattgagaatgtcatctcagactttttgaaggtctaaaaatataactgaaaaatagcactgatttggaaagagtttaggatcaaaccgagagacatttttgtttgaatttggttaagcatgggagcttagatttgaaagactacaagtggtaaggtgaagcagtacaggtctcaatgtaaaagacatgttctaaagattcagatccattggagctaaaatattttggcaatttggctttggtggccagaagaaaaaacctcgaaaggaatagcaacagatattgacaaaaatgaaatttatgggatgaaaaaaaagagcaagaagctcacatagaattaaagagagtaataggattaaatcataacattaaatttccagttcattattttgggaaaagcatgatacaactagcaggcagttattgatctgttttatcattagttttggggtatacacattattttatcatctttaagtgaatctagaaaaaaatttatggtgctaacatgtatactaaaagcatggtacttatctaaagtttctagttcagatttttctctttattacatattgttgaatttttttcttttttaaagttttactattaatctctaagctcaatgagtactttgccatgtctaaaagaaggaaatttcattttagctgctgatttatggtgtaccagtggaagacaggagagacaaaacctgacaaccagaaaagaaaaaaaaataaattgaagaatctttctaattttctgctcagcagtggctaatgttgttgtcctcttgttgttgattacttccatccactcaatttggctgatctccagggggcctacccttctgtccactaaaacctggcagcctgttttttgttttgttttatctttaactgatgtgctttcattttgttttattctattttgattgtttttcattttgggtgagtttacagcacactaataccaaagaaaatgaataaagaaaacattagaataaaactatgttggaggagaaggggaacaacaaactctacaggaattctgatagctttctatttcctttttttgaagtttactttttgcaagtagtattctcaattgtaaatccacaaaatattgagaataactaggatctgcaaatggatttttgttaataaacattctttactagatttccaactgtatttccccaatggagaacttgcataatctcagggagaggtttgagagccagatttttctcaggaaaagagtatttcctgaataaatacattgtgggaatgcaaatgtttgagcagtttcccaggggaggtttaaggccgtgtgactgcacatttgccacgtaccaaattctaacaagtcggcacagagcctgctttatctctttattaatgtccctgttgggtcccacatttttgggatgtcgagtcatcactataaagattattttggcattaaggttctttatatatgacataaaattaaaaagataaaattttgtaaatttggctgtatgctgaatatataccacatttatttaaagcaataatattagaagtgcaaagatgtatcattataaaacatcattttttataatggtttactattttcacagtggtttcttatctgttagactacatattgacaataatactgtgcaagtatgttgaatagtgctatgcaggtacgttgaatttatcttagagctacataatatatttttcagcattatatgactagatggctagtaagtgacaaaggcagaactagaacctggactacattatcccagaacatcctgaaaaataaacaaaatatatgaaatagaggccaaagcccaacccaggaaaatataataaataaatatattaattaaatttgtctatatttatttttgattcagtgagttgcctaaatgttttctatttctaaattaaaatctaaatttcatttatatttattatcataaagtacttctacatcactctatccacatatataggaatctgggtttcagcccaaaccctaattaacctcatcagagaagggcgtaggtctaaagcttagaaacctggagaattgcctctcacagctgggaatagggcaaagaagttcacccaacagtcaaaccctgaatgaatggattagtacaagcctaaacaagagaatgtctaaagagatacttgaaaatctattaagtattatatttattttcccttcaaacttgaaaggaaatacaaagcatttatataccagttttttttaaaaaaagtcttggctaaagagttgaaaagagcaaaccctgttttatttcagcctcctttcaaacatgttattatggtcaattcaaattatctgggatgaattgttatatgaagattaagtctgtttagatttgctctgtagatgccattttattactataggaacgttaaattacagtttgtccttctaattataacaatcataatgtaaatagcagtttccattgttgaatctttattattattgcttttctcatttgtatctcatactcaccttaaaagaacattatcttatgctcattttataaaggtaagaaacaatggttcaaaataacaaattgtccaaaaaacagcagtgtaactatatttgaccctgaagcaaatgcctttaatcactgctctatgctgtcagattttttaagatagtgttggtaaaaaaaaaaaaaaattagtaaaaatcatatttaacactgatgtatagattgagtagtgtgactcctttttataaaaatggtaagaatttgaaaaaggcagtaaagatttgatacaggcagtcaccatcttataatggagtcattccaaactatgttggtaggaccagttttttggaacactgaacatacaatattataaatgaaatttatgttgatagttaactggtaaaaacaaacgaacacgaataaaaaagcctcaatgcataaggatgaactagtccaggtttgaagtttggtaagaatgctgcatcagacccagttcaaggtggcttttatttgctatcacttccaaacagccaataagtcttagaatggatcttcaccaggtaagaatacaattgattctgtgagtgaagctctcaggagctctctcagtctattagggttgctgtaacaaaatatcacagactgtgtggcttaaacaacagaaatttgtatctcacagttctggaggctagaaaatccaagatcaaggtgctggtccaatcgttcctggtgagggctctctcttggcttgccaatggtggctgctttctccctatgtcctcacatggcctttcctgtcctgtgtgcacatggagagaaagaaagatatcttttctctaaggccttctttaaggccatcaatcctactgaattaggattgaacatttattatctcatttatgttaattaccccctaaaaccttaccttcaaatgcagtcacattgggggttaggtatccaacattttggggaaacacaactcagagcaggaacattcctagtgtttcaagaaagtgtctctaacttggttgcaagtttgtcttggaagtgggggtcactgcctttctatcagtaggctggagctgaagatacatcagccctagagtgcactttctaatgtgcaattcaattctttcctttccacatagctatagactttgattctctgtttcttgcggcattactaacctttaggcaggactggtcatatcaatcacatttctattgaaaatacagcaatcgccaacttcttatgttgtacattttatgataatttgcccaaactatggtgtttgtttattcgtttgtttttggttgttccttaagagtgaagtactggtctgggaaagtgactgttttctgtaagtgttctccaatgagaaagtgtattttttgctcacaataagaaggaaagacttggcagggaaaacagatcctcaccttcgaattccttctctacccttatttctcaactgtaattgcaaatcacatgtaagagagcagaaggcactgccctggaggtcaattcttgtaacctgaaattgagtaatatatttgttttctgattcagttagttgtgcagactaactatgaaagtacccagaaggcttgttttgaaattggagatctttttcaaaattgcgcacaataaaattcgcatactaaacattctaagggccctaatctaaatatgtaatatttaccacaagattttaggaaaatgatcagttattatcatgaatatgaaaaaagttggaaagacattcccaatggcagcagagagaaaacctggtaaatcctacccatattgtcaacattatctcttcacttttggcatcgtcccctgacttaatcacatgaatggaatggaaatattgcttctatataaaatctctactcaagtggtgtctttcagagcgtaaaataacttgatggttacgttctcttccttcctatgctttttaaatcactgtacctcttcctgtgttacacattatatatttatttgcttactctgtcttttctctcaaatgtaagctctttaaatatgggaatcatgtttgttctttctggtaccctctggaactcaatggatatttgtgaaataaatcttttatgaattaaaaattcggtaaaaattgttttattttgtattttttttacagaaagtaaaaggtcactggagaaatttaaaacaaatatataagctaaaattattttaaatggtatgaataaaagtgaatataatgggtaatgggcctcgagtataaactaatcctttattagggaagacaattattacttaactaatcatttttcctttcttccacctttgtttctcacaaaacctgtccatattctgtactcataaaatgtattctcaaaacttctattaaatggacagtaatggagtcacagcagcatctggccacaactgacttgccaaggagtcaatacctttacagactcaggctaactactgtctgtagaaaggtgtgtggtatagagttctacagagggccagtactagagaggctgctgcagtaaacttagttgtttatattttagtttctggcttagctcatgactgtagagtctctaatatactctatattctaccaaagaattccaaattgtgctttcaaggtcttattatataaaatgtttattgtgtctgaatgaattcagtccgacaatgaatcattaaaatgtgatgtattttatcagcaccttattgatgtaataattcgtttctttttacagttattacaagtgtcaataacagaaaaatattcacagaaatttttctgtttttttgcaaccatttgattataaataaattttcatatcaatttttctatttaaaaatatcgatagcatattcctcttttgatatgatttatatgatcatgataatcgtacaagttctatgtcaaccaaaaattttatttttcctcatctctgcaatgggaaaaattaaaaaaggtttaccaatgcagtcacctagaaattgaccattttatttatgtttgatgccatttacaaaaatagtttatttttcatgtaagtgatacattgacatgtctaaagacagcattctatttgatattattaaaattgtattcattatagttaaataaaatttttctatgaccttttataatacacttaaatactttcttccaaaggtagaaaggattgagagaatgaagatttcttaccaactgcttttatttaaaatttttttttcaaaattggaggattctatttatttttagctacatatttaactaactgttctattcttttagtatttaaaatattaaaactgtctttttacactggaaaagtaatacatgtgtatttttccaaatcataaaacataaagcagaataaagaaaatacagaataaccatcaatctgcctattcagaagcaacctctggttgtatatgatttcttatgcatgttaatatgtataagtgtgtgtatatgtgtgattatatttatatgagcatatgtgaatgatcattgcacatatattgtttggtaacctcctttgtcattgaatgagataatattgataacttttgagttgcaggcaagatggctgaatagaaacagctctggtctgcagcttccagtgagatcaatgcagaaggtgcgtgatttctgcatttccaactgaggtacccagctcatctcattgggactggttagacattgggtgtagcccatggagggcaagccgaagcagggtgctgcgttgcctcacctgggaagcacaaggggtcagggaactccctcccctagccaagggaagccgtgaggggctgtgccatgaagaacagtgcattctggcccagatacaacgctttccccatggtctttgcaacccgcagaccaggagattccatcgcgtgcttacgccattgaggccctgggtttcaagaaaaaaattggacagcctttgggcagtcacctaccaagctgcgggagttttttttttcataccccagtggcgtctggaatgccagtgagacagaaccatcatcccctggaaagggggcttaagccagggaggcaagtggtctagctgagtggatctcagccccatggagcccagcaagctaagatccactggtttgaaattcttgctcctagcacagcagccttaagtcgacctgggatactccagctttgtcaggggaggggcatccgccattacagaggcttgagtagccggttttcccctcacagtgtaaacaaagccccagggaagttccagcacagctcctcaaacccactgtagccagactgcctctctagattcttcctctctgggcagggcatctcagaaagaaaaacagcagccccagtcaggggcttatagatcaaactcccatctccctgggacagagcacctggggaaggggtggatgtggacacagcttcagcagacttaaacattcgtgtctgccagctatggagcgagcagcggatatcccagcacagtgttcgagctctgctaagagacagactgcctcttcaagtgggttcctgacccccgtgcctcctgactgggagacacctcccagcaaaggtcaacagacacctcatacaggagagctccagctggcatatggtgggttcccctctgggatgaggcttccagaggaaggaatagcagtaatcttagctgttctacagcctccactggtgatacccaggcaaacagggtctggagtggacctcaagcaaactccagcagacctgcagcggagggacctgactgttaaaaggaaaactaacaaacagaaaggaatagtattaacatcaacaaagaggacatccacacagaaaccccacacaaacgtcaccaacatcaaagacgaaaggtacataaatccagaaagatgaggaaaaaccagcacaaaaaggctggaaattccaaaaaccagaacatctcttctcctccaaaggatcacaactccttgccagcaagggaacaaaacttgatgaagaatgagtttgatgaattgacagaagtggcttcagaaggtgggtaataacaaactcctccaagctaagggagcatgttctaacccaatgcaaggaagctaagaaccttgaaaaaagtatggagaaattgctaactagaataaccagtttaggaaagaacataaatgacctgatggagctgaaaaacccagcatgagaacttcgtgaagcatacacaagtatcaatagctgaatcaatctagtggaagaaaggatatcagagattgaagatcaacttaaggaaataaagcatgaagacaagattagagaaaaaaaagaatgaaaaggaatgaagaaagcctccaagaaatatgagactgaatgaaaagaccaaacccacatttgattggtgtacttgaaagtgacagggagaatggaaagaagttggagaacactcttcaggatattatccaggagaacttccccaacctagcaagacaggccaacattcaaattcaggaaatacagagaacaccacaaaggtactcctcaagaaaagcaacccaaaaacacataatcatcagattcaacaaggttgaaatgaaggaaaaaatgttaagggcagccagagagaaatgttgggtttcccataaagggaagcccatcagattaacagtggatctctctgcagaaactttacaagccagaagagagtgggggccaatattccacattcttaaagaaaataattttcaagccagaatttcatatcaagcaaaactaagcttcataagtgaagtataaataaaatattttacagacaagcaaatgctgagagattttgtcaccaccaagcttgccttacaagagctcctgaaggaggcactaaatatggaaagaaacaatcggtaccagccactgcaaaaacataacagattgtaaagaccgtcaacactatgaagcaactgcatcaactaacaggcaaaataaccagctagcatcataatgacaggatcaaattcacacatagcaatattaaccttaaatgtaaatgggttaaatgccccagttaaaagacatagactggcaaattagatagagtcaaaacccattggtgtgctgtattcaggagtcccatgtcacgtgcaaaaacacacattgactcaaagtaaagggatagaggaatattgaccaagcaaatggaaagcaaaaaaaaaaataaaaaaataaaaaaaatcaggggttgcaatgctagtctctgataaagcagactttaaaccaacaaagatcgaaagagccaaagatgggcattacataatggtaaaggaatcaatgcaacaagaagagctaacaatcctaaatacatatgcaccaaatacaggagcacccagattcataaagcaagttattagagacctacgaagagatttagactcccacacaataatagtgggagactttaacaccccactgtcaatattacacagatcaatgagacagaaagttaaaaaggatatccaggagctgaactcagctctgcaacaagcagacctaatagacatctacagaactctgaaccccaaatcaacagaatatatattcttctcagcaccacatcacacttattctaaaattgaccgcataattggaagcaaaacactcctcagcaaatgcaaaagaacggaaattataacagtctctcagaccacagtgcaatcaaattagaactcaggattaagaaactcactcaaaaccatacaactacatggaaactgatcaaccagctcctgaaggactactgggtaaataacaaaatcaaggcagaaataaataagttatttgaaaccaatgagaataaagacacaacataccaaaatttctgggacacagctaaagcagtgtttagagggaaatttatagcactaaatgccgacaggagaaagtgggaaagatctaaagttgacaaccaaacattgcaattaaaagaactagagaagctagagcaaacaaattgaaaagctaacagaagacaagaaataactaagatcagagcagaaaagagggagatagagacaggaaaaacttcaaaaaatcactgaatccaggagctggttttttaaaaagattaacaaaatagacagaccgttaaccagactaatgaagaagaaaagagagaagaatcaaatagacacaatacaaaatgataaagtggatatcacaactgatcccacagaaatacaaactaccatcagagaatactataaaaacctctaagcaaataaactagaaaatctagaagaaatggataaattcctggacacatacaacctcccaagactaaaccaggaagaagtcaaacgcctgaatagaccaataacaagtcctgaaattgaggcagtaatcaatagaataccaaccaaaaaaagcccaggaccaaagaaattcacagccgaattctaccagaagtacaaagagtagctggtactattccttctgaaactattccaaacaatagaaaaagagggactcctccctaactcattttatgaggccagcatcatcctgataccaaaacctggcagagacacatgcacaaaaagaaaaattcaggccaatatccctgatgaatatcgatgcaaaaatcctcaataaaatactggcaaactgaatccagcagcacatcaaaaagcttatcccccaccattaagttggcttcatccctgggatgcaaggctggttcaacatatgcaaatcaataaacttaatccatcacataaacagaatcaatgacaaaaaccacatgattatctcaatacatgcagaagaggcctttgataaaattcagcatggctttatgctaaaaactctcaataaacttggtattgatagaatgcatctcaaaataataagagctatttatgacaaactcactgccaatatcatactgaatgggcaaaagctagacacattccctttgaaaactgacacaagacaaggatgccctctctcaccactcctattcaacatagtattggaagttcaggcaagggcaatcaggtaagagaaagaaataaagggtattcaaataggaaaagaggaagtcaaattttctctgtttgcagatgacatgattgtatatttagaaaacaccatcatctcagtccaaaatctccttaagctgaaaagcaacttcagcaaagtctcaggatacaaaatcaatgtgaaaaaaccacaagcattcttgtacaccaataacagacaaacagacagccaaatcatgagtgaactcccattcacagttgctacaaagagaataaaagacctaggaatacaactcacaagagatgtgaaggacctcttcaaggagatctacaaaccactgctcaaggaaataagagaggacacaaacaaatggaaaaacagttcatgctcatggataagaaaaatcaatatcatgaaaatagccatactgtcctaagtaatttatagattcaatgctatccccatcaagctaccatttactttcttcacatattagaaaaagcaaactactttaaatttcatatggaaccaaaaaacagtctatatagccaagacaatcctaagcaaaaagaacaaagctggaggcatcacgctacctgacttcaaactatactacaaggctacagtaaccaaaacagcacggtactggtacaaaagcagatataaagaccaatggaacagaacagaggcctcagagataacgccacacatctacatccatctgatctttgacacacctgacaaaaaccagcaatggggaaaggattccctatttaataaatcgtgttgggaaaactggctagccatatgcagaaaacaggaactggaccccttccttataccttacacaaaaattaactcaagatgcattaaatacttaaatgtaagtcctaaaaccataaaaccctagaataaaacctaggcaataccattcaggacataggcatggccgaagacttcatcactaaaacaccaaaagcaatggcaacaaaagccaaaattgacaaatgggatctaattaaactaaagagtttctgcacagcaaaagaaactatcttcagagtgaacaggcaacctacagaatgggagaaaatttttgcaatctatccatctgacaaagggctaatattcagaatctacaaagaacttaaacaaatttacaagaaaaaaacaaccccatcaaaaagtggacaaaggatatgaacagacacttctcaaaagaagacatttatgcaatcaacaaacatatgaataaaagctcattatcactggtcattagagaaatgcaaatcaaatccacagtgagataccatctcacacccattagaatagcaatcattaaaaagccaagaaacaacagatgctggagaagatgtggagtaataggaatgcttttgcactgttggtgggagtgtaaattaattcaaccactgtggaagacaatgtggtgattcctcaagtatctagaaccaaaaataccatttgactcagcaatcctattactgggtatacacccaaaggattataaatcattctactataaagacatatgcacaagtatgtttattgcagcactattcacagtagcaaagacttggaaccaacccaaatgcctgacaatgatagactggataaagaaaatgtggcacatatacaccatggaatactatacagccataaaaaaggatgtgttcatgtcctttgcagggaaatagatgaagctggaaaccatcattctcagcaaactaacacaggaacagaaaaccaaacactgcatgttctctctcataagtgggagttgaacaatgagaacacgtggacacaaggaggggaacatcacacaccctggcctgtcaggggttcgtgggactaggggagggatagcattaggagaaatacctaatgtagatgatgggttgatgggtgcagcaaaccaccatggcacttgtatacctatgttacaaacctgtatattctgcacatgtaccccagaacttaaagtaaaattaaaaaattaataactttccaaactgacttgcataaccttatttaatggctgcataatattttttggatatttaaaaatttatgttaccattctcatatttttgggcaatatctatttttgcaattgtaagtattcatgcaaaagtgtgtttgtagtctaatatttcaaaactttgaaagttacttatttatggtaaattcacaggagaagaattattgggtctaatatttaaacatttgaataatattaatatatattgaaaattgtcattcagagatataatatcaacatacacttttcttatgagcatatgaaagtgtttatttatttgtacctttgcctaaatagagtgtgtgtgtgtgtgtgtgtgtatgtgtatgttctttcaaactttatcaattgttcatatggatttcaataaacattaaggggctgctactgtggacagtataatgtctgtgagtacattagagaaatattttacagagtgtgagaatgcaaagtaaggaccagtgataataaagttctaggtgtgcccttgtacactctttttttctttcaaaataacttaagaattaaaatgagatggagcaaataaatatattgatgttattttatatgtaggacaaggtagtgtgaaaaaatgagatggatagaatggacataggaaaggcataaaaaaagatcgaagtttaccaactttttaatggaaaaacacactaaccatctataagattcagttttccatttgttaaatgaggctattaagcctatttgtgtttacgagtgaagataatgtgtaaatacagcagatagtgtgtaaccttagtgcattttcctcagcaaaatttaatccacgattggaaactccaacatttgtgatttttttctagaagtagaaaatcccttcagataaagtttgatgaaagtagatagagagctagaaaaaaaattggtccatttgttttcaaaaggctagatgtgacttattccaaatcagacaacaacaaaaaagaaatggtggaggagaggagggattgttaatgtgaaagcagtgtctagtttatcctcaaactgaataaacatgttttgtattcaacatgcttattcagagaattcctgacatctttaacatcacaaccaccacccattacgtcatcttcttttttttttttttttttgagacggagcctcgctctgtcaccaggctggagtgcagtggctcgatctcggctcactgcaacttccgcctcccgggttcaagcagttctcctgcctcaagcctcaagctgggactacaggcgcccaccaccacgcctggctaattttttttgttgtcgtattttagtatagacggggtttcaccatgtggcccaggctggtctgaaactcctgagctcaggcaatccacctgccttggcctcccaaagtgctaggattacaggcgtgagtcaccgcgccccggccacgtcatcctcatttataacccttaactatttgagcttgatcctaaacagaaagagtaagatccttaccttgctgcaaaaaattgcaaaataagatggaaaaaacatagtgtgtcaataaatcatatcatactatgatcaaaatcacagaagccccactgcatattcagtatagggggattaatgctgttaataatatgacagctgtgaactggaaggaaatagtattttgaagatagatccttggtaaagtgaaatatcaaaaacttctgaaaacttggaaagaaagctcgataaattaggacaaagaatgagcaaaatctgtgagaaattttatagatgtaagtcatataaagagatgacttcttttatgtaatacattttcttaaaagaaaataataaaccagccaggaggggtggctcacgcttgtaatcccaacgctttgggaggccaaagcgggcagatcacttgaggttagcagttccgagaccagcttgcccaatgttgtgaaaccccatctctactaaaaatacgaaaactagcctggtgtggtgatgtgcacctgtagtctcagctacttgggaggctgaggcaggagaataatttgatcccaggaggtggaggttgtagtgagctgagattgtgtcactgcactccagcctgggtgacagagtgagactccatctcaaaaaaaaaaaaaaaaagaaaaaagaaaaaaaagagaaaataataaacctttaattaaagaggcaacttaagagataggattaaataataacagatcattcaagatgcttcagattctgaagcacaagtgaccacaagcaatatattatgtaaaaatattcagacacattttcatatatcttctccatatttcataacatcacaaatacttaccacacacactcaaaaactgtaagacataaaactaaaaagttatcctaacatgtatacttgaaagttttcacagagcaatttgaaatatattctggaatatcagaaagccagaagtttggggataagaattatctatgatttgtaacacaatattggaaatagtggtctaatttttgagaaaattcaaaagtaaattcaagagacttttatgattaaaatgataaggcaagtgaggaagagagaggaatcaaggccacctacagtgagcatctgactttagcaaaggagtcaattgatggttcctggcactgacttgggagcctaaaataaaaaagaacgtagccctaggaaggtgattaattcaaggtgaggcagtttgagtttgaaggatttgtgaaacctccagtggaactatgaaataaaaagccccatatgtagctatggagctcagaatagaggtctctgctggagacaaaaacttgagaatcaggagacaaacgatcattgtttcgtggggtgaatgagatctatttatttaacaagtatatatagtatttgatgtgaagcaagcactctcctgaacgcttttacaaatattaactcatgtaatcctcatagtgactatgaggtgactgtgaagattgggaaggaatatcctagaagtgaactctgaacaaccaggagaaaaacaagtatgagaaaactgagaggaaatggccagcaaagcaggagaaaacttgggaagccgcagttacacaaacactaggggaagtgattattgccagaaattgtcatgagtcaacaatgtctaacgcacagagtgttccagagggcaaggggtaaacacatgcatgggatttaatgacaatggcatcacaagtaaccttctaaaatattttagcgtgagggggcagcagcaagtgagatggggtaggaacaggaacagaggctatgaaaacagaaatttaggatgctattttataaatctgtgctgaaaagtaacagacagaatttgaagagaaaaattttatgaaggttatagttgtatatggttaaaaagggagagtcaaaagctgtaagaaaagtaaaataaatagcagatgcgaacccaggcacaggtgaaaagagtttaactgtgggctgaataaaagatgtatttcccattaaaatgataggttttcttggtgggggatacaaatacatttttaaagtgtgtgtaatgaatgtgtgtttgtgtgtgtgtgtgtgtgttttgccaggggaaacaaagaaacagaaacagagagagagatgagaaagttgctgaagagcagataggaagacgaaaaatttcttgctgtgattaaattttgtgtacaagaaagagattgagattgtctttcagaatgacaagaagcagtagacttttaaaaatgtgaaggtttgatgttctctctaggtaaaataaaatggagcattaataatttagcattaaaagatttctggggctggacgctgcggctcatgcctgtaatcccagcactttgggaggccaaagtggctggtcacgaagtcaggagtttgagacaagcctgaccaacatggtgaaacctctctctactaaaaatacaagaattagctgggcgtggtggcgtgtgcctgtaaacccaggtactcaggaggctgaggcaggagaattgcttgaacccgggagatggaggctgcagtgagctgagattgtgccactgcactccagcctgggtgacagggtgagacttagtctcaaaaaaaaaaaaaaaaaaatctgggctgctggaatcccaactataaattaatagtaacttctgctgccttaaaaattcagcatttctcccctccagatacaggaatttaatatttgaatgattatatttggattttgttaactggacagagataaagaacaaaagaagcaagactttgacaggtgctggtaagaggaaatatataaatggtttaaatggtttattacttaatcatcaactaatcattttttctacatgtgttctttcaatgtttagaaatgtagataatacttcaaattagtaatatcacacttgggaattaaaaatattaaaatggctatgtgcacgttcatatttattttactagagaaaataaaattacattttaaacaatgtagatttccaacataattaaagttattagatatggtggcacatccatctaccgaatttaatatacactaagttaaactggcagtgataatgactagaagataatttgggaataatccacatgatacgaatttgaaatgctgtacacaaaaatagatgcataatttaagatcaaccaagtaaaaaactggtgttcatggagaaaaagatggtttggtaacagaaaatactttaggtcaatgagattatgaattcattttcatagtttctcttctacttaaaagaagtttagtcatctggtttgtttgctcatgaaacattctctgctacattagagagtgagaagactctttaatatgttcataaatccagctctcagagaaggttagcctacacccacctaaagaataaatcaccattaacccacattaatcatggtgattccattaactttatagtgtttggtttagatatctctatatgaactctggctaacaagttgagaggggatgtagctgcatggttggggatggggtgattttgaaaattctccttgctgtgaatgcagctatatgggaagaaccacaaggtatctcctccttctatttgtcctgtctgtaagtgacacttgttactgaagctgcaatcttgtaacattgaggcagacaaactaaaaataaaatttatctgctgtgtatgatggaaataaaaatataggaaaaacctggttccttgttgaaggaaccagtcttgaagcagcttacctctgtattttgtacctctaatgcaggctaataaatttaagctaattatttatgctacctgtgctgtggtggtttcctatcagcagccaaatataacctcacagttgttttgctgtttttgctttcacaaaagagctattaaccaacttaaaaatgttttttgattgaaggatgcttaggggatgagaggatatcaacaatataagcccatgccaaatccccatttcttatcattaaaactgacctgacattaaagcaatgcttaattttttaccataagagtgaaattttgggattataattttaaagtgtaaaatatttacacttaaattacacttataattttaaagtgtataatatttacacagattaaaataaaatatgggaaacaatgaagcaaaacattctaaacttgaaaagtaaattgatattacaaacacagagtgacttaaaaacaaacaaaaacaacaaaaatcaaacctccgttataattgcagatttgttgactaaatgtttactaaaagactggctagcttgagcccagggggcgaaggtttcagtgagctgagattgtgccactgcgctccagcctgggcaacagagcaagacttcatctggaaaaaaaaaaaaaaagactcgctaaagggaaatttctttttggatttggctctttttacaggaagtcatacttttctggagaactacttgatgaaaaatttcttaaccttacttcatgaatcaaatcacaactctttctacattttagattgtgaaaatctcactgataagaaaaaataattgtttctcttggccaggtgcagtgactcacatctataaaaccagcactttgggaggccaaggcgggcggatcacctcaggtcaggagtttaagaccagcctggccaacatggcgaaaccctgactcttctaaaaacacaaaaataagccggttgtggtgtgcgcctgtaatcacagctcctcggaggctgaggcaggagaatcgcttgaacccgggaggcggaggttgcagtgagccgtgatcgtgccactgcgctccagcctgggtgacagagggagaccctgtttcaaaaaaaagaaaaaagaaaaagaaaaataattgtttcactcttttaagtacaaaagtaattgtacatagttttttaaaggagggaagtctcttccaagaataaaactgttcactgtatagaattaatatttttgttattcatagtattaaaagaaaatcccttggagaggaaatagcaataccaggcaaaatgagtatatatttttatgttacaacacaatagcatatagcatatgcaaactatttatttaaataattttaaagctaaaatggagatgaggtcacacatttatacactgctagagctaaaaacaatcatagaaataagtatctgaaatatccagattttttaaatacaaaaactgaagctcaggaaattgattttttcaccccagagtcttacatttacatattggcaatgtttcaactcagacataggaatgtgaccattcaaggaaagggcaactgcaaagcttcaaaagacacgctattctcacaaatattttcctttttgtcacctaaagtaaatttcagattacttacaatctctagaaattaacatttcattaaaccataactaggaaatgtgtatttaatatttgagcaaaagttaagaaacatatttaaacttaattaaaacaaaaataaattaaagaaaattaattaaaacaaatttttatgtaatgttttgagccaaagttaagaaatttaattaaaacaaaatcatttttggtgtttatgtttttgataggtaaaaataattttctcctaccaaataacaggaaatattaatatttattgccaattaagagaggaatgtgagtcctggaagtggagaagtgaaactgagaggcaataagggggaagggggagaagagatcattagaaaattaagaacagggcaaatgtaaacatgtaaacacatttcttaaaatttgcaattgaaatctgaagagaatgtgatatactatagatctccactactaagaatacaacgaacacattgaaataaaaaagaaacacataataaaggaaataatgccaatgtttctttttatagtaatgaatagtattttaatatgcctgttctatgtatagttgtccataactactaaaactctctaaaaatgaatggaattattttgtctggactttatagttaaatttgtaagtttttttttttttttttcagaaaaagattacattgttttctttgaatgaattcacctttcttcatcaaaactactgatttccatactaactaaatttgtttaaaagcaaagctctttatggtatgttatcgtcatttccttaagaggggaaaaaaaacaaataaaagttagcattacatatctgaaccaaacggaggttttcaagaataaaattctgcacaactacaaaactagtagctccaaatgaaaggaaatggaataaaaaacgaatgcaagataatacaatgaatttttggcatgagaggaaaaaaaaagaataatatattaaatgtgtatttctctattataattaccatacatattaaaaatgagaatgatatagagagattgagaaacctgtggctacttttggctattttacctgctttttgtatttgctcttctaggtacctgttattgagtgagataagcaaatggtatttcaggaccaaaacatctgtttcctgaagagttgctcctttaattgtgtatctacctacctgtctatgtaactcttggtaaatgaattaatttgttagttaaaatcaatctattaattcataatgaatgggatatcttgtgggaggtacatgtgctttgcaaatacatggaaagacgagactttcctaacaggttctggaattcaggttgatattacctttttaaaaatttttaaggattaatagctaaaaagatcaagtcagtttcttcatttctcctgaaggcctgtttccatcagattttatctctgcctaggcaaatacattggagacttctcaactttctgcttctgatgatctcaacttgtggtatggcaaaaggagagcaaaatgttcacccaggtatgggaatttctcacaaaaatgttactttattatatttaggggaaaaagggggcaaaatctacactcataatacctgagactggatttctagaaccttttggtttcagatttatgatgaattagaaaacttcctgattagaaaaatgttatagtttcaaatattagctaaaatttttatctgtaagtacaataaacatgacaaataatgatcagtgttttcactcctattaaggagagtatttttagtaataaaaataagccttaatgtgaaaaagctaagaattcatgattgcttctaatgacaagtatctgggaggggtctgagtttggttcaagagaggaactacagctgttggtgactacaaccatctgcccagatgacatcgtgatcaactcctctgaatcactctaaaggaacgagaagtcctggcagctgagtcatgatcccccaggagccattaagaagttaatcttcagtcacttccatccaaacagaagaaaacccatgaaggatgagaactatgggtcctgagaatgacaggtaattggtgccactttattcacagaatccaataaatagtactctttgattcacatatttaatgctcattattgtacatttttataaagacaagttagtctaaattgccattcatctctttcttatcaaagtcctacccaacacatgatcatatcatcagaaatcagatattttcttgttgaatgccctacctaactcattcaattgtaattttctgggaatggtgaccagagatttgatatttttggaagttacatcaaatcctcattactttataagtgatttaaaatttatcacatggtacacttttcatatctttcaaaggattaatatataaaaaatatatagttaatgctcagctttaaagacattaaaggacagagttatacagaaagaaagatccagagatctttctttaataaagatattaaaattgaatctgcttattcaagtataatgatagaacagaaagagatcttaaaattgtttaatctcttccttggctttcaaaaatataaagtcttctttattggagatttctttatccatagaatatcttaattccccactccccaacttcctccccatgtgaagttttatctgtctttaaaatatttgtgttgtcttcttcaggatatatcattgattggcactttttgattctagttttatatactgttatccttgtatattaaagtaggtctcaaatatatctttcatggtggtgtgtaaggttctgagagagctggaaaaaaggtataagctcccttctaaagtgcaagtatatacttgcagagatattttttcacttacattcttggagatcatccatggtctccccatgtcttttacaaaagaggtttccagcacctattagggaagctagatggtcacttgtatcttccttatctctgtattagatgataatatcgaatgcaggtaagtggtggtggggagagtaatattgacagaatagttatatggcaaacattggcacctcagaaattttttgcttttttgagggctcttattaatatttgcaaactttaaaaagccttgaaaagagttttatccagagctcaccacatatagaaaaacagatctctcttgttatgggaattgaggctagtccaaattcccccagattaaacatctttcctcatttggcacattcttcagctgttccttaagaaaaaatcatactaaggaaagttaattctgggaagtctagaattagaataaaattattacactaaaaggaaagcccagatatctctttaaaaatgcttaatttttttgaaaactcacatcagcaccagatcatttctttaatgtgtacagatttcctttcttcattgactaaatagctttgctaaacgagattaaaaccacataactcaaatgagacatataagatcttgaataatgttcacatagctacaacatcaaattccagtgctaatataaattatgtctactacgttttcatttatttgggattatctgtttgcctcaagtggtgtaaaaaaattgagcaggaaccacctgaaacttcctttcacaacaagagaaagttgtaatttgtatttactttacctagctttctttatatgaatgtagccaagaagcaggggaggaaggacaattacaggaaattgtgataggaaactattaggaaaagcaatttgtaatttctgctaaaactctaggtaaataaccctgagcattcatagtctggcaagtgggaagtacctgttgaacaagtgatcacttgattgattttaagcatgtggagctcatttgtcatctaaaatatagaagagagtgagatattagcttcctgaatagctattgttatttagaaaaaataatgaaccaataaacttcttacataagatgaaataactgttttctagaaacagtgatcttatgttcttcattgtataaacacttatgtactcatatcacatagctcctgggatacaataaacaataaatgtatgtttatcttatttaggcaaactaaaagttacaggctctgtgcccttaaatttttaaatttatattcatcttttgttttttaaggtgttatgaaaatacaattttaaaagcccttctatttctaaccaccatgtattaacagggattggatttttccacccacctgaaataagtaaaaaaaaaagacaaaatataagaaattatattggtcagtggagagcagtgatttcatagagatgagaaacaagtgtttagccccacatttgtacatttgttccaccagactgagtggagactcagtttagtttctatatgaaagctcagggaggaggaactctacaagaacccagtggtctcgctgagtttgggagacaaagcagacagtctcaggaggtagttagggtatatagtaccgaacgtcagagaggacagagttacacagaaagaaagatccagagatcttcagatggacttctaggcttcagctcaatattgatctgttgcattcataagagaaaagtctaaagactgggtgaagcaccacctaaaagggttagaggggcccacacatgtaaagcagggaatattttttgttcccaagttgcaaaactctcagttcatggagcattaagtatagtactcaggtgtttgcaacagtagtaggaaaaaattaaccatagaataaacaattctctggtcttgcctaacaaagtttaatagcaagacaacaaaataggaaacagtttccaagtactttaactacatcccagaagagagctcaaggatatttatagaaatacaacatataccaacacccaataaggtaaaattcataatattaggcaaccacatcaaaattactagggatgcaaagaacagtagaatataactcataatgagaaaagtctaaatgacagaaatgacatcaaaaacagaattagcagacaaaaatattaaaaatgtaaagtattttccatatgtccaaaaaactagagaaaagttgtattacattttaatataaccattgtgattcattttctgagatgaaaattaatctttgaagcttcctaaatggactttaaaatattaccaaaatattcataataaacaccattattctggagacttaccctgtttctgagatttactctgtttttaagccttgggaaatgaggaatgaggaatgaagtgatgcttacagatgaattatcatagaattcaaggactggatagaaatagataagggtcaagaagaggagaagagatagactaggttggcagcagtgtggtggcagcacttgagggtgtggtatatttcgagggtgtcaaaggcacattgtgcttggtaataaaaactgtttacattttatcagtgtcctactgatgaatactttcacatttctgatgttgaaatagctttcttatgccctaataagcaatatataatattttttactcacatattgactgggtaattccttgcaataattccaagtctacacagagacctgtggtccatcacatggaacaattgggatagttgtactgcagcattggaacttctattatgggccatgatgtccttatattcttttgtttttgaagtaattttaacacctggttgttccaactaagagaggacatagcatcccaaatagaggcttaaagagaaaacagtggatttgacatgggcccatactttctgttattgtcggtttgaggaagaagaaaagtagaggtgaagaagttgccttcagcaactggtagctactggtagttgaatctcaggctgtggttctacttggcacctgacacttggagaagtgaagacagggagagaaaggtaatgggaagactgggcccccggaattgatacataacaccaagaaagcagtcagtgaggatttcagaaagccaggaaagatggtctattatgaagagaacttgctggaaacacttgaacacttccctgtttctggtgagatttgatatccagaaacacatgtctattgaattcaagtttctcctaatgcacattgtagcaatcagaaagaattatagtactgctatatttctataaaagatagcagaatctacctttgacactaatgcatgaaaatatatttgtgttttaaaaaggcagcctgccaaatttaattcctaaaatgagttaattgctatagatggtaaacaaaaaaggatggctggttgtagaaggcctttattgagaatagatgagttgtattgtagtacaattcttagatcatgtccacatagaaaaaaataaattgatgatataattaacccattttaacctatattataattcaatttaattaatttatactgataagatttttttgaaaatcctagtctaagtaattttcttcacttttcatattgtctgttcctttttattttttgtaaggatgtttactttgcattttttttcttgtattaggtagagatatcagttgaaagataccttaaaattttgtgacactgaatttaatcagccaaccattcctaaggaattgatagcatatttactatttggttagatggataggcactctggcattaaattaagtctctaaagttggcattttttctccattagtttgccatcctgcccacttacctcttgaatttgaaagatgtaaacaaaagatttctaaagattagaaaattaatttttaagataattaagctgttttgaaaattagagtttattacaaaatatgttatcattttatgtattattaatttaacaataagttttatgacagaagatttaagtcaaaatagttgtacaatcaacaagcaaatgataatcatttccttaaatgattatctgactgataaatggacaatcagtcagaccatcaaacaccagttgataacataatccatttggacaggaaccacatttccaaaggagttttgatttagtcattggtggtaaaacaaaagatatcagactgtaccttaaaaacaaagaaacaaaacaaaacaaaaacttgtccaattcagtatacctaatagagataggaatcaaatagtagtatatgtcattaaacttttccaacaagattctgtggtcacttgaagtagaaaaacttggttttccaatataactactcaaatcagtaaaaataaatattttaaagttttactcttattttaaaattacttgattagttatctgtatttacattaatatttttcaatctttgttgatccctaattatatttcatataattttattaagctgtaggccacaaattaacatttcaaactcagccaaatttcagggactatccctctttagtttaaggattagatgagatatggacactgtatattgaaataatcatgcactagaatgatagatttaaaataatctttaaaatgtgttagggagattttgcctccctaacacattttattcaaaagttttgcagtatctctcaaaattgtcacaactttccccctttcatgtaaatattatgcttttacacatgaaatatgactctctgggcagtatgtttcctgcttgagttttgccctttgtgtttatattatctcatgttatacaaagtcattttgtgactaatttccagagcactgagtcacagtgtggctgttgcttatcttttcttttttcccacatggtagtactcttggcccttatttttggtaattattttatactaatgagtgctttttcataattaaataattgtttctctcattatatttctgtggttgtttactgctgtattatatgctttcatttttcactagaagcaaacattttataacaggaacataacagtacatcatgtaggcatgttatctattgttttaatttacaaaattgcacaacatagacttgatcgtaagtattctcgtttaagtatctcagaatatgacctttggtctttggagaattgtaaaatatttccttagagagattagttaatgctggcataaaatattccatttagattacgattattttaatggttatacctcattttaaatatcatcaactaatagtattgaaagattatttgaatagaagaataacagtctctattttatatgttatgaaataaaatggaaaggtaaaccgaactttcaagaacttccaattaaccaagcacaattagtaaagaattctactacaatcttcaaattataaaaaagctacatacaccaattagttacaaaaatgtttatggtttaaaatcataaaaattgcacataaatttgcttaagaactaaatgcaaaatgctgagaactcaagtttggattgcagtttgagtttactctgtttacagggaagggctgattttcattttacgcaaataaacagtgatcctcccctatcagttctttgcctctcagcaccctgcttttcccccgagaaaaagaaattaaagttatttcttatgggctagacagtatattgccaggtactcacaagtaaaatctctgatgaaagttcttggaatgtttttttcaaaacggagttgaggttattttgtttttccttccaggtattgaagacaggatttatcttctctacttcttcttttagaagcagatcaagaaactggcgattgaagagtaactgaaagaaacgcaatctgatcttactagcagtgaaagagcgaggtaagaatttgactattatccagcctaaagtcgctgctgtctgttagagcaaagagggagcctcagagtcggcttcagagatcactggcagttgggaat

SEQ ID NO: 2793 - DNA, 32878 bp, Homo sapiens
  source 1..32878: mol_type = genomic DNA
tcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagacactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccacctacgaaaacaacacacaaggcaatttacacagccctgtgacttttgtagtaaaacaacagttcacttcaaatgtaaaatgtcccaaatttaagaatgccgatcagactttttttttttttttttttttttgacacagagtttcgctcttgttgcccagactggagtgcaacagcgctatctcggctcactggtaccctccacctcccgagttcaagcaattcatgctgggattacaggtgtgagccaccgtgcccggctttttgttgttgttgagacagagtttcgctcttgttgcccaggctggagtacaatggcgcgatctcagctcactgcaacctccacctcccgggttcaagtaattctcctgcctcagcctcctgagcagctggaattacaggcatgcaccaccacgcccagctaatttttgtatttttagtagagatggggtttctccatgttggtcaggctggtcttgaactcctgacctcaggtgatccgcttgcctcggcctcccaaagtactggaattacaggcatgagccactgtacccagccagctgatcagactttctatagcagagtaaggaaaaaagaatgctgagaaccaggctaatgctaatcttctaaggttaaaattctaaaggaggctaggcacagcggctcacgcttgtaataccagcactttgggaggccaaggcaggtggatcacttgaggttgggagttcgagaccggcctggctaacatggtgaaactccgtttctactaaaaatacaaaaaatgagccgggcgtggtgttgggcacctgtaatcacagcaactcgggaggctaaggcaggagaatcacttgaacctgggaggtggagggtgcagtgagccgagaccgtgccattgcactccagcttgggcaacaacagtgaaactctgtctcaaaaaaaaaaaaaatttttttaaaggaaactgattcattttacaaaggaaaactttaaatgtgttcagattcttttccccattggagcatacatggaagttttacagcaagtctcttccaaaaagactaggtttgactaagttctgaattagacagcagaaacagaaaatgacagctaaaccattaatgctcccttcttaaaggaattctagactcctagagtttgtccactttgcagaagtgtaagatttatcggttattttacacatactttagttcctcctttcccaaaagttcacttactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctgaaacagacattattcgctatgagaagttttatttctaaggacattcttttgtatgcctttctaatttaacgtgcgttaagtaagattctgataaaaggaactcgcagataagctcaagactccgaaagcaccttgcacaggggttccaagctctatggactgtgatatacactcatatttgagcccagcatgtaagaaaaccattctcattaagaaattgaacataattatataatcctatgtactatattgtttccagttcaattctccttttgggggaaaatgtccctataggggaaaacattttggttcaaggtacttcaggatttagttatttccacctggtaagttccattttcaacagttacaattagtttcaagaaagacataagatgccgggcgtggtggctcatgcctgtgatcccagcactttgggaggccgaggtgggtggatcacctgaggtcaggagttcaagaccagcctggccaacatggtaaaaccccggctctactaaaaatacaaaaaattagccgggcgtggtggccggcacctgtagtcccagctactcgggaggcttaggcaggagaatggcgtgaacccgggaggcgcatcttacagtgagccgagatctcgccactgcacttcagcctggccaacatggtaaaaccccggcttctactaaaaacacaaaaactatctgggcatggtggcacacgcctgtaatcccagctacctggggagccgaggcaggagaatcgcttaaagccgggaggtggaggttgcagtgagccgagatcatgtcattgcattccagcctgggggacaagagcgagacttcatctctcaaaaaaaataaaataaaaataaaaataaaaaagatataaaaagattcggttgtcagtgatttacttcaattaagagatctgttaaaaatcaactcctagtaccataaaacaatctggaagctactttaatattagttttattaatttatttagagatgggattttgctatgttgcctgggctggactccagcaatcctcctgcctcagcagaagtagctggggctacgggtatgcaccacctcaccctgcttatcagtttcgtttaatagaatatttgacttttagatgcgcagatcactacgagatggaatcctgctagctgtgctgtctttccatccgggtcacgcccgagaggcacacagcccaactccttgctgagatcttcatattccgtgtcctactgacgggctgcctgggagacatgagtgacagaaaacctgacactgctctggattctgaaacacctgctgagctctgtcctaggtctctaatccacagcctcccgacttctctcaaacaagttaccaattctacatacaattatacctcagttcactttaaaatgtactatggctacaatcacccttccaacaggaacacacaggaacacatcacatttcaaaatacttgacattcagcaaaataaaaacgtaattggaatcagtgctcacctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctgcaagacaacgcgaggctatggtactcacgtgagttctaagagcaagagcctcacattctggcttcgccatcgaggtaacagtgacgacagttccacccttgcttctaacatattcctaccgcaatttaccccaattctatctcattatctgctgctttaagtacattcttgctacttctctcaagctaacctactcctagagtgactactttcttccaggttctacagaatccctgttctatcgtatcatatgccctgaatagacttctagccaaattccttaaggctgtatgtttttctctctgggaagtttgggcctttatcaatgaaaaaagagaagatacatgaaacataccttgagacgaggtctctctgtcacccaggctagagtgcagtgatgcaatcacgactccccacagccttgagacaaggtctctctgtcacccaggctagagtgcagcaatgcaatcatgactccccgcagccttgagacaaggtctctgtcacccaggctagagtgcagcgatgcaatcatgactccctgcagccttgagacgaggtctctctctgtcacccaggctggagtgcagtgatgcaatcatggctccctctagccttgagacgaggtcactctgtcacccaggctagagtgcagtgatgcaatcacagctccccgcagccttgagacgaggcctctctctgtcacccaggctggagtgcagtgatgcaatcatggctccctgcagccttgagacgaggtcactctgtcacccaggctggagcgtggtgatgcaatcatggctccccacagccttaagctcctagctcaagtgacccccctgcctcagcctcccaaggagttgggactacagctggccactgggccacttaatttaaaaaattttttgtagagatatagtctaggcacgttacccaggctggtctcactcctggcctcaagtgatctgcccacctcagccacccaatgtgccggaattataggtgtgagttactgcacccagcctgaggaaaatactgttcagctggactgtccaatagatagccactgctcaatcactcaagaaattcagccttggttttttttttgttgttgttagacgatcttgctctgttgcccaggctagagtgcaatggcacgatctcggctcactgcaacctctgccccctgggttcaagcgattcttccacctcagcctcctgagcagctgggattataggcatgtgccaccatgcccagctaatttttttgtatttttagtagagatggggtttaaccatgttggccaggctggtcttgaactcctgacctcaagtgatctacccgccttggcctcccaaatgctgggattacaggtatgacccaccacactcggccaagcctcattattaaaactcataaagaagttttagcaataaactcaaatgctaattaagctaattgagattaacaagtctatgttaaaactaataatgaaggaacatgcaataattacatgtgtataacttttttttttgagacagggtcttgctctgtcacccaagctgcagtgcagtggctccatctcagctcactgcaacctctgcctcccaggttcaagcgattctcctgcctcagcctcctgagtagctggggttacaggcacacgccactatgtccgactaatttttgtatttttagcagagacggggtttcaccattttggtcaggctagtctcaaactcctgacttcgtaatccgccttccttggcctcccaaagtgctgggattaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttgccaaagctcccagccaaataaagcccttccttctttaactcggtgtctgaggggatttgtctgcggcttgtcctgctacaggattacaggcgtgagctaccacatccagcacatgtgtataacttcttaaaacattttaagcactgcagtaaatttggtctcaaagttgacacaagaagatccatggccaggtgtagtaagtagctcttgcctataatccaaacagtttggaggctgaagggggaggactgcttgaggctgcagtgagccatgatcgggccactgcaccccagcctgggtgacagagcaagtcaccattgtcaaaaaaaaaaaaaaaaacaaaacaaaaaacaaacaaaaaaaacccaacaactaagatatgtgcaagttgtcaaaatcaaaatggagtcactagtgttaacaaaaatgcaaccctgaagagaagggtctcacccttgtatgtctgataacaaggattaagggtttttttttttcctttttacaaaaactacaaccttacacaaaggccactgcaaccttgcaccaaaaaacttctctcgtgagaaaatctgcctagcaactgcctgtcaaccttggactggtgtcatccttgttattgatcttggtagccaagaataattacctcaaagtaattttgtaatcctcgtcatttgtccttaaaaacttgttttcctttactcctctgaatatgtacatagttgactatagcacaggcattcccattgcaatgccctattcccaaatacagatcacttccttttagagagcctctctccatttgtcatttaaatgaacagacttacctcgcaaaaacagaaagaaactgctgggattccagaatatgcaaggaaagggaaagcagcattgtctaaagtgagtttctcactgcaaagacaaagaatgtgtctttagaaagtgttttaaagaatagactgttctatcgtgctagtccccccatccaaaataaattctttagctgaatatctttaggtgtaagtaagttcaatgcaaggacagatttagattctacctaatgtagtaggtagaatctctgcttttctattagtttgttcattcacttttctcaacttacactttgctggcccagttgctgtcctgatatagaaattgcccagtaaccggatgcttcacctgtaagataagaaattatcattaaaactaaccttttggaacttatttattcaggctagtcactaacatgttactctataacaatttttaaataaaaaacttgtattatatcttcttgaaaagaaattatttatgatagttaaaacaatctcaactttaagttattactaactaggctcatgttgtcagttcctttagttatggtgaggaaaaaatgttttcttcttaattaacattttaaaagtgggcctaggccgggtggggtagttcacaactgcaatcccaacactttgggaggccgagctgggaggatcacttgagcccagaagtttgagactagcctgggcaacacagcaagactttatctcttaaaaaaaaaaaaggaaaaaaaaatgaataaaagctgggcgcggtggctcacacctgtaatcccagcattttgggaggccaaggtcaagagatcatgaggtcaagggattgagaccatcctggccaacatggtgaaaccccgtctctactaaaaatacaaaaattagccaggtgtggtggtgtgcacctgtagtcccagctcctcaggaggctgaggcaggagaatcgcttgaacccaggaggtggaggctgcagtgagccaagatcgcaccattgcactccagcctgagtgctggaggaagacagaggaagactccatctcaaaaacaaacaaacaaacaaacaaaaccatggtggcttacccacaattgtaaaagccctctctgggcttcacactatgcctatcttgtttctggtttcttccttctagtgcatcttatgccaccaacctaactggcaaattcatgatcaccttgcttgagatcctataatccctagtatctcttggatcaaggccaatgtctgctatctgacctgtttctaactttactcactccaatatacagcctctaatcccattaggcaaatattttcttttttatttatttatttattttttttttaattatactttaaattttagggtacatgtgcacattgtgcaggttagttacatatgtatacatgtgccatgctggtgcactgcacccactaactcgtcatctagcgttaggtatatctcccaatgctatccctctcccctccccccaccccacataggcaaatattttctttcacatgctctccctcattcaaaactatggtaattgtttattcaatgaatatttcctccggccttctcaaagtatagttcaagttgatttaagccttccttagcattgtgactctatagacaatcccctgtgggcccctgcactacagcttaggcctcatggcattttgttatatattcctaaataaacaacatattctttaagattggagccctcatctcatatggttcaataggcaagtatcccttaaataacgctgctataaaatttattctcaattcctattttttgttactgactacggtttacatatcagtgttttttatctcaggttgattcaacaaaaattaagtcatacatttttgtaatgaggtatatactcacattttgcattgttttctcaataagcgtatacaacagtgggctggcagaaaccttgaagttgctggtacctgaaaataaattgttttatcattgccccttctccattccgataattttcacactgctacttctacaactataagtacttgacaaataagacagtaatctagatcagtggccctgtgcaacaactatcccattcatcaagtaaacaaaagtaattttggtatcaagctctttagcaactaagctaacttcactcaagtgggctcgtactactccttgagtttgcatactttaatccaagtcaccttttttaaaaatatcagagcagttaggccgggcacggtggctcacgcctgtaatcccaggactttgggaggcccagacgggtggatcacaaggtcaggagatcgagaccatcttggctggcacagtgaaaccccgtctctactaaaaatacaaaaaattagccgggtgtggtggcgggcacctgtagtcccagctactcgggaggctgaggcaggagaatggcatgaacccgggaggcggagcttgcagtgagctgggatggcgccactgcactccagcctgggtgacaaagcgagactccatctcaaaaaaaaaaaaaaaaaaaaaaaaaaaaatcagaccagttttaggttcagcagcaaaattaagagaaaggtacctagaggtcccataaatccactgcccccacacatgtgcagcctcccccattagcaatttcatgtttaactttctggttcacccaggttagagctatacatagtatgcttgctatactcagcacattctgcggcaaacatacaacagggaaataactaacctagagaggtttaattgtaactctttccttttttcccccatgtagacatttcactattctcagctcatcagctacatctgcactttcttttttaccccattcctgttgaatgtacagctgcactttaaataacattcaaacccttttgtcaattttctgctgccagtgaacattcaaactcttctagaagtttcattatccaatatttctatcagtgatgccacaacgtaacaggatgtgaattactctctaagtaccattctatatggcatagtttagtttcttctcacctcaatatagtccagacttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagatggagtctcgctctgtcgcccaggctggagggcaatggcgccatcttggctcactgcaacctctgcctcccgggttcaagtgattctcctacctcagcctcctgagtagctgggattacaggtactcgccaccacacccggctaattttggtatttttagtagagacggggtttcaccatgttggccaggctggtctcgaactcctgacctcaggtgatccgcctgccttggcctcccaagtgctgggattacaggcgtgcaccactgcgcccagcccaaaaagcccagtttttagaccaacactcccatttctgactcaaaggtctggggtagacatgacagtttgcattcgtaacagttcctaatgctactcatctgggggccacactgagaactacccactgttctagacaagcaattgtgctcactgtgtaacttgacagactatttaaaggaaggttaagatacaggctgagggcaatggctcatgcctgtaaccgcagcattttgggcagctgacatagaatgcttgaactcaggagtttgacaccagcctgggcaacatggcaaaaccccatctctacaaaaaaaattagccaggtggctgaagtgggaggatcacctgagcccaggaggtcaaggctgcagtgagccaagattgtgccactgcactctagcctgggcaatacagtgagaccctgtctcaaaaaaaaaaaaaagctttcttccacttcaaagtagtttatctggccaggcacagtggcccacatctgtaatcccaggccgaggcaggcagatcgcctgaggtcaggagttcgagaccatcctggccaacatagtgaagccctgtctctactaaaaatacaaaaaattagctgggtgtggtagtgagcacctgtaatcccagctactcaggaggctaaggcaggagaatcgcttgaatctgggagacagaggttgcagtgagccgagatcgtgccattgcactccagcctgggcgacaagagcaaaactccatctcaaaaaagtttacctgaattcatacacagctaatgaaagggatacttaccaagaaccgctttatccagattaatataagtgaaagcctttaaatgcagggacgaaaggtatccctagaagagaagggaaaacactaataagtataaatctgtttatttatcacatacagtagcattagggattcattttcaattctggactctactgagactaaacgcaaaggcaaaagtggtaaaatcaaacctataaaaacatcacttctggacaacagcctaagcccacaagctcgtgtccaatatgggaagggatgataaagaatacctctagccattcagtggcaccaaccgatccaaagtctccagcactccaactggcaaagataatgcttctgctgggctgaaacccatctgaaagagaaaaaagttagctttacctgaggaaaggttatacacagacaaggatggaaggtatcccacttaagatgaatcagaaggtctaattccaagatagcagattccaaaatcttttttttctgagccaaaaaagaaaaaaaaaactaacaaaatctttttttgagaccccaggtaaaagaataaaagaataggaataattttttttaaagtaacctacaaagagcaagataggagatctgcaaataagattttgagtacatagcaggggccagtagtcaccctttcacaatttcattcttggagttccttaacttctggacccagagatcattgaaaacagtgtaagcatgatgatgcacatcttgagaaaaatcttcagaggtaaatccaaacattggatttttaaaaaaataattctaaaataaaataaaaattcacaaatttaagttacaagaagagtttgcagagaaactatatttgtgacagcaccttttgaggttacatgtatcacactgccctccatccctcccacttccctcactgtatctttttctccattaatgtactctgtattaaagttaagcattgcagtttgccctaagacccaaagattcaagaatgtgacgtgattttgaatgtgtgggtgggtaggagtgtgaaagagtggaaagtaggacagaaaggctcaaaaataaacaaaagaggcagggcacggtggctcactagcagcattttgggaggctgaggcgggtgaatcacttgaggtcaggagactagcctggccaacatggcgaaaccctgtctctagtaaaaatacaaaaattggccgggtgtggttgtgggtgcctgtaatcccagctactcaggaggctgaggcaggagaattgcttgaagtcgggaggcagaggttgcagtgagctaagtgagatcacaccactgcactccagcctgggcaacagagtgaaactctgtctcaaaaaatgaataaatgaataaacagaacaaaatttcaatagctgttaggcctcagtacatgagtagagaggtatgctactgctttcaaatagattgcttagggactatgatccaccttatcactctggatccaccacactaagcactagggctcagtaactccactgtctcaaagaaactggtgatttctagcacagttaagacactttatggaaagctgtttcaaaggaaaaggcagctacaacaaaagacaatctgccttgtatttaagaactagagtctagcatgagaaccacaggaatgcaggcaaagtgagcaaagcacagtataacatctagaactgtatgcagtgcaccaatattcaaaagaatcaaaatttgtactctaccttttaagaccatatctgagaacatctgggcaagtttcaataggagagctgtgcctacaccggattttgcagctccagggccccatgcatctctctgggccccaactacaacatagtgatctttaaaaaagaaaaaagaggaagaaagaacttatataatcagcttctaaacttttctagaattagcacatcagtagaaaggtaaaagcacagtatatgtattaaggataaaagagccttacttcaaatctgactaaaaactctgggaattaaaaattcacatgagaatattaattttaccttactagtagagctacttttttcctacactactaattaaatttactgactacttaagtccaaggacttatttcttagtaagtgttggctgtttgattgcatttaaagttaactccagggactggcaaactacagcccgcatgcccattcactacgcacagtctgtgcctgttttcttgctcccacagagttgaacagctaaaagagagactgtatagcctggcaaaaggtttattatctgcccccttaagaaatttgcttatcactggtctagtcaataacttagaatagattttctagtcataatggtcaatttttaacaagaatttcctagggccttattacctcccaataaaactgacacataggctgggcgcggtggctcatgcctgtaatcccagcactttgggaggctgagggaggcagatcacctgaggtcaggagctctgacctcatggagcctgaccaacatggagaaaccctgtctctactaaaaatacaaaattagccaggcgtggtggcgcatgcctgtaatcccagctactggggaggctgaggcaggagaatggcttgaacctgggaggcggaaattgcagtgagccgagatcacaccactgcactccagcctgggcaacaagagtgaaactctttctcaaaaaaaaaaaaaagaaactaacacataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttccaaccagattaaattcaatgacaggtatagaatctactcatgattgtcttcctagtggcacttaaaaaggcataaagtggacgggaaagtggctcatgcctgtaatcccagcactctgggaggctgaggcgggcagatcacgaggtcaggagttagagaccagcctgaccaacatggtgaaaccccgtctctactaaaaatacaaaaattagccaggtgtggtggtgcacgcctgtagtcccagctcctcaggaggctgaggcagaagaatcgcttgaacctgggaggcggagattgcagtgagccgaaatcacgccactgcactccagcctgagccacagagtgagactccaactcaaaaaaaaaaaaaaaaaaattagccaggtgtggtcgtgggcgcctatagtcccagctactcaggaggctaaggcagagaatcgcttaaacctgggaggctgaggttgcagtgagccaacatggtgccactgcactctagcctaggcaagagagtaagcctctgtctccaaaaaaaaaaaaaaaaaaaataaggtacaaaataactatatgctgagctgacataacagacttcccagagttggttatagaaaacattgaagtttggaatggtcattctcaccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaactgtgttgcggaaaaaggcatgatgaagaacaggcacgggaatgtttaggaaaagctcgtttaggtatatgcttgttattgggccattactataacttgctatatattccttagggtgttctcctttcaaaccaacattcttccctgggcccagtcaagggctagttcacactggtcttctcagtcagtctctccctttttgtaaatttttttttttttttgagacaaggtctccctctctctcccaggatggagtacagtggtgtgatcacagctcactgcagcctcaaaatcctgggctctactgattcccccacctcagcctcctgagtagctgggactaggggcacaaatcagttcaggatactatgcagtaacccagaccatgatgttggtgggagcaagggagcaagaataaaacaaagttataaataagcagaaattctgactaagcataagatagaagacagaaaagagagaatagaccagacacagtggctcatgcctgtaatcccagcactctggggggggccgaggcacacagatcatttatggtcagaagtttgagacaagcctgaccaacatggtgaaatcccctctcactaaaaattcaaaaaaaaaaaaaccactagctgggcatggtgtcgcacgcctgtaatctcagccacccaggaggctgaggcaggagaatcgcttgaactcaggaggcggaggttacagtgagctaagattgcacactgcattccaacctgggcaacagagcccaggctgagactccatctcaaaaaataaaataaaaataaataaataaataaatacaaataagagagaattgaggtctagacagagtgttaagagttaggctccttctcgtcatggcctggatggctgttttttttgtatgttctttcagctttcactcatactgtctactcaatgtttcttaaaatttcattttttttttaatagagatgggcttgctatgttgcccaggcaagtctcaaactcctcaagtgatcctcctgcctcacctcccaaactgctgggattgcgggagtgagccaccacacttggcctcattcagcctttgcttttttttttttttttgagacggagtctcactctgttgcccaggctggagtgcaatggcgtgatctcagctcattgcaacctccgcctcccgggttcaagcaattctcctgcctcagcctcccaagtagctgggactacaggcatgcgccatgacactcagctaattttttttttttttgtatttttagtagagaccgagtttcaccatgttggtcaggctggtcttgaactcctgaccacaggtgatccacccacctcagcctcccaaagtgctgggattacaggcgtgagccacagcgccccgcaagcctttgctttttacttctcctactaaaacattttgatcagggctttaattcgtcttatctactaagctgtccccgtctaccacacccagaaccactctgagaattcttccaagactttccataattaaccctactgaaggctgaactctttgtgagatcagttatgcctcaagactaccaattcaaatgtaaatgaatacctgataatagattggggttattatttcatgcttactcagttaaagtcatgcttgtatatttcacattcttgcagacacagaaatacaactgaaaatatcttaccaagttagagaatgctgatctagcttgatccatcattctgaactgccacacagaagaacctaggtatcagaatagagaattattgagaaagatactactgtatcagattagtgagctttctattaccaggctaaatgatacattaaatttttaaaatacattatcacttttctagaaaaggtatttaaccatagtttacatgacaactaaattaagtgggatcctttttaaagtttgttatatacataattctttttttttctttttgtagagacaaggtcaccctatgttgcccaggctggtcttgaactcctggcctcaaacaatcctcccaccttggcctcccaaagtgctgcaattataagtacgaaccactatgttctgagtagacaaaagtgacacatactgctgggcggggtggctcacacctgtaatcctagcactttgggaggctgagatgggtggatcacctgaggtcaggagttcaagaccagcctggccaacatggagaaaccctgtctctactaaaaatacaaaaattagccggacgtggtggtgggcgcctgtaatcccagccactcgggagcctgaggcaggagaatggcgtgaacccaggaggtggagcttgcagtgagccaagatcgcgccactgcactccagcctggaaaacaagagcaaaactctgtctcaaaaaaaaaagaaagtgacacatacaaaaagacaaaattaagactaaggcagacaagaccagttatgctacaaataccacaaaccatctccaatgggaaggggaagaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctctgaggggatggcggcccctaaccggcggtttatagcctggccccgcccccggcccccaggggggctgtgcgt

SEQ ID NO: 2794 - DNA, 32807 bp, Homo sapiens
  source 1..32807: mol_type = genomic DNA
tcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagacactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccacctacgaaaacaacacacaaggcaatttacacagccctgtgacttttgtagtaaaacaacagttcacttcaaatgtaaaatgtcccaaatttaagaatgccgatcagactttttttttttttttttttttttgacacagagtttcgctcttgttgcccagactggagtgcaacagcgctatctcggctcactggtaccctccacctcccgagttcaagcaattcatgctgggattacaggtgtgagccaccgtgcccggctttttgttgttgttgagacagagtttcgctcttgttgcccaggctggagtacaatggcgcgatctcagctcactgcaacctccacctcccgggttcaagtaattctcctgcctcagcctcctgagcagctggaattacaggcatgcaccaccacgcccagctaatttttgtatttttagtagagatggggtttctccatgttggtcaggctggtcttgaactcctgacctcaggtgatccgcttgcctcggcctcccaaagtactggaattacaggcatgagccactgtacccagccagctgatcagactttctatagcagagtaaggaaaaaagaatgctgagaaccaggctaatgctaatcttctaaggttaaaattctaaaggaggctaggcacagcggctcacgcttgtaataccagcactttgggaggccaaggcaggtggatcacttgaggttgggagttcgagaccggcctggctaacatggtgaaactccgtttctactaaaaatacaaaaaatgagccgggcgtggtgttgggcacctgtaatcacagcaactcgggaggctaaggcaggagaatcacttgaacctgggaggtggagggtgcagtgagccgagaccgtgccattgcactccagcttgggcaacaacagtgaaactctgtctcaaaaaaaaaaaaaatttttttaaaggaaactgattcattttacaaaggaaaactttaaatgtgttcagattcttttccccattggagcatacatggaagttttacagcaagtctcttccaaaaagactaggtttgactaagttctgaattagacagcagaaacagaaaatgacagctaaaccattaatgctcccttcttaaaggaattctagactcctagagtttgtccactttgcagaagtgtaagatttatcggttattttacacatactttagttcctcctttcccaaaagttcacttactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctgaaacagacattattcgctatgagaagttttatttctaaggacattcttttgtatgcctttctaatttaacgtgcgttaagtaagattctgataaaaggaactcgcagataagctcaagactccgaaagcaccttgcacaggggttccaagctctatggactgtgatatacactcatatttgagcccagcatgtaagaaaaccattctcattaagaaattgaacataattatataatcctatgtactatattgtttccagttcaattctccttttgggggaaaatgtccctataggggaaaacattttggttcaaggtacttcaggatttagttatttccacctggtaagttccattttcaacagttacaattagtttcaagaaagacataagatgccgggcgtggtggctcatgcctgtgatcccagcactttgggaggccgaggtgggtggatcacctgaggtcaggagttcaagaccagcctggccaacatggtaaaaccccggctctactaaaaatacaaaaaattagccgggcgtggtggccggcacctgtagtcccagctactcgggaggcttaggcaggagaatggcgtgaacccgggaggcgcatcttacagtgagccgagatctcgccactgcacttcagcctggccaacatggtaaaaccccggcttctactaaaaacacaaaaactatctgggcatggtggcacacgcctgtaatcccagctacctggggagccgaggcaggagaatcgcttaaagccgggaggtggaggttgcagtgagccgagatcatgtcattgcattccagcctgggggacaagagcgagacttcatctctcaaaaaaaataaaataaaaataaaaataaaaaagatataaaaagattcggttgtcagtgatttacttcaattaagagatctgttaaaaatcaactcctagtaccataaaacaatctggaagctactttaatattagttttattaatttatttagagatgggattttgctatgttgcctgggctggactccagcaatcctcctgcctcagcagaagtagctggggctacgggtatgcaccacctcaccctgcttatcagtttcgtttaatagaatatttgacttttagatgcgcagatcactacgagatggaatcctgctagctgtgctgtctttccatccgggtcacgcccgagaggcacacagcccaactccttgctgagatcttcatattccgtgtcctactgacgggctgcctgggagacatgagtgacagaaaacctgacactgctctggattctgaaacacctgctgagctctgtcctaggtctctaatccacagcctcccgacttctctcaaacaagttaccaattctacatacaattatacctcagttcactttaaaatgtactatggctacaatcacccttccaacaggaacacacaggaacacatcacatttcaaaatacttgacattcagcaaaataaaaacgtaattggaatcagtgctcacctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctgcaagacaacgcgaggctatggtactcacgtgagttctaagagcaagagcctcacattctggcttcgccatcgaggtaacagtgacgacagttccacccttgcttctaacatattcctaccgcaatttaccccaattctatctcattatctgctgctttaagtacattcttgctacttctctcaagctaacctactcctagagtgactactttcttccaggttctacagaatccctgttctatcgtatcatatgccctgaatagacttctagccaaattccttaaggctgtatgtttttctctctgggaagtttgggcctttatcaatgaaaaaagagaagatacatgaaacataccttgagacgaggtctctctgtcacccaggctagagtgcagtgatgcaatcacgactccccacagccttgagacaaggtctctctgtcacccaggctagagtgcagcaatgcaatcatgactccccgcagccttgagacaaggtctctgtcacccaggctagagtgcagcgatgcaatcatgactccctgcagccttgagacgaggtctctctctgtcacccaggctggagtgcagtgatgcaatcatggctccctctagccttgagacgaggtcactctgtcacccaggctagagtgcagtgatgcaatcacagctccccgcagccttgagacgaggcctctctctgtcacccaggctggagtgcagtgatgcaatcatggctccctgcagccttgagacgaggtcactctgtcacccaggctggagcgtggtgatgcaatcatggctccccacagccttaagctcctagctcaagtgacccccctgcctcagcctcccaaggagttgggactacagctggccactgggccacttaatttaaaaaattttttgtagagatatagtctaggcacgttacccaggctggtctcactcctggcctcaagtgatctgcccacctcagccacccaatgtgccggaattataggtgtgagttactgcacccagcctgaggaaaatactgttcagctggactgtccaatagatagccactgctcaatcactcaagaaattcagccttggttttttttttgttgttgttagacgatcttgctctgttgcccaggctagagtgcaatggcacgatctcggctcactgcaacctctgccccctgggttcaagcgattcttccacctcagcctcctgagcagctgggattataggcatgtgccaccatgcccagctaatttttttgtatttttagtagagatggggtttaaccatgttggccaggctggtcttgaactcctgacctcaagtgatctacccgccttggcctcccaaatgctgggattacaggtatgacccaccacactcggccaagcctcattattaaaactcataaagaagttttagcaataaactcaaatgctaattaagctaattgagattaacaagtctatgttaaaactaataatgaaggaacatgcaataattacatgtgtataacttttttttttgagacagggtcttgctctgtcacccaagctgcagtgcagtggctccatctcagctcactgcaacctctgcctcccaggttcaagcgattctcctgcctcagcctcctgagtagctggggttacaggcacacgccactatgtccgactaatttttgtatttttagcagagacggggtttcaccattttggtcaggctagtctcaaactcctgacttcgtaatccgccttccttggcctcccaaagtgctgggattaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttgccaaagctcccagccaaataaagcccttccttctttaactcggtgtctgaggggatttgtctgcggcttgtcctgctacaggattacaggcgtgagctaccacatccagcacatgtgtataacttcttaaaacattttaagcactgcagtaaatttggtctcaaagttgacacaagaagatccatggccaggtgtagtaagtagctcttgcctataatccaaacagtttggaggctgaagggggaggactgcttgaggctgcagtgagccatgatcgggccactgcaccccagcctgggtgacagagcaagtcaccattgtcaaaaaaaaaaaaaaaaacaaaacaaaaaacaaacaaaaaaaacccaacaactaagatatgtgcaagttgtcaaaatcaaaatggagtcactagtgttaacaaaaatgcaaccctgaagagaagggtctcacccttgtatgtctgataacaaggattaagggtttttttttttcctttttacaaaaactacaaccttacacaaaggccactgcaaccttgcaccaaaaaacttctctcgtgagaaaatctgcctagcaactgcctgtcaaccttggactggtgtcatccttgttattgatcttggtagccaagaataattacctcaaagtaattttgtaatcctcgtcatttgtccttaaaaacttgttttcctttactcctctgaatatgtacatagttgactatagcacaggcattcccattgcaatgccctattcccaaatacagatcacttccttttagagagcctctctccatttgtcatttaaatgaacagacttacctcgcaaaaacagaaagaaactgctgggattccagaatatgcaaggaaagggaaagcagcattgtctaaagtgagtttctcactgcaaagacaaagaatgtgtctttagaaagtgttttaaagaatagactgttctatcgtgctagtccccccatccaaaataaattctttagctgaatatctttaggtgtaagtaagttcaatgcaaggacagatttagattctacctaatgtagtaggtagaatctctgcttttctattagtttgttcattcacttttctcaacttacactttgctggcccagttgctgtcctgatatagaaattgcccagtaaccggatgcttcacctgtaagataagaaattatcattaaaactaaccttttggaacttatttattcaggctagtcactaacatgttactctataacaatttttaaataaaaaacttgtattatatcttcttgaaaagaaattatttatgatagttaaaacaatctcaactttaagttattactaactaggctcatgttgtcagttcctttagttatggtgaggaaaaaatgttttcttcttaattaacattttaaaagtgggcctaggccgggtggggtagttcacaactgcaatcccaacactttgggaggccgagctgggaggatcacttgagcccagaagtttgagactagcctgggcaacacagcaagactttatctcttaaaaaaaaaaaaggaaaaaaaaatgaataaaagctgggcgcggtggctcacacctgtaatcccagcattttgggaggccaaggtcaagagatcatgaggtcaagggattgagaccatcctggccaacatggtgaaaccccgtctctactaaaaatacaaaaattagccaggtgtggtggtgtgcacctgtagtcccagctcctcaggaggctgaggcaggagaatcgcttgaacccaggaggtggaggctgcagtgagccaagatcgcaccattgcactccagcctgagtgctggaggaagacagaggaagactccatctcaaaaacaaacaaacaaacaaacaaaaccatggtggcttacccacaattgtaaaagccctctctgggcttcacactatgcctatcttgtttctggtttcttccttctagtgcatcttatgccaccaacctaactggcaaattcatgatcaccttgcttgagatcctataatccctagtatctcttggatcaaggccaatgtctgctatctgacctgtttctaactttactcactccaatatacagcctctaatcccattaggcaaatattttcttttttatttatttatttattttttttttaattatactttaaattttagggtacatgtgcacattgtgcaggttagttacatatgtatacatgtgccatgctggtgcactgcacccactaactcgtcatctagcgttaggtatatctcccaatgctatccctctcccctccccccaccccacataggcaaatattttctttcacatgctctccctcattcaaaactatggtaattgtttattcaatgaatatttcctccggccttctcaaagtatagttcaagttgatttaagccttccttagcattgtgactctatagacaatcccctgtgggcccctgcactacagcttaggcctcatggcattttgttatatattcctaaataaacaacatattctttaagattggagccctcatctcatatggttcaataggcaagtatcccttaaataacgctgctataaaatttattctcaattcctattttttgttactgactacggtttacatatcagtgttttttatctcaggttgattcaacaaaaattaagtcatacatttttgtaatgaggtatatactcacattttgcattgttttctcaataagcgtatacaacagtgggctggcagaaaccttgaagttgctggtacctgaaaataaattgttttatcattgccccttctccattccgataattttcacactgctacttctacaactataagtacttgacaaataagacagtaatctagatcagtggccctgtgcaacaactatcccattcatcaagtaaacaaaagtaattttggtatcaagctctttagcaactaagctaacttcactcaagtgggctcgtactactccttgagtttgcatactttaatccaagtcaccttttttaaaaatatcagagcagttaggccgggcacggtggctcacgcctgtaatcccaggactttgggaggcccagacgggtggatcacaaggtcaggagatcgagaccatcttggctggcacagtgaaaccccgtctctactaaaaatacaaaaaattagccgggtgtggtggcgggcacctgtagtcccagctactcgggaggctgaggcaggagaatggcatgaacccgggaggcggagcttgcagtgagctgggatggcgccactgcactccagcctgggtgacaaagcgagactccatctcaaaaaaaaaaaaaaaaaaaaaaaaaaaaatcagaccagttttaggttcagcagcaaaattaagagaaaggtacctagaggtcccataaatccactgcccccacacatgtgcagcctcccccattagcaatttcatgtttaactttctggttcacccaggttagagctatacatagtatgcttgctatactcagcacattctgcggcaaacatacaacagggaaataactaacctagagaggtttaattgtaactctttccttttttcccccatgtagacatttcactattctcagctcatcagctacatctgcactttcttttttaccccattcctgttgaatgtacagctgcactttaaataacattcaaacccttttgtcaattttctgctgccagtgaacattcaaactcttctagaagtttcattatccaatatttctatcagtgatgccacaacgtaacaggatgtgaattactctctaagtaccattctatatggcatagtttagtttcttctcacctcaatatagtccagacttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagatggagtctcgctctgtcgcccaggctggagggcaatggcgccatcttggctcactgcaacctctgcctcccgggttcaagtgattctcctacctcagcctcctgagtagctgggattacaggtactcgccaccacacccggctaattttggtatttttagtagagacggggtttcaccatgttggccaggctggtctcgaactcctgacctcaggtgatccgcctgccttggcctcccaagtgctgggattacaggcgtgcaccactgcgcccagcccaaaaagcccagtttttagaccaacactcccatttctgactcaaaggtctggggtagacatgacagtttgcattcgtaacagttcctaatgctactcatctgggggccacactgagaactacccactgttctagacaagcaattgtgctcactgtgtaacttgacagactatttaaaggaaggttaagatacaggctgagggcaatggctcatgcctgtaaccgcagcattttgggcagctgacatagaatgcttgaactcaggagtttgacaccagcctgggcaacatggcaaaaccccatctctacaaaaaaaattagccaggtggctgaagtgggaggatcacctgagcccaggaggtcaaggctgcagtgagccaagattgtgccactgcactctagcctgggcaatacagtgagaccctgtctcaaaaaaaaaaaaaagctttcttccacttcaaagtagtttatctggccaggcacagtggcccacatctgtaatcccaggccgaggcaggcagatcgcctgaggtcaggagttcgagaccatcctggccaacatagtgaagccctgtctctactaaaaatacaaaaaattagctgggtgtggtagtgagcacctgtaatcccagctactcaggaggctaaggcaggagaatcgcttgaatctgggagacagaggttgcagtgagccgagatcgtgccattgcactccagcctgggcgacaagagcaaaactccatctcaaaaaagtttacctgaattcatacacagctaatgaaagggatacttaccaagaaccgctttatccagattaatataagtgaaagcctttaaatgcagggacgaaaggtatccctagaagagaagggaaaacactaataagtataaatctgtttatttatcacatacagtagcattagggattcattttcaattctggactctactgagactaaacgcaaaggcaaaagtggtaaaatcaaacctataaaaacatcacttctggacaacagcctaagcccacaagctcgtgtccaatatgggaagggatgataaagaatacctctagccattcagtggcaccaaccgatccaaagtctccagcactccaactggcaaagataatgcttctgctgggctgaaacccatctgaaagagaaaaaagttagctttacctgaggaaaggttatacacagacaaggatggaaggtatcccacttaagatgaatcagaaggtctaattccaagatagcagattccaaaatcttttttttctgagccaaaaaagaaaaaaaaaactaacaaaatctttttttgagaccccaggtaaaagaataaaagaataggaataattttttttaaagtaacctacaaagagcaagataggagatctgcaaataagattttgagtacatagcaggggccagtagtcaccctttcacaatttcattcttggagttccttaacttctggacccagagatcattgaaaacagtgtaagcatgatgatgcacatcttgagaaaaatcttcagaggtaaatccaaacattggatttttaaaaaaataattctaaaataaaataaaaattcacaaatttaagttacaagaagagtttgcagagaaactatatttgtgacagcaccttttgaggttacatgtatcacactgccctccatccctcccacttccctcactgtatctttttctccattaatgtactctgtattaaagttaagcattgcagtttgccctaagacccaaagattcaagaatgtgacgtgattttgaatgtgtgggtgggtaggagtgtgaaagagtggaaagtaggacagaaaggctcaaaaataaacaaaagaggcagggcacggtggctcactagcagcattttgggaggctgaggcgggtgaatcacttgaggtcaggagactagcctggccaacatggcgaaaccctgtctctagtaaaaatacaaaaattggccgggtgtggttgtgggtgcctgtaatcccagctactcaggaggctgaggcaggagaattgcttgaagtcgggaggcagaggttgcagtgagctaagtgagatcacaccactgcactccagcctgggcaacagagtgaaactctgtctcaaaaaatgaataaatgaataaacagaacaaaatttcaatagctgttaggcctcagtacatgagtagagaggtatgctactgctttcaaatagattgcttagggactatgatccaccttatcactctggatccaccacactaagcactagggctcagtaactccactgtctcaaagaaactggtgatttctagcacagttaagacactttatggaaagctgtttcaaaggaaaaggcagctacaacaaaagacaatctgccttgtatttaagaactagagtctagcatgagaaccacaggaatgcaggcaaagtgagcaaagcacagtataacatctagaactgtatgcagtgcaccaatattcaaaagaatcaaaatttgtactctaccttttaagaccatatctgagaacatctgggcaagtttcaataggagagctgtgcctacaccggattttgcagctccagggccccatgcatctctctgggccccaactacaacatagtgatctttaaaaaagaaaaaagaggaagaaagaacttatataatcagcttctaaacttttctagaattagcacatcagtagaaaggtaaaagcacagtatatgtattaaggataaaagagccttacttcaaatctgactaaaaactctgggaattaaaaattcacatgagaatattaattttaccttactagtagagctacttttttcctacactactaattaaatttactgactacttaagtccaaggacttatttcttagtaagtgttggctgtttgattgcatttaaagttaactccagggactggcaaactacagcccgcatgcccattcactacgcacagtctgtgcctgttttcttgctcccacagagttgaacagctaaaagagagactgtatagcctggcaaaaggtttattatctgcccccttaagaaatttgcttatcactggtctagtcaataacttagaatagattttctagtcataatggtcaatttttaacaagaatttcctagggccttattacctcccaataaaactgacacataggctgggcgcggtggctcatgcctgtaatcccagcactttgggaggctgagggaggcagatcacctgaggtcaggagctctgacctcatggagcctgaccaacatggagaaaccctgtctctactaaaaatacaaaattagccaggcgtggtggcgcatgcctgtaatcccagctactggggaggctgaggcaggagaatggcttgaacctgggaggcggaaattgcagtgagccgagatcacaccactgcactccagcctgggcaacaagagtgaaactctttctcaaaaaaaaaaaaaagaaactaacacataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttccaaccagattaaattcaatgacaggtatagaatctactcatgattgtcttcctagtggcacttaaaaaggcataaagtggacgggaaagtggctcatgcctgtaatcccagcactctgggaggctgaggcgggcagatcacgaggtcaggagttagagaccagcctgaccaacatggtgaaaccccgtctctactaaaaatacaaaaattagccaggtgtggtggtgcacgcctgtagtcccagctcctcaggaggctgaggcagaagaatcgcttgaacctgggaggcggagattgcagtgagccgaaatcacgccactgcactccagcctgagccacagagtgagactccaactcaaaaaaaaaaaaaaaaaaattagccaggtgtggtcgtgggcgcctatagtcccagctactcaggaggctaaggcagagaatcgcttaaacctgggaggctgaggttgcagtgagccaacatggtgccactgcactctagcctaggcaagagagtaagcctctgtctccaaaaaaaaaaaaaaaaaaaataaggtacaaaataactatatgctgagctgacataacagacttcccagagttggttatagaaaacattgaagtttggaatggtcattctcaccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaactgtgttgcggaaaaaggcatgatgaagaacaggcacgggaatgtttaggaaaagctcgtttaggtatatgcttgttattgggccattactataacttgctatatattccttagggtgttctcctttcaaaccaacattcttccctgggcccagtcaagggctagttcacactggtcttctcagtcagtctctccctttttgtaaatttttttttttttttgagacaaggtctccctctctctcccaggatggagtacagtggtgtgatcacagctcactgcagcctcaaaatcctgggctctactgattcccccacctcagcctcctgagtagctgggactaggggcacaaatcagttcaggatactatgcagtaacccagaccatgatgttggtgggagcaagggagcaagaataaaacaaagttataaataagcagaaattctgactaagcataagatagaagacagaaaagagagaatagaccagacacagtggctcatgcctgtaatcccagcactctggggggggccgaggcacacagatcatttatggtcagaagtttgagacaagcctgaccaacatggtgaaatcccctctcactaaaaattcaaaaaaaaaaaaaccactagctgggcatggtgtcgcacgcctgtaatctcagccacccaggaggctgaggcaggagaatcgcttgaactcaggaggcggaggttacagtgagctaagattgcacactgcattccaacctgggcaacagagcccaggctgagactccatctcaaaaaataaaataaaaataaataaataaataaatacaaataagagagaattgaggtctagacagagtgttaagagttaggctccttctcgtcatggcctggatggctgttttttttgtatgttctttcagctttcactcatactgtctactcaatgtttcttaaaatttcattttttttttaatagagatgggcttgctatgttgcccaggcaagtctcaaactcctcaagtgatcctcctgcctcacctcccaaactgctgggattgcgggagtgagccaccacacttggcctcattcagcctttgcttttttttttttttttgagacggagtctcactctgttgcccaggctggagtgcaatggcgtgatctcagctcattgcaacctccgcctcccgggttcaagcaattctcctgcctcagcctcccaagtagctgggactacaggcatgcgccatgacactcagctaattttttttttttttgtatttttagtagagaccgagtttcaccatgttggtcaggctggtcttgaactcctgaccacaggtgatccacccacctcagcctcccaaagtgctgggattacaggcgtgagccacagcgccccgcaagcctttgctttttacttctcctactaaaacattttgatcagggctttaattcgtcttatctactaagctgtccccgtctaccacacccagaaccactctgagaattcttccaagactttccataattaaccctactgaaggctgaactctttgtgagatcagttatgcctcaagactaccaattcaaatgtaaatgaatacctgataatagattggggttattatttcatgcttactcagttaaagtcatgcttgtatatttcacattcttgcagacacagaaatacaactgaaaatatcttaccaagttagagaatgctgatctagcttgatccatcattctgaactgccacacagaagaacctaggtatcagaatagagaattattgagaaagatactactgtatcagattagtgagctttctattaccaggctaaatgatacattaaatttttaaaatacattatcacttttctagaaaaggtatttaaccatagtttacatgacaactaaattaagtgggatcctttttaaagtttgttatatacataattctttttttttctttttgtagagacaaggtcaccctatgttgcccaggctggtcttgaactcctggcctcaaacaatcctcccaccttggcctcccaaagtgctgcaattataagtacgaaccactatgttctgagtagacaaaagtgacacatactgctgggcggggtggctcacacctgtaatcctagcactttgggaggctgagatgggtggatcacctgaggtcaggagttcaagaccagcctggccaacatggagaaaccctgtctctactaaaaatacaaaaattagccggacgtggtggtgggcgcctgtaatcccagccactcgggagcctgaggcaggagaatggcgtgaacccaggaggtggagcttgcagtgagccaagatcgcgccactgcactccagcctggaaaacaagagcaaaactctgtctcaaaaaaaaaagaaagtgacacatacaaaaagacaaaattaagactaaggcagacaagaccagttatgctacaaataccacaaaccatctccaatgggaaggggaagaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctct

SEQ ID NO: 2795 - DNA, 4032 bp, Homo sapiens
  source 1..4032: mol_type = genomic DNA
tgggattcgccagatgccccaggaagggtttatttaattcattccaacaaatgatcctataatgcatttatgcatttaaaagcacagagacacaagtcctcatatatgaagttgttatggttacagaaagaaaataaatatttgtgcacacagagatagcatgaaatcattctacagtgaaaataatagcctctggaaaaagctttgaaaatcagagatggtgccaccaccagacaacacaagtgctggggtacagggcagccctccatgcatctcatagcatttgcatggtttgtgagccccatttaatgacataaaatgagggcactgagggaggaaaagtgaacagacacacaacccgagagcacattgttatttgtttattttgtacaagtgatgtcataagcaaggattttgcctgtgttctagattatctccaataaataaataactatgtacaaatattttgagtttacaaaatagaagaggaaaacctttgtcttacaaaagttacatttctatgatacatttatttccatacactgaagcaggatttcattcctagcttagctgaaccaaagaccttgcagaccctgtgtggcagtgtctagagctgtgtacctagccttttctaccaaagagcaaagctacacaaagaaaattcctcagtttcttgaaaataagggcctgacttggcctgctacttataactgatctatatttcatgtattccagaaaattggaagcagtctggaatggttgtcctcaaattactgagcagacacaccccctgcagatcttgttaaatatagattctcatgaactggatggggtggagcctaggattctgcatttctaaccagctcccatgggcagggcagcttccaattcttgttcaggggccacattccaaaaggcctctctgaaatggtagaaattctctgaggacctgattaaggctaggccctaattgggcatcctccaggatccattcccaagctcccaattccacaagaccagtagagctggttttattttggtctaccagtgacaaggaacagtgacagtcaattgctaattggcatgaatcatgcagtttgaagctttcttgaactgtctcctgggaggtgtttgtctcttctctcaatctagagcaaccttctgaacattttcaacactgtcaaaaataagtaataataacaaaaaaggaaattgcataagaagattagcaacaattaccatttttcagtacaaatcaaaacagcaacaaaattcaggctcactgtttaaaagtaaagataaatacctctttgggtgtaatttctatgacagtccagcaacatcaatttaataccttttacatctcaacctttgtttaaaattattttgctctgggaatctgaaatttcaggataaattagcaaatctggtgaaaaagcaaatggccatttttatttttagtgtttttgtttctgtttcatgtaggggttctgtctgagcagacagctaagagcaaaagaagtagggtcaggcacaggtagggtgactcaggtgagttggcccagttcctgggaggagaaaactaggaagaatggggaataagtggggcttgcttcataaatgtgagagggctaggaaaaaaaaattcaccaagatagtttacctgtcacatgacaagtgggagtttgtagagagagagagaccggagagctgtgcaaagtggatactggagacatacaggtaagaacaaaggaaacaaacaaaaacctaaatacttaaaaaaaataaatattttagtcatccctagcccacgaggtcaaggtctgcccagaaggctgccgaccaataacgctcaccctcctgcgcccggtagtgaggacctgggacaaatcgcagtctgtgtcttcgttacaaaattgccatcattgcccagtggtccagtgacgtcacggaagaggccgaggctcattctcctccctctaatcaccccctcgccagttagccatggaatagaagaaaacagcttggggggtgcggggagggtcttctccagctgtaatgccagctaaggtgctttggtagcaaagctgggggtgaggaggcacaggctcctggacggagccaggctcctggacggaggccgctcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgggcgtcgggctgggcgggggctcgccagagccgctgtcgccaccgtccaccttgccggagtcacagtcggtgccaatgtggcgggcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcatgttacccaggcgcgccgcgtgcaggcgccggggaaagcgcgggcactgcgacagggccgtgccggagcagaggggcacaggacgccgatggcgacagcctctcctgtccgtcccagcccagacacttcttgccgctgcgcgcagcccctgcgaggcagcc

SEQ ID NO: 2796 - DNA, 16389 bp, Homo sapiens
  source 1..16389: mol_type = genomic DNA
agccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttcccctgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccaggtgagtttgtgtggcacctttaggggaaggagggacaaggaagaggtgctggctatcccaggtgtgccccctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattcctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagcccgttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagtttggaggttcacctggcttatctattaatagcaaagtatttgaatttgcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgatgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctgtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataatactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcattttttttcctcattcttttttacttagtcattacttaagctcgctgagtccaacactggctctaccacaaaataagtgcttaatatatatttactgggccaaggccagatacctaaaagatcaatgacagtagagaaagatggttgattttactcaaaaaaatctaaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttata

SEQ ID NO: 2797 - DNA, 3030 bp, Homo sapiens
  source 1..3030: mol_type = genomic DNA
ttaacaaatccaaagtttaattattaaggattacaaatatttttagcagtgtagttaggcaatccaagcctggacttccacttcattcctactaaactacttgcagagctgaggaggcaggagactagagtacagagagcattttagttctatcacaaaggtctagaactgtctctacagtcacaggaagaaacaggtatggcaccgtggccagaagggggtaggtattcacagagagtgggtatcaaggtgtcaaactttgtcttctgatagttttccagagattcctgtagagaagggagcagggagagcctactatccgaaaccattccctgaaccctctgaattctgaagcatgtggatttctcagtcttgttctacccatcccctttcccagctttctgctccttcccactcacctttccttccccctggccattttcttcctcatcagagtctaaaaccaagtcccctatggtaatgacggagctgcacagagacggaggacacactgtaggagggaaaccagaatcaaactactacttctagatgaacacaggctcttgagagtccccaagagaggaggctgttgatccaatcctgactcagactacctacctggcttcctggccctaggaggtaataatgatagtctcagggggtccatgtagcaatccaagcaattcctgaggtgagagcaagcaaagaggataggatgaagggaaggcaggcaaagaatgtgctcctagtaagaagcaactctgttccactcactccttttgctctgtggcaggcaagtcaactgggttctccttcagagcccttccccccagggtctggcatggactcttagacttcccagtggaggctgctcttgtgcccatggctaggtctgctgtgtatatcgcatgttcttccttgctctcaggcttagatatgacctgggttggtgagccgagattcctaaagggaaacagcatgactgtggggcgctccttatggcctcccctagtggaggcccattgggactgaactcttcgtcggcctagaggggccagattgaagtgtcggccagctagaggttctgggtgcgtccttgaagatggtccctgaggaagatgtgtgccaggcttggcttttggcaggggattgtggagtgctagtctttgttgctgaggaggattctgttccatgggctcagccaggttcactgagtcagtaacagagcactctgaaaaagaaaatgaggccccttataaagagaacagatagtaacagaataactggtttcttatgcccggagcccatggaactattccagtggactgcctcaaaaggtctcaggctaaacactacacctccaaattcctagtacctggaagcagccaccccatgtccacaccatattgtctccaggcaagagaagaggtgatagagactccaggctgcatccaactcagcacatcctgaagctgtgggcagggacagaggtatgaagaccacaatccttgaaacagccaccccacactctgcccttacatgttttgccccagcgaaacctgctgtgcctgcggtgtaggcagtgctttctccagctgacacaagtactcaaaaagcagcttttccatggcagccagaaagggttccccatactcttgttcaagttcctacagcaggggagattaggtcaaaagtgggttagtggccaggcacggtggctcacgcctgtaatcctggccatttgggaggccgaggtgggcggatcacttgaggtcaggagttcgagaccagcctggccaacatggtgaaaccccatctctactaaaatacaaaaattagctgggcatttgtaatcccagctactcgggaggctgaggcaggagaatcgcttgaacccgggaggcagaggttgcagtgagccgagattgtgccactgcactccagcctgggcgacagagcaagattcctcaaaaaaaaaaaaaaatgggttagagaaaatagccacataatagccttcaaaccagtctcacctgcagcttcgaggccaaatccacaggagcctctgacagctgcttcacctgctggtaaaaagtttcctgtgcctccaaaatcttcctcagatcctgctttgtctgttgaggatacagaagacagagaagttagcaccaacatccagtagacaggaggagcaactttgctgcaccaagtgtaactggggtcagggcttgttccggggattactcacagccttgggatcccgcactataggtccagattctggaaagtggtgattcagggctttcaggacttgggcccaaggccggccctgcaggatcagctccaccaccacctgtacggtactgaattcagaatccccacttcggggcaagctgaccttttccaactagtctcatccccaagctgtgggcccttgtcaggtgctcgcatcccgcccctttctttctttccccttccaggtcctacttgctccaataccttggcctttaggcccatacaaaggcgttcgtggtgccggtagcgaaccaagccaggggcaacagcgcgcagagatcgcagaaactccagtactcgcggaaaatgttccacgcagcgtccgcgcacaacctgccagctagccgcggcggcgaagcgtagagctgcgggacccgccaccaggggcgtagccatggtcggcgggctccgcccggaggcggtccctccgggttcctcacccggatgggtgaggctttccgatcactcctaggggcggggcttctggcaactccctgtcgctccggtctgtcggctctgggtacctcgcgatctgactcggctcccttccatcggcccccagaattctgggggagggggtcttctggctcgggctggaggagcctgagtggagaagctgaccgtctccagtggcactgggtcgctcagctttaaacgtcgccgctgtctcgagcccgagggtgcctcacttccggctccgctactagcttcccttgccccggaaaagggcggtaagag

SEQ ID NO: 2798 - DNA, 3030 bp, Homo sapiens; identical to SEQ ID NO: 2797
  source 1..3030: mol_type = genomic DNA

SEQ ID NO: 2799 - DNA, 11847 bp, Homo sapiens
  source 1..11847: mol_type = genomic DNA
gcgctgctcttccccgcggagcccgcgcagtccgcgcagccctcatcgcaactgggcccgcgcgcaggtgagcccggggcggggtcgcgggggaccgggaggcgcggcggggctccgtggggtgggcgacggagcgcggccggcctgggccccagagtcccggccccaccgagagccgcaggggtgcgcgccgcctctggtccggccttgccctgctggcggcacatccgcttcccttcttcacctttctggcacccgcaacacgcaagcggcatgaaagggccctccgaggagaatgtcaccttttctgtcgcaaagaagctcgcgcggggcggctcccctttcgcttgcctcgctggaagagcctggcgctcagtgcgttgtggatatcgtttctcctcacgttcttctctgctccggtcacagcctcttcctctgctcttcgggttgtcattgtggcagtgattcagcaagtgcataacattagttagggtcagggacctatcgaggcattacaccacagtcatgggcagctacacacgggctgggcagccactgtgccaacgactagggtgaccgcggtggaccagacagatccagtcttctggtccccaggggacagacaggtacgctagaatcacagcataccctagaagtgcaacagagagggggaagtgtggagaactcccgttgaaacaccaaacctaggggacaccaggatcaggaatgactcagagggaaccacatctagttagtttttagatttaaaagagttgatacgtaggcacacaaatcctaagtgtacagctcaaccattttccacaacacgcacatttcctgattcagagcaatcaataaaacatgactacatccctggcttctaacgccataaaataggtttgcctgttttggattttccatccatggaatcatatatcatgtacttcttttttttttttttttttttgagatggagtttcgcctttgtcctctgggctggagtgcagtggcgcaatctcggttcactgcagcctccgccttgtgggttcaagcgattctcctgcctcctcccgagtagctgggattacaggcgcctgccaccacgcccggctaattgttgcattttcagtagcgacggggtttcgccatattggccagggtggtctcgaactcctgaactcaggtgatccgcctgcctcagccttccagagtgctgggattacaggcgtgaaccactgcgcccagcccttcatgtactcttacgtgtgtgacgtctgacattcagtatgttttgtgatattcacccatgtttagttagcagtttattcttgttggtatataatattccattgtatggctagaccacaatttatttatccattctactggacacgggttgatggacagtcgtttccactgtggggttattttgtatcttgctgctacagacattcttgtgaatgtcttttggtaaacatctgtaagcaggcggggaacagtggctcacacctgtaatcccagcactttgggaggctgaggcaggcagattacgaggtcaggagttcgagaccagcctagtcaatatggtgaaaccccgtctctactaaaaatacaaaaatcagccaggcgtgatggcgggtgtcggtagtcccagctatttgggaggttgaggcaggagaatcgcttgaacgtgggaggcagaggttgcagggagccgagattatgccactgcactccagcccgggcgacagagggagactccgtctcaaaaaaaaaaaaaaaaatatgtaagcactgctgtttgagtatattcgtaggactgaaattgctgatgtgtgtatgctcatcttagtctatggccaaacacttctccaccggcagtgttcgagttcccatccctgcacactcttaccactacttgatagtctttttctctgtagccatttggctgagtgcccagcagtgatgcattgaggttttagtttgcatttctctgatgactaatgaactgttttgatgtctattgctcatttgaatattccttttgtgaagtgcctgctcaattcttctgctcatttttctgtcgtcttactagttccattgagtccttgaaatatttgtgatataagacatttattggatatatgtgtgtgtgtgtatatatatatatatataatatatattttatttgatttttgagacggagtctctgtcacccaggctgcagtgcaatggcgcagtctcagctcactgcaacctccgtctcccaggttcaagcgattctcctgctttagcctcccgagtagctgggattacaggcacctgccaccacacccagctaatttttgtatttttagtagagatggggtttcaccatgttggccaggctgatcttgaactcctgacctagttatccgcccgcctcggcctcccaaagtgccgggattacaggtgtgagccactgtgcccagccctggatatatatttttaaacattttaaccctcgggagattgccttttcactctcctatttatgtcttttgatgaacagaagttcttcattctaatgttttttattttatcattttttccccttatagttgtattatttgagtctggtttttaaaaaatcttccctagcaagaagactcagataaaagtaaaattaaagctgggcatggtggctcatgcctgtaatcccagcactttgggaggctgaggtgggcggatcacttgaggccacgagttaggagaccagcttggccaacaaagcaagatcctgtctgtaccaagaaaaattaaaaaatgaaaaaaataaattaggtaggtgtggtggctcacgtctttaattccagctactctagaggttgagatggaagactgcttgagccttggaggttgaggctgcagtgagctgtaatcacaacactgcactccagcctgggtgacagagcaagaccctctctggaaaaaaaaaaaaaaaaaaaaaaaaggtcgggtgtggtggctcatgcctgtatgtaatcccagcactttgggaggttgaggtgggccaatcacttgaggtcatgagttccagaccagcctggtcaacatggtaaaacctcgtgtctactaaaaatacaaaaattagctggatgtggtggcgagcacctgtagtcccagctactcaggaggctgaggcacaagaatcacttgaacccaggaggcagaggttgcagtgagctgagattgtgccactgcactccagcctgggtaatggaatgagtctgtctgaaaaaaaaagaaagtcatgggtccttctcacagtcccaggtgtgaacacagggggccaccctaggtctgcaccatagtctacaaacctctttgagaacactgtgttgtgtctatcaagctataaatgaattatattcaggactttaagtgacattgtcctgcaaaccataattaatcctacccaaacgttttagcaagtgtttgagaacaaaacagcctttgaaaccaaaattcttttaaatgtaaagtcaaagtcaggtgaagtatagatggtaatttatttatttaaagatgtaaaaactgtttcaaacaatttgaacctttaaacagaccaggttttagcactcaactgaaatccaatactttctccattcattggcctgatctaatcagacacagtgtagtagtttcctattgctgctgtaacaaattgccacaaacttagtggcctcaaacaacacacattgattatcctgccgttctaagatgggtcagcaaggccgtgctccttctgaaggctccaggaaagaacccatggacttgccttttccagcttctagaggccacctgcatcccactgccgcctgcttcccttggcacagctctttcgtctgcctcagaccttcctgcctccctcttgaaaggatctttgtggttacattaaactcacctgggtaatccaggaatccctccccatcacaaggttcttaatcacagctgccgaatccccttttgccacggaaggtaacatattctcagttccggggattaggatgtgggcctctttgtgggccactattctgtctaccccagatagtgattcctgcttaacagaaatcgaatatgaactctaagagatacatattctaattatatgccttcacaggctccagtacattccctatataatagaaattggagaccagtttgatattggatactaaatacactttggatttttttttttttatttttgagacttgagtcttgctctgttgcccaggctggagtgcagtggcatgatctcggctcactgcaacctccacctcccgggttcaagtgattctcctgcctcagcctcctgagcagctgggattacaggcacgcaccaccacgcttagctaatttttgtatttttagtagagacagggtttcaccatgttggccaggctgatctcaaattcctgacctcatgatccgcccacctcggcctcccaaagtgctgggattacaggcatgagccactgtgcccagcccactttggattttatacagcaaaactccataatgtttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagattaacacgtgtttgaatatgtgacagttccacagctccagctacaaaagaactgaaaaggaacagggaaggtgcatggcgtcttggattccaggaagtaggcagtgtgtatggttactggaatttacctgccatcttgctcaattatcctgtcaaaggtgctgttatttttctctttaaaacgtttccatgtttctcatgagggcttataccaccgcacttctggtggcatatactgctggacaactggatttcttcttaaccaagcaatggaaaagcaatttcccccaattagcatgcgttgccaaaagggcaagtcatttcataaaatgagaaactgaaactttaaaatctacatatattaagtagattaacatattatgttaatttttaacctttagaatatttacaaatcaaatgatgctctagtttacaagtgcaccaaggccaaataattaatattaaaattaaaacagaattgaaaaaatatttaaaaaatgcaaaaaccaagtgacatcatgtttactactgggggcaaaaaggcatcctgaacggccctagctgcagcctaccacttaggctgtctgaaatcccaagcatattaggaaagaaaagaaactcatatacatactcatagtcaacgtccagtgccgttttggtggcttcacatttagctgtgttgctttttcagatgtcttctctggttcctgtacccattccaaccctttgctctgcctcctttgctgctatggtttaagttctacttcttttttgaactttgatatatgatcacaaatcctcagcatcccttgtcttctacgcatcagtgaacaaagcattaatgtgcagcatagaatgacattctttaattttttttattgagatggagtttcgctcttgttgcccaggctggagtgcagtggtataatctcagctcactgcaacctccgcctccaggttcaagagattcttctgcctcagcctcccaagtagctgggattataggcgcctgccaccatgcccagctaatttttgtattttcagtagagacaggggttttaccatgttggccaggctaggcttgaactcctgacttcaggtgatccgccgccttggcctcccaaaatgctaggattacaggcgtgagccattgtgcctggccacattctttaaattttgaaaccttttattttagtgtgtctaataatacttgcttccatgagttctcaggtttgttttgatctcacagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggcaggttgcctttctaagggattcttgggcctttgtatttccatataaatttagaagcagtctgacaacctccccaccaaaaaacctaaaaaacaaaaatcttctagactttggaacagcactgaattaatgatcagtttgggaaacgttaacattacaagtttaataaaccatgaacataatatacccctccaatatctagattattttatatacatagtagcccacattttctaagcatttattacatgccaggcaccattaggactttacataaatgatttcatttaatcttcacaataatgctgagaaggaggctctagtacttccatttcacggatggagaaacgagtttagcaaggtggccaaaggtcacggttaaccagagatgagaatcaggcactctacctgcagtctgcagtctgtaccactttttgacatgaccttcctgagctgacggctgcaggggcgatgggtctatggatggagttattcagggggaggcagacttggaggaaaagtctcccaagatttcctgcatgtgctctctctctactgttcagcttctgtctatctggatacataattatttgtccaaatagcaactgtccttcttctgccatttcaggccttacataggaagtccttctaaagagctgcctgccagctgcccttccccagatcccgaatatcctcctggccaggtggagcagagaacagttcctcagctggtcatgctgagctcataccctgtaagtctgaccacactacacagctttggctttatctagaatccagctccaatcacagtcgtgtctggccctaatctcatgaggaatgaaagacccatttagagaagaagcctctgtcaggcattaggagagaaacagaacttcgcagagctcatccatggggaatgagagcagggtaagtgcagcctttgtgattctctctctctaccctctgtaggatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctggtgagtggaaccggactcgcgactctgctgtgttcctgagtgtagtgctcagcctccatagggcgcggtgggaggcctgcctggtccaaactcagagagacgcaggaaggctgacgtggggaactcctgacctgaattcagggcctggatgctttgtggagagtgaggaggggaggcctgcgtcagctcagccagatctttatccttttggctcaaaggttttccaggcctgctcagctagctttcctagcctggaaaccactgtgctgagtgcttaacactgtctcttgtcgtccaaatctttgttccagaaccatttagaggagaagccaagcagagagagaaaatgaatcaatccccaccacaactatctgtccttatcaaaggctggggaagctgttttcatctccttatggagtcccatactccaaacacagacctgagcagtgtttctcccccacagactggttcaggcagaccctgctgaagaagcccaagaagaggcccggctccctgacatacctgacactgcattatctcagttaactttcagcaactaagacaggtccacaagtccacagtcaaagccgtgtccctgactccagagtgtgggttctgaatcacgaagctctctgctcctcagcaactctgagcagtagcctcttccccatttagcgacaatctaggatttcttggggccaaacagatgccagtcctccgtaccccttccttcctgtatacgtagcccttcctaatctaagtccacctcccctcagtgctgaaagtgggctttgggactgatggatccttgctagcataacgtagctctgcctgcagactcccggtggttgactagtcagctctagtgggaagttctgcttaaggtgggctgggctgggggtaccagatatcaaagggcctggagtagtgcaaggccatttctcttaaccaggctggtggaacactctcacataaggattccagagttctgacacgtccaaaacctttacctttagagggcacttttaggcaagtcccaaaagataaacaaaaatagcagagtgctgggcacagtggctcacgcctgtaatcccagcactttgggaggctgaggcgggcagatcatgaggtcagaagttcaagaccagcctgaccaacatggtgaaaccccgtctctactaaaaatacaaaaattagccaggtgtggtggtgcatgcctgtaatcccagctactcaggaggctgaggcaggagaatcgcttgaacctgggaggcagaagttgcagtgagccaagatcgcaccactgtactccagcctgggtgagagtgagactctgcctcaaaaaaaaaaaaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggccaagttactcacccgctctgtgccttggtttcctcactgaccaacaggtttccattgctatgaaatgagaacagtatatacacgaagggctcagaacatggcctagcacatgtattcataacaggcagcgcctagcacaaatcaggtcctcaagttaatagctagtagtagtaacagtaatagcattaggtttctctgagatcaggctggagatgtccatcaagagctgggaaggtgccaggagggacattggtttagtaaggcaaaatgatgcaaaataataggaaagaagtgcatataagtgtatctggggagggccatgctattgcagtaggtttggaagtgtaatagataaaaagatagaagaggcaggacctgttggggaaaacagatgctgggtttgggaggtgtgacaacgctgtgattggtctctttcagatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctact

SEQ ID NO: 2800 - DNA, 10090 bp, Homo sapiens
  source 1..10090: mol_type = genomic DNA
gcgctgctcttccccgcggagcccgcgcagtccgcgcagccctcatcgcaactgggcccgcgcgcaggtgagcccggggcggggtcgcgggggaccgggaggcgcggcggggctccgtggggtgggcgacggagcgcggccggcctgggccccagagtcccggccccaccgagagccgcaggggtgcgcgccgcctctggtccggccttgccctgctggcggcacatccgcttcccttcttcacctttctggcacccgcaacacgcaagcggcatgaaagggccctccgaggagaatgtcaccttttctgtcgcaaagaagctcgcgcggggcggctcccctttcgcttgcctcgctggaagagcctggcgctcagtgcgttgtggatatcgtttctcctcacgttcttctctgctccggtcacagcctcttcctctgctcttcgggttgtcattgtggcagtgattcagcaagtgcataacattagttagggtcagggacctatcgaggcattacaccacagtcatgggcagctacacacgggctgggcagccactgtgccaacgactagggtgaccgcggtggaccagacagatccagtcttctggtccccaggggacagacaggtacgctagaatcacagcataccctagaagtgcaacagagagggggaagtgtggagaactcccgttgaaacaccaaacctaggggacaccaggatcaggaatgactcagagggaaccacatctagttagtttttagatttaaaagagttgatacgtaggcacacaaatcctaagtgtacagctcaaccattttccacaacacgcacatttcctgattcagagcaatcaataaaacatgactacatccctggcttctaacgccataaaataggtttgcctgttttggattttccatccatggaatcatatatcatgtacttcttttttttttttttttttttgagatggagtttcgcctttgtcctctgggctggagtgcagtggcgcaatctcggttcactgcagcctccgccttgtgggttcaagcgattctcctgcctcctcccgagtagctgggattacaggcgcctgccaccacgcccggctaattgttgcattttcagtagcgacggggtttcgccatattggccagggtggtctcgaactcctgaactcaggtgatccgcctgcctcagccttccagagtgctgggattacaggcgtgaaccactgcgcccagcccttcatgtactcttacgtgtgtgacgtctgacattcagtatgttttgtgatattcacccatgtttagttagcagtttattcttgttggtatataatattccattgtatggctagaccacaatttatttatccattctactggacacgggttgatggacagtcgtttccactgtggggttattttgtatcttgctgctacagacattcttgtgaatgtcttttggtaaacatctgtaagcaggcggggaacagtggctcacacctgtaatcccagcactttgggaggctgaggcaggcagattacgaggtcaggagttcgagaccagcctagtcaatatggtgaaaccccgtctctactaaaaatacaaaaatcagccaggcgtgatggcgggtgtcggtagtcccagctatttgggaggttgaggcaggagaatcgcttgaacgtgggaggcagaggttgcagggagccgagattatgccactgcactccagcccgggcgacagagggagactccgtctcaaaaaaaaaaaaaaaaatatgtaagcactgctgtttgagtatattcgtaggactgaaattgctgatgtgtgtatgctcatcttagtctatggccaaacacttctccaccggcagtgttcgagttcccatccctgcacactcttaccactacttgatagtctttttctctgtagccatttggctgagtgcccagcagtgatgcattgaggttttagtttgcatttctctgatgactaatgaactgttttgatgtctattgctcatttgaatattccttttgtgaagtgcctgctcaattcttctgctcatttttctgtcgtcttactagttccattgagtccttgaaatatttgtgatataagacatttattggatatatgtgtgtgtgtgtatatatatatatatataatatatattttatttgatttttgagacggagtctctgtcacccaggctgcagtgcaatggcgcagtctcagctcactgcaacctccgtctcccaggttcaagcgattctcctgctttagcctcccgagtagctgggattacaggcacctgccaccacacccagctaatttttgtatttttagtagagatggggtttcaccatgttggccaggctgatcttgaactcctgacctagttatccgcccgcctcggcctcccaaagtgccgggattacaggtgtgagccactgtgcccagccctggatatatatttttaaacattttaaccctcgggagattgccttttcactctcctatttatgtcttttgatgaacagaagttcttcattctaatgttttttattttatcattttttccccttatagttgtattatttgagtctggtttttaaaaaatcttccctagcaagaagactcagataaaagtaaaattaaagctgggcatggtggctcatgcctgtaatcccagcactttgggaggctgaggtgggcggatcacttgaggccacgagttaggagaccagcttggccaacaaagcaagatcctgtctgtaccaagaaaaattaaaaaatgaaaaaaataaattaggtaggtgtggtggctcacgtctttaattccagctactctagaggttgagatggaagactgcttgagccttggaggttgaggctgcagtgagctgtaatcacaacactgcactccagcctgggtgacagagcaagaccctctctggaaaaaaaaaaaaaaaaaaaaaaaaggtcgggtgtggtggctcatgcctgtatgtaatcccagcactttgggaggttgaggtgggccaatcacttgaggtcatgagttccagaccagcctggtcaacatggtaaaacctcgtgtctactaaaaatacaaaaattagctggatgtggtggcgagcacctgtagtcccagctactcaggaggctgaggcacaagaatcacttgaacccaggaggcagaggttgcagtgagctgagattgtgccactgcactccagcctgggtaatggaatgagtctgtctgaaaaaaaaagaaagtcatgggtccttctcacagtcccaggtgtgaacacagggggccaccctaggtctgcaccatagtctacaaacctctttgagaacactgtgttgtgtctatcaagctataaatgaattatattcaggactttaagtgacattgtcctgcaaaccataattaatcctacccaaacgttttagcaagtgtttgagaacaaaacagcctttgaaaccaaaattcttttaaatgtaaagtcaaagtcaggtgaagtatagatggtaatttatttatttaaagatgtaaaaactgtttcaaacaatttgaacctttaaacagaccaggttttagcactcaactgaaatccaatactttctccattcattggcctgatctaatcagacacagtgtagtagtttcctattgctgctgtaacaaattgccacaaacttagtggcctcaaacaacacacattgattatcctgccgttctaagatgggtcagcaaggccgtgctccttctgaaggctccaggaaagaacccatggacttgccttttccagcttctagaggccacctgcatcccactgccgcctgcttcccttggcacagctctttcgtctgcctcagaccttcctgcctccctcttgaaaggatctttgtggttacattaaactcacctgggtaatccaggaatccctccccatcacaaggttcttaatcacagctgccgaatccccttttgccacggaaggtaacatattctcagttccggggattaggatgtgggcctctttgtgggccactattctgtctaccccagatagtgattcctgcttaacagaaatcgaatatgaactctaagagatacatattctaattatatgccttcacaggctccagtacattccctatataatagaaattggagaccagtttgatattggatactaaatacactttggatttttttttttttatttttgagacttgagtcttgctctgttgcccaggctggagtgcagtggcatgatctcggctcactgcaacctccacctcccgggttcaagtgattctcctgcctcagcctcctgagcagctgggattacaggcacgcaccaccacgcttagctaatttttgtatttttagtagagacagggtttcaccatgttggccaggctgatctcaaattcctgacctcatgatccgcccacctcggcctcccaaagtgctgggattacaggcatgagccactgtgcccagcccactttggattttatacagcaaaactccataatgtttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagattaacacgtgtttgaatatgtgacagttccacagctccagctacaaaagaactgaaaaggaacagggaaggtgcatggcgtcttggattccaggaagtaggcagtgtgtatggttactggaatttacctgccatcttgctcaattatcctgtcaaaggtgctgttatttttctctttaaaacgtttccatgtttctcatgagggcttataccaccgcacttctggtggcatatactgctggacaactggatttcttcttaaccaagcaatggaaaagcaatttcccccaattagcatgcgttgccaaaagggcaagtcatttcataaaatgagaaactgaaactttaaaatctacatatattaagtagattaacatattatgttaatttttaacctttagaatatttacaaatcaaatgatgctctagtttacaagtgcaccaaggccaaataattaatattaaaattaaaacagaattgaaaaaatatttaaaaaatgcaaaaaccaagtgacatcatgtttactactgggggcaaaaaggcatcctgaacggccctagctgcagcctaccacttaggctgtctgaaatcccaagcatattaggaaagaaaagaaactcatatacatactcatagtcaacgtccagtgccgttttggtggcttcacatttagctgtgttgctttttcagatgtcttctctggttcctgtacccattccaaccctttgctctgcctcctttgctgctatggtttaagttctacttcttttttgaactttgatatatgatcacaaatcctcagcatcccttgtcttctacgcatcagtgaacaaagcattaatgtgcagcatagaatgacattctttaattttttttattgagatggagtttcgctcttgttgcccaggctggagtgcagtggtataatctcagctcactgcaacctccgcctccaggttcaagagattcttctgcctcagcctcccaagtagctgggattataggcgcctgccaccatgcccagctaatttttgtattttcagtagagacaggggttttaccatgttggccaggctaggcttgaactcctgacttcaggtgatccgccgccttggcctcccaaaatgctaggattacaggcgtgagccattgtgcctggccacattctttaaattttgaaaccttttattttagtgtgtctaataatacttgcttccatgagttctcaggtttgttttgatctcacagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggcaggttgcctttctaagggattcttgggcctttgtatttccatataaatttagaagcagtctgacaacctccccaccaaaaaacctaaaaaacaaaaatcttctagactttggaacagcactgaattaatgatcagtttgggaaacgttaacattacaagtttaataaaccatgaacataatatacccctccaatatctagattattttatatacatagtagcccacattttctaagcatttattacatgccaggcaccattaggactttacataaatgatttcatttaatcttcacaataatgctgagaaggaggctctagtacttccatttcacggatggagaaacgagtttagcaaggtggccaaaggtcacggttaaccagagatgagaatcaggcactctacctgcagtctgcagtctgtaccactttttgacatgaccttcctgagctgacggctgcaggggcgatgggtctatggatggagttattcagggggaggcagacttggaggaaaagtctcccaagatttcctgcatgtgctctctctctactgttcagcttctgtctatctggatacataattatttgtccaaatagcaactgtccttcttctgccatttcaggccttacataggaagtccttctaaagagctgcctgccagctgcccttccccagatcccgaatatcctcctggccaggtggagcagagaacagttcctcagctggtcatgctgagctcataccctgtaagtctgaccacactacacagctttggctttatctagaatccagctccaatcacagtcgtgtctggccctaatctcatgaggaatgaaagacccatttagagaagaagcctctgtcaggcattaggagagaaacagaacttcgcagagctcatccatggggaatgagagcagggtaagtgcagcctttgtgattctctctctctaccctctgtaggatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctggtgagtggaaccggactcgcgactctgctgtgttcctgagtgtagtgctcagcctccatagggcgcggtgggaggcctgcctggtccaaactcagagagacgcaggaaggctgacgtggggaactcctgacctgaattcagggcctggatgctttgtggagagtgaggaggggaggcctgcgtcagctcagccagatctttatccttttggctcaaaggttttccaggcctgctcagctagctttcctagcctggaaaccactgtgctgagtgcttaacactgtctcttgtcgtccaaatctttgttccagaaccatttagaggagaagccaagcagagagagaaaatgaatcaatccccaccacaactatctgtccttatcaaaggctggggaagctgttttcatctccttatggagtcccatactccaaacacagacctgagcagtgtttctcccccacagactggttcaggcagaccctgctgaagaagcccaagaagaggcccggctccctgacatacctgacactgcattatctcagttaactttcagcaactaagacaggtccacaagtccacagtcaaagccgtgtccctgactccagagtgtgggttctgaatcacgaagctctctgctcctcagcaactctgagcagtagcctcttccccatttagcgacaatctaggatttcttggggccaaacagatgccagtcctccgtaccccttccttcctgtatacgtagcccttcctaatctaagtccacctcccctcagtgctgaaagtgggctttgggactgatggatccttgctagcataacgtagctctgcctgcagactcccggtggttgactagtcagctctagtgggaagttctgcttaaggtgggctgggctgggggtaccagatatcaaagggcctggagtagtgcaaggccatttctcttaaccaggctggtggaacactctcacataaggattccagagttctgacacgtccaaaacctttacctttagagggcacttttaggcaagtcccaaaagataaacaaaaatagcagagtgctgggcacagtggctcacgcctgtaatcccagcactttgggaggctgaggcgggcagatcatgaggtcagaagttcaagaccagcctgaccaacatggtgaaaccccgtctctactaaaaatacaaaaattagccaggtgtggtggtgcatgcctgtaatcccagctactcaggaggctgaggcaggagaatcgcttgaacctgggaggcagaagttgcagtgagccaagatcgcaccactgtactccagcctgggtgagagtgagactctgcctcaaaaaaaaaaaaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgt

SEQ ID NO: 2801 - DNA, 15863 bp, Homo sapiens
  source 1..15863: mol_type = genomic DNA
cccatttgcaaaacccctttaatcagaataaatagagtcccaggcagggcagagttcattggggatgcccaagccggattcacccacccttccagctccagcctaggcgcagctgcggctttcgagaggcgaaactgtcttccttgtcctggtgtcccagcagggtcactgggaggcaacagtgtggtctcagggtgctgggcgggcccgtgaggcccatcgccgtccccctaggcatcctgttcatctgtgagcagggcagggggtgccgcagcctcctcggttgtcccaaccctgccagaaagagacatcactgaggggaccccataaacatcaacatccctgcaacctggctgggcgcagccaaggcccggcgagggacaggccagacgccccacagcctttctcctgagatgtattttaggtccctgtcaaaatggccaggctccggaggccagagaaggctctagagagagtgaaggtgggcgccgggggggagatttttgtaggtcaaaagcggtcaagtgtcagcaatgtcgtggtgtagccccagtggcagccctactgtccagccctggcccctctcccctccaggctcagagtgtccccaatccctccacggaccctcacctgctcctctcctccctctccttcctctcgtagatggagtgaagcttgttgattaagaagattttgtcctcaccctcctagaaaggccagaacacaaaggggaggagaaatcatccatcagcccatccagagccatcctgttccaaactgcatttgagggaaaactcacgaggtgtattcaacatcgcaagcagcaaaaacataaaagaaaaggtgaaagggccaccaaacaaggacaaggaaaaaccaagagccaggaagtgggcgtatgtgtggatctaagcttcctagtggccaaagtgaaaagggaaatgtaatcagcagcccagagccagcctgactcaatttaaaaccagccctgccacgtactggctctgccttgggttactaactctgtgacctcagtggcagcatctgtaaagggggataataacacaaggcacagggtttacattagtttcctgctgctgtcgtaacgaactgtcatcaacttcgtggcttaaaacaccaccggtttctcaactttcagttctggaagtgagaagtccaaaatgagtctcactgggctccagtcaagcatgatcagggctacattcctcccggaggcttcgggggagaatcctcttcctcgccttttccaacttctagaggcccctggctctcagccctttcctccacttcaaagccagcagtggctgctcaagtcctgctcacgtggcaccactctgaccctgacactccggcctctgtttttcacctctaaggaccctgagatcacgctgggccaccacgataatctagggccatctcctatccaaagtcagctgactggcaactttaattctacctgcaatcgtaattccccagccacgcaacgtaacgtattcacaggctccatccagtcttaggacggggacatctttggggccagtactggactgacccagggctctttcgacaatgaaatgtgacaagcagagggggcacttagcaaaggatctggtgcaccgaaacactgatcatcagtgcctgggtcagaccgggattccccgcccggagcttcacacagagaacaggagttctgtcaagagccacacggattggctctgggcacctggcaacctggctcagcctaggaggaccacttagaataccttcaaggagagaccatgggccccttaagcaacaacctaagtagcttctatcgagttgctgatgagtatggaggggctgtgcacttgagccatgccgacctgcacggggaaaactcagaccgacagccccaaagacgggtcagagctcggccttgggtagacaccacagccagcatccgcctggagaaaggtccttcccatcccagagcaacggtgggtagagctgggattctcccagcaccactctgcattccccgcccggacccacctggccctacctggcccctgggggctctgaaatgccacccagtagggcaggagccattccccacttccaatatctacagccagacaaccaccgcagccgagatgccaggctttcagctctatgtggtgaaacgggaaaggcaggagatgggacagtgtgtactacagtgtttacaacccaagcaatgtgggagccgtcccatgagtgcttgggacgagctgggacgagctgcctggagccctggatcctggcaccaactagccagcagcagggtcacatggctgccgaggcccactggctgcaccccgccctgccctcgccttggcagacgccagccgctgatccccacaagcgcccccctagccctggtgtggagcatgcctaaggacactggcactcaccagccccagagtgaaaacctgcaggaggacaaatggcaatgggaggggatggggagccctagggggagggcagagcccagcagcaggacgcaagcctggaaaagccacaggacctgcttcacggggggccgttccccaggggaggggcctcggggaggaggccaggctgggtagcccggggggaaagtgccttgtctccaacttggtgggtgcccagtgggcaaggaggtcctcctgggcagagaggagcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacagggaccagctgccgggtggacagtactcctgggggctgcctctccggtatggggtccgacccccttctgcaactcactcccatgacacagcatgagggcctcagcaactcgctctgtcgcccgggctggagtgcagtggcgcaatctgggctgattctcctgcctccgcctcctgagtagctggtacaggtggacgccaccacgcccagctgatttttgtacttttagtagagacggggttttgccatgatggtcaggctggtctcgacctcctgacctcaagtgatctgctcacctcggcctcccaaagtgctgggattagaggcctgagcccccatgcccaggcttttttttttttttttttatgagacagagtttcactgtcacccaggctggagcgcagtggcacaatcatagctcactgcagcctcaacctgggctcaagcaatctcctccctcagcctcccaagtagctgggactacaggtgcacaccaccacacccagctaacttttaaaatttttatagagacgaggtttcactctgttgcccaggctggtctcgaactcctgggctccagccattctcccaccttggcctcccaaagcattgggactataggcatgagccccaccacacccggtcaaacattgttttcttcataaaaatgttttggccaggcacggtggctcatgcctataatcctagcactttgggaggccaaggtgggtggattgcctcaggagctcgagaccagcctgggcaacacagtgaaactgcatctgtacgaaaaacacaaaaaagtagccggagtggcggcaggccctgtactcccagctactcgggaggctgaggcaagacagttgcttgaacccaggaggcagaggttgcagtcagctgagactgtgccactgcactccagcctgggtgacagagcgagactccgtctccaaaaaaaaaagttttaagtcctaactctcaaccttaatccacctgtttgtaaaatgagtgaagagtccatagggacccaaaaatcctcacagagactgtctaaaccctcagcggggccacacccgggggctgaaatcacaccccaccccccagagccctggtcccagtggggccctgcgggtccttggggatcaggagcctggctctgtctcacggctacttcgtcacttgatctgaagtgcacgtattgatcagggtcacttgtttggcaaacaaaccctttcaccagccaaggcccacaggagatgtacaggggagtggaggggagcgtcaccctcaggtgacctgagagggtgggggctgagagcagcccaggaggggcactcacattgctgatctgctccttgagcaggcagatgaccttgcgctggccccgcaccacctggatgttgaggtagatcacggccctgcgggagaggggctgtcgggcagggcccagggccacagcccgggagcggccagtccccacacggtgcaggcccagcgagggccatctccccagggccgcccccacctgcgggactcacagcagcagggctgacaccaggaagacaaagaaggtgttttccatcaggtaccggtgcacccagggcagccaggagaccctggggcctgccgcctccaggtggcgcacccacaccctgccggcctcgtacatggtgtccagggtccggaaggggccgcaggtgctcgagggcttcaccctggggaagatgccgaccaggaaccctcaccccgagcaacagttcacccggctccctcccagcccgtcctctgcacccctaagccttgggccccccaggcaccaccacccaacccccagatgacacagaagggtctccctccacccgccccactcactgccagacggcgtagcagaggaagacagcggcgcccaggaaggcggggaagcagagcagcgtgaggaagacggtgctcatgtgtgaggccagccagggccggcgcggcgcctggcagttggccagaaggctggtctgtggggaaaggctgcgctctgccaccatcctgctacccctcagcacccctccaagccctgggggagctcaagagggaagggcgaccagggctgtgcgtccaggcagagcctggaccctgctccctgcagcctcctcatttacagaggaagacagaagcctgccggtcacttgcacgcaaacgggtgatgccaacagcacctccatctgctgaaggtcgctgccatgccaggctctgcacacaacactgtacacaccacctccctcagtccccactggaacatggtccccactgcagggatgaggaaacaaaaggccagacgagacaggagccaggatggccaggtgcggtggctcatgcctgtaatcccagcactttgggaggctgaggtgggcgatcacaaggtcaggagatcaagaccatcctggctaacacagtgaaaccccatctctactaaaaatacaaaaaaattagctgggtgtggtggcgggcgcctgtagtcccagccactcgggaggctgaggcaggagaatggcgtgaacctgggaggcggagcttgcagtgagccgagattgcgccactgcactccagcctgggcgacaaagcaagactctgtctcaaaaaataaaataaaataaaaagacaggagccaggatgggaagaaaggtcccagttctcagccactgggcatgacccagttgcggagagaggcccagcatcacttttccagggacccagaggtcccaaggcttggtgtctcccagagccctggccctacccctggccaggtgcacacaggtacctgctaatgacctctgaacccagcgatgcttcccagcctgccgaagacagtgatgccaagaggggtcagccgtcccttgggcggagggacaggccagggcagccccgagccgccagccccactccactcaggtggggagggttctagtgtcccaggctctgcccagctgagtcctgcccccactgccggccaccctgccagcccagccctccccaggccttggcagcctcaccttcttgacatagaagacgagcagcagcttgatgatctgcacggcggggaggaggggcgagaagagcacccccagcctggggagggggtggcagttcaggggctgctccagtgccctcccctccccgagatcaggctggttccagaccacgggcagggcatgtgacagtggccaaaactgagtccccggggttagggtctgcatcactccagggtccatggccgggcctggctgtggccccagggggaggcaggtacaggacccccggggggaaaggggcactgaccgaggggccagacagtaggaggcaagcagaggaccctcaccaggtcagagtctgcccataaatcagctccaggacattccgggcaatgtcaaactccggcttccgcctcctcttcagcttcttctcggagataatcctgcctccgaggaccccggatcgttagatgggaaagccatgcccagggaggccagcctgagtccccacacccagaggcaccccgcccccagccaggggacatcctggccgttccacagataatgccaagaagagacagccaccagcctgggggaccccaccaggtgcttggtcacaccagcctcatcctaagtaggttcggatacacccggagttaaacaagcagtatcagctccagcaccaaatgattttttcttttttgaaacagggtctggctctgttgtccgggctggagcacagtgacgcaatcgtggctcactgcagccttgacctcctgggatcaagcagtcctcccacctcagcctcctgagtagctgggactacaggcacacaccaccaggcccagctaatttttatttatttttatttttatttctttagagacaaggtctcactctgttgccgaggctggtctcaaactcctgggcttaagtgatcctcccacctcagcctcccaaagtgctgggattacaggcgtgagccaccacaccgggcctcctactgatttttttaatcttattttttattattattaaattcatatattctcgaagaaaacaccaagaggaaaaaaacagctgaagtgccagaacccacagcggaatacctggaacattttttaaatgttcctccgctgtctgttccctgctgtgtgtttttcctttgtatcctagactgaggttgtgtcatatacacgttacttttttttttttttttttttttttggcaacacagtcttgctctgtcgcccgggctggagtgcagaggcgcaatctcagctcactacaacctccgcttcccaggttcaagcgattctcatgcctctgcctcccgagtagctgggactactggtgtgcgccaccacgccctgctaatttttgtatttttagtagagacggggttttgccatgctggccaggctggtctcaaactcctgacctcaggtgatccactcacctcagcctcccaaagtgctgggattacaggcatgagccaccatgcctggccatacacatcactttgaaacctgttttcctttccaatctaaaaatgagttcggttctatttcctgagtcttcctctgaagggtggagacacagggccctgatgggaaaggtccaggcctgagaacctcccggccacacgtcccggccactaaggggagaacactcaccacccagtccgcccaggaccccctcacctccacaccagttccccaaaaagcgtgtccagcaacatgaggacgaagtccatcaccaggaaccggtacagctcctggcccacaaaatcctcccagcactggccctgcaggacgcccaccctgcggcccagccagtggtagcacagtgtccccaggatggccagcttgaggatgaggttcctgcggagggcggggtgcaaaggctgaggggcgggtacaggggacagaagatgcaccccagggcccccaccaggggcttggtcacaccggcctcatcctaagtaggtttggatacacccggagctaaacaaccagtatcagctccagcaccaaatgatgttttcatgtgcggccacacacctgcagatggccacgtacacctccagtaccggggagtcatgcggctccagggcggccaggacacggcacaggtagggggcccccaggttgaggaggccaaccaccaggggcaggaccagcagcacagcctcctggccagcagcctctggactctgcaggggtgcagggagcggtgtcatggaagccccccatccatggtgggagcgggcagctacagggaagggcccggggtggaactggcaggtagcacctccctcctccaagatctggccctccccaggcctcaagttcaaaccacacaggaagcagggaggggtacaagtagtggaaaagaaaccagaaaccaaaaaataaaaccgtgagacaggacaaggggctgagaagtggggctcggagggggccccagcacggggcacagcgtacgtggcaccctgggctggctgggtggaggaggagaggcaaggctgcctccccagggggcaggtgcccagagtcactggggacacgttccaagcaagggccaggctccccccatccccgcacctggatcatgaactccgagaagacgtggacggccacggcgcagcccagcgcggtccccagacacagcagccacacaagccccagcacagccgcctgccgcagcctcccgcacacgctcctggggctgtgccgcagctgccactcggccagcagctcctgcaggcggcaccgtgtccccgtcacccacaccagagcacgggcacacgcagacgtgcagacacagcacaacacacacaacacacatgagacacaccaggaggcttgaaccaggacagagggccagttccccatgccccacctgccctttcatctgctgagggccctccctccaggcgcagagaggacccagtccccctgccgagaggcccctgtgcctgggctggcgttcactcccgaggcctgcctcaacccctctccacccacctccccagccctgcccgctggggcaggggccttgctcagaggtcctttcctgttccctgtggatgtgggtggcccccagtgaccagaagcccccctacacggaatggctcatgacaggtcacagctctgagctccttgaagcacagaaccccagaaaggcagagaatgttccacgaggcccggctctgcagcctcctggccccgcaacctctacgagggcctcggcctctatgcctcagtctcctctctgaggcacacagaaggtgacagtcctcacccactggcctcctatggccaccaaccaagctaacgccagccagggagcatgtgccagctggggcctgaggcctcagggctggctcccgggtgcccacggggccatggcgctactacgcgctagcagacaacagaggcagcccctaactgatgggtgtgtgccagagaaaaactcagggcctgcccgtcactgcaagcagaagaccacgcctgcccagcgccccgagttcagctcacggacagctggccctccctctagaccatggttctggtcacatggtcctaagtggacccagggccaggcctgcagggagctgggcaggccagcttggtgctccggggccactcaccttcagccgggtgcgaatattgtcctgctggaggcgggaggcccgcttctgcgtcaccttgtagtcccaggagcagaagacggtgatggcgtggatgccagaggtgctgcccacccggtagctctccccgaaagagtgagccatgctggggagaagcagacacagacatggcaaccaacaagctgacgggcagaggccaaggggagaaggcagaccggatgctctgggcagccagaccccaccacccactcaggagccatctgggccctgactgggcctcctgccacacccctgccccaccaccagccctctacaccagtctcatccaacatagcacccaccagccacatctgcctagaagagggggcagggctgcattcaccgcggacttggctggctgcctcccagcgagacatggaccagaagatgctgggctcacctcagggcctttgcactgctggtcccaatgaccaaaacatcttccctgcttccttatccatccccactcttatctaaccttcccctctcagggcaagtgccgcctcccctgggaagcagcctgactccttccccagtgctcccataacactggggaaacaccactaagcctcatggattgtcccagcccattcagtggtccatcttctcccagagacagcaagcccccctaggacatttaccatcctgccctgagctgagcacagagaatgtttgtggaatacgtagatgcatgggtggatgggtggatggatggatgaataaatgtgtgggtggatgggtggatggatgaacggatgggtggatgaatgggtggatagataaggaggtggatggatgtgcgaatggatggatgcgtggatgaatgagtgggtggatggatgaatgggtggatgggtgggttaaactgagtggatggatgggtgggtagatggatgaatgggtggatgggtgggtggatgggtgaatgggtgaatgtgtgaatggatggatgggtgggtgaatggatgaatgggtggatgggtggatgggtgggtgaactgattgggtgaatgggtgggtagatggatgggtgggtgaattgagtgggtggatgggggggtgaattgagtgggtagataggtaggtggatggctgaatgggtaaatgggtgggtgaattgagtgggtggatgggtgggtggatggatgaatgggtggatgggtgggtaggtagatggatgggtagatgggtgggtaagtggatagttggataggtgagtggatgagagcagacaggtagatggacagaaggaagaaaggaagagggaagaatcaatgaatgggtcgaaagatgaatggatggatgagtggagctcggagcctgggtcatgaggtggaggcattacctgtacaccagggtgatgcaggtgataaagaagctcacgcccacagtggagaggtaggccaggggcatgttgtagggcaggccacccaccctgggtgtgcactggctgccatccagggggctgccacacggctggttcagcgtggcgttactgtagtggccgtagtacatgacggtgtgggtgaagcaaccctgccacagggagatccagccgagtcagggactttccccacgccccacccgaccctcaggcctgacagccacaggggcagagcaggaggaggccaggcaggggcagtgagggaaacagggaggggccttggccacagcaatcttgggcctccagccccatgggaaccccagcacgatgagcatccagggtcattgagggggaggcggggagctggctgtggccacctggagtcacagcggggcaagggttgggggccccaggggagctgggacaagaagggaacacggtaccagggtagcagaagacaggcaccccccgtcccccagtcctagggcttcctcaccgcgcctgtgaggagctccaggcctgtgcagacgggggcagggcccggcagggcgggtgggaaggcgacctgagggcccatgatgaaggccaccagcagcagcagcaggagggcattgaaagccagcagggtcttgagaaagaggaagtaggagagcacgctggagccgaactggcccccgatgcgcttcagggcgtagcgccacggcatcagggcctgcagggcggagagcagcgccaggcccaggctgtgcaaggcctgcgggcacaggcagagaggccctgagggtgaggccggaggaggcactgaggccaccccagccctgcccagccgccccagccccagggcagaccaggggcccataccagcacgcaggcatatctgagccggccacagcaggagcagaccccgccgctgcccggctggcccctccacttccccctcggggtcctgctcttctctctggggacagaggcagccataggtgcctggaccaatgaggggcctgactctctccttcctggagaccggccacccacgggctcagccccttctcccccaccacctagcccagctgaggaagtgggtctgggggcgcagcagcggcggcatggtcagggtcggggctgctcaccgcaggctgcgtttctcagccaggcttaagggcatcccgcgaagcatgtggtcccgctgtgccactgccaggctctggagctccttcaccaggaggctctgcttctctgcgagagggagagggaggtcctgcccatccccaagtgcccctccctgcagcccgaagccgggaccctggtcaggcctgtgtgtccctgcggcaccgtcccgagacacctcggtgcccttatttgagcttcagtcgccaatcagccgtgtgtttgcttcagtcagcgacaagcaggaagctcacagagcacaggggcctgtttcccacgcacggtccccgactcggggcccagggccacagccctccaagcactccaaggcgcttgtgaggtaagacccccacttccctgtccccgtgggtccctgcagagggacgggggggccttcaggcagcctgctaagggataggagaggggcctctggctctgcagcaccccagccaccgcccaggccaggctggcctcttgcaccccaccccaggccggtgtccgccactggggctccagtgcccactcactcaccctcctcctccagggccgtggggtccagctccaggtcgtacaggcggaggctgggccaggcggagcggacaaagttcccgagcaggggccggctgctcctgcaccgaagctgcaccgtgcggttgtagtactgggagatgatggcacctcggctgcggcctatggaggcagctgggcagggccgggccgggcagggccaggcctccctcccctcaggatgggctcaccacaggcctctgcgtccctcaccccttcccaggacccaggaaaatcctttcaacaaagacttcaggcaccactgcattccgaaagcctatttttaccccgtgatgactctggagtcatttttggagcccagcgagggccacatggggctgtgctgggcccccaggcagcagatgggatgggctaggagcccgccctgggcctggctctgagctacgggagcagccactacccagggagatgcctggcaggaagcccagcccagccccagggactggggtcaactcggggccggggccgaggccgaggctgagggtcccactcaccaatggtgcggctgggcatgctggccaggatgcggagtgtggccgtgctctgggtgccctcgggccgccagagtgtctgctggctacttcctacaaagcaagaaagactcaccaggggtcctggagatgccattggccacagtatctcccaccccatcccaggcctgcagagctgggaggcccgtcctgaggggctggggcacccaagtcttggtccacaccacccagcatccaggcctgagctcacctgtcacctcccgctctctctgctgcagctccagcccctcctgggccgtgcactggctctgctcctggatgagctgctggaaggagtcgtgcacttcgctttcatcataggggctggggccctggctgcagagggggttggcgggggggtcaggctccagccacctctctccttccagcagcccctgctcaggtgacctctccgtggggggtggaacattccagcctccagcccccagccccagagcgcttacccctggtcccctggggtctcagggacatcgaggatgaaggccagtggctgggccatgtctctggccaatgcccgctagtctgcagacctagggtagctcagagcctgggcgccacctccggagcccccatctgatgagacaggggcacagagccaggggtggtcttcaacgcctggcagctgtccacaccacccattcctgggggaaccacaggaggtgccactcacagcccagacagtcccgcccacccccctatcaccccaggtacataaatggtgaggcaccgaataagcctcatgccagaatggaatggggggccccctccagtgtcaggggaggggagagaggaaggaagggtgtggggtctgcagttccacatctgtttcctcgatgtcgccagtccctgggaaatggggaagaggtagggtgcctgtagacacagcccctttcaggatctccatgcccagggttctggcacagagacacctcctttttggagagaaaggtcagagtaggctgtaggccttctctgcgtctgccctgtgacctcaaagaacttcctctagcaggaaattagctgctggagccctcacccccaaccagccccaggcggaagcagcacagggggctcctcccccacacacagaggtcactccatgccaccgccgtcagggcgccaaggtcctcatgttctcagaagacccactgccctgcattccatcatcccagggcggccggctgggggtggccaggacctcaacaggcctcctttgtcctggctctgccgtcacccggcacaactggaaccagagcagccttgtctggggccctgggctcggggcccgttcatctgtgagagtggagccaggactcagctcccagccaccagcgagtcctgccggcctctgccctggactcctcctgcgctcaccctcaggaactcagggctcaaagtcggccgggttgaagggcgctttcctcggacaggcaaagcccgggggcgccccgacagagcagctccttgcaggggtgccagtcacaggaccggacggcgccctccctcagtgtcctgggtgccatcttcgggcccaggccccacaccaccccctccctccagcaggagcaaagacgtgggaaaaccagcccagagctgggtccgaggcggccccacccagcctaacacgggacagctgccgaaagaggggctgaggacgccccacccagtccctagagctggaatcccttcctccagacaggcccttctaagctcagggaacccggggactcgggcacccagcgccccagcactccgccccgaggcccaggcaagtccagcggagtttccaggcgcaccattcctgagctaggtggggagaggctgggtggcgcccgtttccaggaacccccaccccagccggcagcgagcttcccgggagcagccgctacccagggagaaccgcaacctggccccagagcccagagcggctgcaactctggggccaccgaacccgtccagccggcctccctgtcccccgccccttcccatcccggccacaccccctcccctcccctccccgtgccctggcgctcggctgggggacctgggtgggggctgcggattttgctccccgcactgtcctccccgcccctgccgctcccagctctgtccgagccggagggtcaagccctgggagctccaggagcacccggggagggaactcggctgccaaatggccccagaggccgaaaggaattcaggggggattgccgctgtccccgcataggagaagcagctggggctggcgggacccgggaccgggatcgcggccgctcacctgggaggcgccggggaggaggggccgcgcgcgcagccagggctcacctgtgccccgcaagagccgccgggaactgaggtctcggctctccttgccaagggagtggcaaagggccccaggggcgactgggccagtcgcaggtctgccggggccgggggagtagccgcac

SEQ ID NO: 2802 - DNA, 19490 bp, Homo sapiens
  source 1..19490: mol_type = genomic DNA
cccatttgcaaaacccctttaatcagaataaatagagtcccaggcagggcagagttcattggggatgcccaagccggattcacccacccttccagctccagcctaggcgcagctgcggctttcgagaggcgaaactgtcttccttgtcctggtgtcccagcagggtcactgggaggcaacagtgtggtctcagggtgctgggcgggcccgtgaggcccatcgccgtccccctaggcatcctgttcatctgtgagcagggcagggggtgccgcagcctcctcggttgtcccaaccctgccagaaagagacatcactgaggggaccccataaacatcaacatccctgcaacctggctgggcgcagccaaggcccggcgagggacaggccagacgccccacagcctttctcctgagatgtattttaggtccctgtcaaaatggccaggctccggaggccagagaaggctctagagagagtgaaggtgggcgccgggggggagatttttgtaggtcaaaagcggtcaagtgtcagcaatgtcgtggtgtagccccagtggcagccctactgtccagccctggcccctctcccctccaggctcagagtgtccccaatccctccacggaccctcacctgctcctctcctccctctccttcctctcgtagatggagtgaagcttgttgattaagaagattttgtcctcaccctcctagaaaggccagaacacaaaggggaggagaaatcatccatcagcccatccagagccatcctgttccaaactgcatttgagggaaaactcacgaggtgtattcaacatcgcaagcagcaaaaacataaaagaaaaggtgaaagggccaccaaacaaggacaaggaaaaaccaagagccaggaagtgggcgtatgtgtggatctaagcttcctagtggccaaagtgaaaagggaaatgtaatcagcagcccagagccagcctgactcaatttaaaaccagccctgccacgtactggctctgccttgggttactaactctgtgacctcagtggcagcatctgtaaagggggataataacacaaggcacagggtttacattagtttcctgctgctgtcgtaacgaactgtcatcaacttcgtggcttaaaacaccaccggtttctcaactttcagttctggaagtgagaagtccaaaatgagtctcactgggctccagtcaagcatgatcagggctacattcctcccggaggcttcgggggagaatcctcttcctcgccttttccaacttctagaggcccctggctctcagccctttcctccacttcaaagccagcagtggctgctcaagtcctgctcacgtggcaccactctgaccctgacactccggcctctgtttttcacctctaaggaccctgagatcacgctgggccaccacgataatctagggccatctcctatccaaagtcagctgactggcaactttaattctacctgcaatcgtaattccccagccacgcaacgtaacgtattcacaggctccatccagtcttaggacggggacatctttggggccagtactggactgacccagggctctttcgacaatgaaatgtgacaagcagagggggcacttagcaaaggatctggtgcaccgaaacactgatcatcagtgcctgggtcagaccgggattccccgcccggagcttcacacagagaacaggagttctgtcaagagccacacggattggctctgggcacctggcaacctggctcagcctaggaggaccacttagaataccttcaaggagagaccatgggccccttaagcaacaacctaagtagcttctatcgagttgctgatgagtatggaggggctgtgcacttgagccatgccgacctgcacggggaaaactcagaccgacagccccaaagacgggtcagagctcggccttgggtagacaccacagccagcatccgcctggagaaaggtccttcccatcccagagcaacggtgggtagagctgggattctcccagcaccactctgcattccccgcccggacccacctggccctacctggcccctgggggctctgaaatgccacccagtagggcaggagccattccccacttccaatatctacagccagacaaccaccgcagccgagatgccaggctttcagctctatgtggtgaaacgggaaaggcaggagatgggacagtgtgtactacagtgtttacaacccaagcaatgtgggagccgtcccatgagtgcttgggacgagctgggacgagctgcctggagccctggatcctggcaccaactagccagcagcagggtcacatggctgccgaggcccactggctgcaccccgccctgccctcgccttggcagacgccagccgctgatccccacaagcgcccccctagccctggtgtggagcatgcctaaggacactggcactcaccagccccagagtgaaaacctgcaggaggacaaatggcaatgggaggggatggggagccctagggggagggcagagcccagcagcaggacgcaagcctggaaaagccacaggacctgcttcacggggggccgttccccaggggaggggcctcggggaggaggccaggctgggtagcccggggggaaagtgccttgtctccaacttggtgggtgcccagtgggcaaggaggtcctcctgggcagagaggagcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacaggggcgaagggagtgggcacagggaccagctgccgggtggacagtactcctgggggctgcctctccggtatggggtccgacccccttctgcaactcactcccatgacacagcatgagggcctcagcaactcgctctgtcgcccgggctggagtgcagtggcgcaatctgggctgattctcctgcctccgcctcctgagtagctggtacaggtggacgccaccacgcccagctgatttttgtacttttagtagagacggggttttgccatgatggtcaggctggtctcgacctcctgacctcaagtgatctgctcacctcggcctcccaaagtgctgggattagaggcctgagcccccatgcccaggcttttttttttttttttttatgagacagagtttcactgtcacccaggctggagcgcagtggcacaatcatagctcactgcagcctcaacctgggctcaagcaatctcctccctcagcctcccaagtagctgggactacaggtgcacaccaccacacccagctaacttttaaaatttttatagagacgaggtttcactctgttgcccaggctggtctcgaactcctgggctccagccattctcccaccttggcctcccaaagcattgggactataggcatgagccccaccacacccggtcaaacattgttttcttcataaaaatgttttggccaggcacggtggctcatgcctataatcctagcactttgggaggccaaggtgggtggattgcctcaggagctcgagaccagcctgggcaacacagtgaaactgcatctgtacgaaaaacacaaaaaagtagccggagtggcggcaggccctgtactcccagctactcgggaggctgaggcaagacagttgcttgaacccaggaggcagaggttgcagtcagctgagactgtgccactgcactccagcctgggtgacagagcgagactccgtctccaaaaaaaaaagttttaagtcctaactctcaaccttaatccacctgtttgtaaaatgagtgaagagtccatagggacccaaaaatcctcacagagactgtctaaaccctcagcggggccacacccgggggctgaaatcacaccccaccccccagagccctggtcccagtggggccctgcgggtccttggggatcaggagcctggctctgtctcacggctacttcgtcacttgatctgaagtgcacgtattgatcagggtcacttgtttggcaaacaaaccctttcaccagccaaggcccacaggagatgtacaggggagtggaggggagcgtcaccctcaggtgacctgagagggtgggggctgagagcagcccaggaggggcactcacattgctgatctgctccttgagcaggcagatgaccttgcgctggccccgcaccacctggatgttgaggtagatcacggccctgcgggagaggggctgtcgggcagggcccagggccacagcccgggagcggccagtccccacacggtgcaggcccagcgagggccatctccccagggccgcccccacctgcgggactcacagcagcagggctgacaccaggaagacaaagaaggtgttttccatcaggtaccggtgcacccagggcagccaggagaccctggggcctgccgcctccaggtggcgcacccacaccctgccggcctcgtacatggtgtccagggtccggaaggggccgcaggtgctcgagggcttcaccctggggaagatgccgaccaggaaccctcaccccgagcaacagttcacccggctccctcccagcccgtcctctgcacccctaagccttgggccccccaggcaccaccacccaacccccagatgacacagaagggtctccctccacccgccccactcactgccagacggcgtagcagaggaagacagcggcgcccaggaaggcggggaagcagagcagcgtgaggaagacggtgctcatgtgtgaggccagccagggccggcgcggcgcctggcagttggccagaaggctggtctgtggggaaaggctgcgctctgccaccatcctgctacccctcagcacccctccaagccctgggggagctcaagagggaagggcgaccagggctgtgcgtccaggcagagcctggaccctgctccctgcagcctcctcatttacagaggaagacagaagcctgccggtcacttgcacgcaaacgggtgatgccaacagcacctccatctgctgaaggtcgctgccatgccaggctctgcacacaacactgtacacaccacctccctcagtccccactggaacatggtccccactgcagggatgaggaaacaaaaggccagacgagacaggagccaggatggccaggtgcggtggctcatgcctgtaatcccagcactttgggaggctgaggtgggcgatcacaaggtcaggagatcaagaccatcctggctaacacagtgaaaccccatctctactaaaaatacaaaaaaattagctgggtgtggtggcgggcgcctgtagtcccagccactcgggaggctgaggcaggagaatggcgtgaacctgggaggcggagcttgcagtgagccgagattgcgccactgcactccagcctgggcgacaaagcaagactctgtctcaaaaaataaaataaaataaaaagacaggagccaggatgggaagaaaggtcccagttctcagccactgggcatgacccagttgcggagagaggcccagcatcacttttccagggacccagaggtcccaaggcttggtgtctcccagagccctggccctacccctggccaggtgcacacaggtacctgctaatgacctctgaacccagcgatgcttcccagcctgccgaagacagtgatgccaagaggggtcagccgtcccttgggcggagggacaggccagggcagccccgagccgccagccccactccactcaggtggggagggttctagtgtcccaggctctgcccagctgagtcctgcccccactgccggccaccctgccagcccagccctccccaggccttggcagcctcaccttcttgacatagaagacgagcagcagcttgatgatctgcacggcggggaggaggggcgagaagagcacccccagcctggggagggggtggcagttcaggggctgctccagtgccctcccctccccgagatcaggctggttccagaccacgggcagggcatgtgacagtggccaaaactgagtccccggggttagggtctgcatcactccagggtccatggccgggcctggctgtggccccagggggaggcaggtacaggacccccggggggaaaggggcactgaccgaggggccagacagtaggaggcaagcagaggaccctcaccaggtcagagtctgcccataaatcagctccaggacattccgggcaatgtcaaactccggcttccgcctcctcttcagcttcttctcggagataatcctgcctccgaggaccccggatcgttagatgggaaagccatgcccagggaggccagcctgagtccccacacccagaggcaccccgcccccagccaggggacatcctggccgttccacagataatgccaagaagagacagccaccagcctgggggaccccaccaggtgcttggtcacaccagcctcatcctaagtaggttcggatacacccggagttaaacaagcagtatcagctccagcaccaaatgattttttcttttttgaaacagggtctggctctgttgtccgggctggagcacagtgacgcaatcgtggctcactgcagccttgacctcctgggatcaagcagtcctcccacctcagcctcctgagtagctgggactacaggcacacaccaccaggcccagctaatttttatttatttttatttttatttctttagagacaaggtctcactctgttgccgaggctggtctcaaactcctgggcttaagtgatcctcccacctcagcctcccaaagtgctgggattacaggcgtgagccaccacaccgggcctcctactgatttttttaatcttattttttattattattaaattcatatattctcgaagaaaacaccaagaggaaaaaaacagctgaagtgccagaacccacagcggaatacctggaacattttttaaatgttcctccgctgtctgttccctgctgtgtgtttttcctttgtatcctagactgaggttgtgtcatatacacgttacttttttttttttttttttttttttggcaacacagtcttgctctgtcgcccgggctggagtgcagaggcgcaatctcagctcactacaacctccgcttcccaggttcaagcgattctcatgcctctgcctcccgagtagctgggactactggtgtgcgccaccacgccctgctaatttttgtatttttagtagagacggggttttgccatgctggccaggctggtctcaaactcctgacctcaggtgatccactcacctcagcctcccaaagtgctgggattacaggcatgagccaccatgcctggccatacacatcactttgaaacctgttttcctttccaatctaaaaatgagttcggttctatttcctgagtcttcctctgaagggtggagacacagggccctgatgggaaaggtccaggcctgagaacctcccggccacacgtcccggccactaaggggagaacactcaccacccagtccgcccaggaccccctcacctccacaccagttccccaaaaagcgtgtccagcaacatgaggacgaagtccatcaccaggaaccggtacagctcctggcccacaaaatcctcccagcactggccctgcaggacgcccaccctgcggcccagccagtggtagcacagtgtccccaggatggccagcttgaggatgaggttcctgcggagggcggggtgcaaaggctgaggggcgggtacaggggacagaagatgcaccccagggcccccaccaggggcttggtcacaccggcctcatcctaagtaggtttggatacacccggagctaaacaaccagtatcagctccagcaccaaatgatgttttcatgtgcggccacacacctgcagatggccacgtacacctccagtaccggggagtcatgcggctccagggcggccaggacacggcacaggtagggggcccccaggttgaggaggccaaccaccaggggcaggaccagcagcacagcctcctggccagcagcctctggactctgcaggggtgcagggagcggtgtcatggaagccccccatccatggtgggagcgggcagctacagggaagggcccggggtggaactggcaggtagcacctccctcctccaagatctggccctccccaggcctcaagttcaaaccacacaggaagcagggaggggtacaagtagtggaaaagaaaccagaaaccaaaaaataaaaccgtgagacaggacaaggggctgagaagtggggctcggagggggccccagcacggggcacagcgtacgtggcaccctgggctggctgggtggaggaggagaggcaaggctgcctccccagggggcaggtgcccagagtcactggggacacgttccaagcaagggccaggctccccccatccccgcacctggatcatgaactccgagaagacgtggacggccacggcgcagcccagcgcggtccccagacacagcagccacacaagccccagcacagccgcctgccgcagcctcccgcacacgctcctggggctgtgccgcagctgccactcggccagcagctcctgcaggcggcaccgtgtccccgtcacccacaccagagcacgggcacacgcagacgtgcagacacagcacaacacacacaacacacatgagacacaccaggaggcttgaaccaggacagagggccagttccccatgccccacctgccctttcatctgctgagggccctccctccaggcgcagagaggacccagtccccctgccgagaggcccctgtgcctgggctggcgttcactcccgaggcctgcctcaacccctctccacccacctccccagccctgcccgctggggcaggggccttgctcagaggtcctttcctgttccctgtggatgtgggtggcccccagtgaccagaagcccccctacacggaatggctcatgacaggtcacagctctgagctccttgaagcacagaaccccagaaaggcagagaatgttccacgaggcccggctctgcagcctcctggccccgcaacctctacgagggcctcggcctctatgcctcagtctcctctctgaggcacacagaaggtgacagtcctcacccactggcctcctatggccaccaaccaagctaacgccagccagggagcatgtgccagctggggcctgaggcctcagggctggctcccgggtgcccacggggccatggcgctactacgcgctagcagacaacagaggcagcccctaactgatgggtgtgtgccagagaaaaactcagggcctgcccgtcactgcaagcagaagaccacgcctgcccagcgccccgagttcagctcacggacagctggccctccctctagaccatggttctggtcacatggtcctaagtggacccagggccaggcctgcagggagctgggcaggccagcttggtgctccggggccactcaccttcagccgggtgcgaatattgtcctgctggaggcgggaggcccgcttctgcgtcaccttgtagtcccaggagcagaagacggtgatggcgtggatgccagaggtgctgcccacccggtagctctccccgaaagagtgagccatgctggggagaagcagacacagacatggcaaccaacaagctgacgggcagaggccaaggggagaaggcagaccggatgctctgggcagccagaccccaccacccactcaggagccatctgggccctgactgggcctcctgccacacccctgccccaccaccagccctctacaccagtctcatccaacatagcacccaccagccacatctgcctagaagagggggcagggctgcattcaccgcggacttggctggctgcctcccagcgagacatggaccagaagatgctgggctcacctcagggcctttgcactgctggtcccaatgaccaaaacatcttccctgcttccttatccatccccactcttatctaaccttcccctctcagggcaagtgccgcctcccctgggaagcagcctgactccttccccagtgctcccataacactggggaaacaccactaagcctcatggattgtcccagcccattcagtggtccatcttctcccagagacagcaagcccccctaggacatttaccatcctgccctgagctgagcacagagaatgtttgtggaatacgtagatgcatgggtggatgggtggatggatggatgaataaatgtgtgggtggatgggtggatggatgaacggatgggtggatgaatgggtggatagataaggaggtggatggatgtgcgaatggatggatgcgtggatgaatgagtgggtggatggatgaatgggtggatgggtgggttaaactgagtggatggatgggtgggtagatggatgaatgggtggatgggtgggtggatgggtgaatgggtgaatgtgtgaatggatggatgggtgggtgaatggatgaatgggtggatgggtggatgggtgggtgaactgattgggtgaatgggtgggtagatggatgggtgggtgaattgagtgggtggatgggggggtgaattgagtgggtagataggtaggtggatggctgaatgggtaaatgggtgggtgaattgagtgggtggatgggtgggtggatggatgaatgggtggatgggtgggtaggtagatggatgggtagatgggtgggtaagtggatagttggataggtgagtggatgagagcagacaggtagatggacagaaggaagaaaggaagagggaagaatcaatgaatgggtcgaaagatgaatggatggatgagtggagctcggagcctgggtcatgaggtggaggcattacctgtacaccagggtgatgcaggtgataaagaagctcacgcccacagtggagaggtaggccaggggcatgttgtagggcaggccacccaccctgggtgtgcactggctgccatccagggggctgccacacggctggttcagcgtggcgttactgtagtggccgtagtacatgacggtgtgggtgaagcaaccctgccacagggagatccagccgagtcagggactttccccacgccccacccgaccctcaggcctgacagccacaggggcagagcaggaggaggccaggcaggggcagtgagggaaacagggaggggccttggccacagcaatcttgggcctccagccccatgggaaccccagcacgatgagcatccagggtcattgagggggaggcggggagctggctgtggccacctggagtcacagcggggcaagggttgggggccccaggggagctgggacaagaagggaacacggtaccagggtagcagaagacaggcaccccccgtcccccagtcctagggcttcctcaccgcgcctgtgaggagctccaggcctgtgcagacgggggcagggcccggcagggcgggtgggaaggcgacctgagggcccatgatgaaggccaccagcagcagcagcaggagggcattgaaagccagcagggtcttgagaaagaggaagtaggagagcacgctggagccgaactggcccccgatgcgcttcagggcgtagcgccacggcatcagggcctgcagggcggagagcagcgccaggcccaggctgtgcaaggcctgcgggcacaggcagagaggccctgagggtgaggccggaggaggcactgaggccaccccagccctgcccagccgccccagccccagggcagaccaggggcccataccagcacgcaggcatatctgagccggccacagcaggagcagaccccgccgctgcccggctggcccctccacttccccctcggggtcctgctcttctctctggggacagaggcagccataggtgcctggaccaatgaggggcctgactctctccttcctggagaccggccacccacgggctcagccccttctcccccaccacctagcccagctgaggaagtgggtctgggggcgcagcagcggcggcatggtcagggtcggggctgctcaccgcaggctgcgtttctcagccaggcttaagggcatcccgcgaagcatgtggtcccgctgtgccactgccaggctctggagctccttcaccaggaggctctgcttctctgcgagagggagagggaggtcctgcccatccccaagtgcccctccctgcagcccgaagccgggaccctggtcaggcctgtgtgtccctgcggcaccgtcccgagacacctcggtgcccttatttgagcttcagtcgccaatcagccgtgtgtttgcttcagtcagcgacaagcaggaagctcacagagcacaggggcctgtttcccacgcacggtccccgactcggggcccagggccacagccctccaagcactccaaggcgcttgtgaggtaagacccccacttccctgtccccgtgggtccctgcagagggacgggggggccttcaggcagcctgctaagggataggagaggggcctctggctctgcagcaccccagccaccgcccaggccaggctggcctcttgcaccccaccccaggccggtgtccgccactggggctccagtgcccactcactcaccctcctcctccagggccgtggggtccagctccaggtcgtacaggcggaggctgggccaggcggagcggacaaagttcccgagcaggggccggctgctcctgcaccgaagctgcaccgtgcggttgtagtactgggagatgatggcacctcggctgcggcctatggaggcagctgggcagggccgggccgggcagggccaggcctccctcccctcaggatgggctcaccacaggcctctgcgtccctcaccccttcccaggacccaggaaaatcctttcaacaaagacttcaggcaccactgcattccgaaagcctatttttaccccgtgatgactctggagtcatttttggagcccagcgagggccacatggggctgtgctgggcccccaggcagcagatgggatgggctaggagcccgccctgggcctggctctgagctacgggagcagccactacccagggagatgcctggcaggaagcccagcccagccccagggactggggtcaactcggggccggggccgaggccgaggctgagggtcccactcaccaatggtgcggctgggcatgctggccaggatgcggagtgtggccgtgctctgggtgccctcgggccgccagagtgtctgctggctacttcctacaaagcaagaaagactcaccaggggtcctggagatgccattggccacagtatctcccaccccatcccaggcctgcagagctgggaggcccgtcctgaggggctggggcacccaagtcttggtccacaccacccagcatccaggcctgagctcacctgtcacctcccgctctctctgctgcagctccagcccctcctgggccgtgcactggctctgctcctggatgagctgctggaaggagtcgtgcacttcgctttcatcataggggctggggccctggctgcagagggggttggcgggggggtcaggctccagccacctctctccttccagcagcccctgctcaggtgacctctccgtggggggtggaacattccagcctccagcccccagccccagagcgcttacccctggtcccctggggtctcagggacatcgaggatgaaggccagtggctgggccatgtctctggccaatgcccgctagtctgcagacctagggtagctcagagcctgggcgccacctccggagcccccatctgatgagacaggggcacagagccaggggtggtcttcaacgcctggcagctgtccacaccacccattcctgggggaaccacaggaggtgccactcacagcccagacagtcccgcccacccccctatcaccccaggtacataaatggtgaggcaccgaataagcctcatgccagaatggaatggggggccccctccagtgtcaggggaggggagagaggaaggaagggtgtggggtctgcagttccacatctgtttcctcgatgtcgccagtccctgggaaatggggaagaggtagggtgcctgtagacacagcccctttcaggatctccatgcccagggttctggcacagagacacctcctttttggagagaaaggtcagagtaggctgtaggccttctctgcgtctgccctgtgacctcaaagaacttcctctagcaggaaattagctgctggagccctcacccccaaccagccccaggcggaagcagcacagggggctcctcccccacacacagaggtcactccatgccaccgccgtcagggcgccaaggtcctcatgttctcagaagacccactgccctgcattccatcatcccagggcggccggctgggggtggccaggacctcaacaggcctcctttgtcctggctctgccgtcacccggcacaactggaaccagagcagccttgtctggggccctgggctcggggcccgttcatctgtgagagtggagccaggactcagctcccagccaccagcgagtcctgccggcctctgccctggactcctcctgcgctcaccctcaggaactcagggctcaaagtcggccgggttgaagggcgctttcctcggacaggcaaagcccgggggcgccccgacagagcagctccttgcaggggtgccagtcacaggaccggacggcgccctccctcagtgtcctgggtgccatcttcgggcccaggccccacaccaccccctccctccagcaggagcaaagacgtgggaaaaccagcccagagctgggtccgaggcggccccacccagcctaacacgggacagctgccgaaagaggggctgaggacgccccacccagtccctagagctggaatcccttcctccagacaggcccttctaagctcagggaacccggggactcgggcacccagcgccccagcactccgccccgaggcccaggcaagtccagcggagtttccaggcgcaccattcctgagctaggtggggagaggctgggtggcgcccgtttccaggaacccccaccccagccggcagcgagcttcccgggagcagccgctacccagggagaaccgcaacctggccccagagcccagagcggctgcaactctggggccaccgaacccgtccagccggcctccctgtcccccgccccttcccatcccggccacaccccctcccctcccctccccgtgccctggcgctcggctgggggacctgggtgggggctgcggattttgctccccgcactgtcctccccgcccctgccgctcccagctctgtccgagccggagggtcaagccctgggagctccaggagcacccggggagggaactcggctgccaaatggccccagaggccgaaaggaattcaggggggattgccgctgtccccgcataggagaagcagctggggctggcgggacccgggaccgggatcgcggccgctcacctgggaggcgccggggaggaggggccgcgcgcgcagccagggctcacctgtgccccgcaagagccgccgggaactgaggtctcggctctccttgccaagggagtggcaaagggccccaggggcgactgggccagtcgcaggtctgccggggccgggggagtagccgcacctcccggcccacgtgggcggggggggggggggcgggcctcggctatcacgtgacccggcccggcccgcggcgcccccgccctcctccgggcgccccgcggcgactatgccttcctcccctgccaacttccgacccctcctcctgaggtctgagctgggctggattcattccagcccctggttgaagtccccaatttttctgacgctcagtttccccaagttccaaaaaggggcaatatttccagactcatctgcttcccatggttagggatcgtccaagtaagatgccgccgaaagccccagggacacagagtatctcactccagattgggcagcgcccccccccccgccgcccccgcaagcctcctgctgactctccccgaccccggcggggggagcctggttatctcccactcctgacacctgggcggggttcattgtttatctagcaagagttctggctcacttcctgtgtgctgtgtggagaggaggggatgaaaaggaggacacgctgacacttaggtgactgtccccaggtgctgtacccgttgccctgttttctgttattccccatgagccaggaaggtatgcactgatattcccatttcacagatgaggaaactgaggctgagagaagttaatcaccctttagggtgcccccagccaaagcaggagacttagtggtccacctgggaactctatggaggaaactgcctttgagattgtaccccccaccccaagcccatttggaagggagggtcattcctggcggggagaagccatgaagcaggcagggtgaatgtgagctggggcccaggagggcaggagagggcactgctgcaggggagagcaggcaagcaaaagcgaggaccaggcaggggtcaaggctggggccttttggagctgccagtgtggtcctcagatggctaccccaagctggttcttggcaagtggcaccctggcatggagacccagcccctgcctctcctcccactgcttccccctccctgcatacccacactgaatttgcatgaatgccacctcctctggggagcctccccagattgaaccctggtggagcacctaccacttcctattgacatgtacatctgtggttctgtgccccctcctaccccagcccactgtgtgcccagcaccagcacatagcttgcgcctgacacacagaaaggactctggaaaccaggaaggaggtgggcagagaggcagaaaagctatgaacattcagacctgagatgactgggccctatagcaggtagagagggagcagagaggaagggctgcgggcttcccaggggcccaaggacagagaattggcaaagatatgtcttaaacatctagcctgggagagcatgaatggagccaattcctgagcacttactaccggccaggtgctaggcctgggtcttggcacaaccataacgccaatgacaggggctggaagtacagcagtaacaccaagagtatctggaaacccagcagccaggttctggggagcccaccatcctgtcattatcacaccctccagggtgaggccggcagataaagagtttggcccctgtgcccccaccgttcccatccccacccatgtcaggctcccagctcaggcctcgaggtcaagtcctgcctatccaggctggaaggagttgaacagagagggcctcagctgcaggctggacatccctggaggcagccaggcggcagacccggaccagtggaccctagggctgcaggagaccaggccctgactcctgtgcagaggggaagggtgggccacccgcagcccagcatgcacagagctccctgggaggccaagtggcctacgcctgtcaccttcacctctgcatctcaggggcccacaggaagtgcctgcttggcctcagtttaaagcagaggaaaccatggggtgagaggggaggagggaggtagtggagagggaagctgggtttcctgtcatatgacccctcctctgggctccctcaccaccctgcctggcttggcaggagtcgtctgagaaggggactcctccagggacttggtccctaggtccccaggtgagctggatgtccagtggagggagaatgcagagggtgaggggctgtgggggccagctagagccctgcaagggtagcagtgggtccctgctcctgtccccacggctggggctgtagccacaggtcctcatcaggggctcgcggggtacctgggactggaggctggaccacaagaaggaagacagaagggggtcccccgacatccagagtcagatgtggcagatgccgagtcccaggaactgtggggtttgggacacaggctcttccggaagggcaaactgccacgtggagaagagagggaattgtctctccttggggtgacggtgggcccaggcacaggtggatgcggggtgcagcaggtcttggctttctttgcctgtgccggtccagactttctgtgccctttggatctttcaccccatttgacagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggtgggtgccacgcgggcgccagacggtgcgtggggggggtgctgcgaggctgccccgtcggatggtgtgggagcaccccgtctgcttggcccgggtgggcagggcgggtgactcaggggcgcccctgtcaccacccccgtccaggcagctgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggtaggacccgcgcgacccgcacctccccttgccctctctggagccccactgcccagatcggaaaaaggagagtggcatcatcccacctgccttcacccgggtcccccgaccaatcggcccctcccccctcccaccccttccgcccgcaggcaccgcaaacctcgggcccacgcagcacccccaggtgactgtcagcggtacctccggactcgggcgggtgggagcctggcgggcaccccacgccgtccggtgggcccgcccttggactctcagcgcggccccagccccggccccggcctccctgacccaccctgctctcccactgcaggcctcttcggcacaggaattcggtcctacttcaccttcctccgcttcct

SEQ ID NO: 2803 - DNA, 12191 bp, Homo sapiens
  source 1..12191: mol_type = genomic DNA
caccaccctgcctggcttggcaggagtcgtctgagaaggggactcctccagggacttggtccctaggtccccaggtgagctggatgtccagtggagggagaatgcagagggtgaggggctgtgggggccagctagagccctgcaagggtagcagtgggtccctgctcctgtccccacggctggggctgtagccacaggtcctcatcaggggctcgcggggtacctgggactggaggctggaccacaagaaggaagacagaagggggtcccccgacatccagagtcagatgtggcagatgccgagtcccaggaactgtggggtttgggacacaggctcttccggaagggcaaactgccacgtggagaagagagggaattgtctctccttggggtgacggtgggcccaggcacaggtggatgcggggtgcagcaggtcttggctttctttgcctgtgccggtccagactttctgtgccctttggatctttcaccccatttgacagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggtgggtgccacgcgggcgccagacggtgcgtggggggggtgctgcgaggctgccccgtcggatggtgtgggagcaccccgtctgcttggcccgggtgggcagggcgggtgactcaggggcgcccctgtcaccacccccgtccaggcagctgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggtaggacccgcgcgacccgcacctccccttgccctctctggagccccactgcccagatcggaaaaaggagagtggcatcatcccacctgccttcacccgggtcccccgaccaatcggcccctcccccctcccaccccttccgcccgcaggcaccgcaaacctcgggcccacgcagcacccccaggtgactgtcagcggtacctccggactcgggcgggtgggagcctggcgggcaccccacgccgtccggtgggcccgcccttggactctcagcgcggccccagccccggccccggcctccctgacccaccctgctctcccactgcaggcctcttcggcacaggaattcggtcctacttcaccttcctccgcttcctgctgctactcaacctgctgagcctgctgctcaccgcaagcttcgtgctgctgcccctggtctggctccgcccccctgacccaggccccaccctgaacttgagtgagtgtgaggcccaccaggggaagtgctccggtgcccacctgcgccatgggggggctggcccagggcccagagcgtggcgacaacgctgggcgtggtcctgccgtgcaggccccggggctctctctccctgacctcgccttgtgtggggcacgcctttggcacatcctcagccccctgcccaggcctccccagggttgggggttatagagcagtagccgcagagcctcacctatgccttggggatccctctctattgacccccttcctcctcaacagccctccagtgccctggtagccgccagtccccgcctggcgttttgaggttccacaatcaactttggcatgttttgactggcagggtgagtgaggtctgtcccggctatggtccagagtctgggagacccagggaactggcttcaggggacacaagtctaagaggacctctgctcctccagggacatttcggctcctcaggggatggtcttacctagacagactggcctggccggtggtggggttagagagaggctgaggccactgtgcccaacatagactcatggacacatgcccgtggtcctcagagcccagctggtgtaggcggtgccagggacaaagggggaaaagtgccccggcctctgggagaagcacttccccaccctcatcctgggaagccatcgagtggtcaccaatggggttcctgggttccagtcgtggctctatttctcaaagccctgtgaccgtgggcacgttgccgaacctctgtgggcccttgtaagacgggacactccctacctgatggggggattgcacgggggctaacaagatcatatatggaaagcacttgagcagagcctggtgctcacccgggctgggtatcttcgtcgctgtccccaggccttcaccaacacctatctcttctacggtgcgtaccgagtggggccggagagcagctccgtgtacagcatccgcctggcctacctcctcagcccgctggcctgcctgctcctctgcttctgtgggactctgcggcggtgagagcgaggtccacaccttcaccccttccccagggaatcttccctgatcaccccttccttggcagggtaccctcccattggcaggaaggcccatggcccggcacagcaggctcctgggtgcttcctcagcccaggctctggccgcaaaccttaggaacagggccaccgccccctaccccgactcctcactcaccaggacctgcacctggggctgcaggggccttcccagacccagagccgagccaaggctgaggctggatggtagaggtgcccctcctccagcagcccctggtctcctgccccgcaggatggtgaaggggctgccgcagaagactctgctgggtcagggctatcaggcgcctctcagcgccaaggtcttctcctcatgggacttctgcatccgggtgcaggaagcagccaccatcaagaagcatgagatcagcaacgagttcaaggtgtgtgcacgagtgagtgcctgagatccacaagctccaggtatatgggagcgagtgcgtgagagccacgtgttccaggtgtgtgcgagcaagtgcgaccgtgccagtgtgtgtgagcgtgtgtgggagggagcctgtgggagcgtgatggagagcgtgtgaatgtgtgtgcatgtgtggccgagtgtgagggcacatgtgactgaatgggtgatggcgagcacgcctgtgaatgtgtgaatctgagtgtctatgggagcatgacagtgtgagagtttgtgactgtgtatgtgagcgtgaatggttgtgactgtgtgtgagagcgtttcctgcaccctttcctcccatgcccaccccgcctgcagctgcctctgtccccacccttccgggcaggtggagctggaggagggccgtcgcttccagctgatgcagcagcagacccgggcccagacggcctgccgcctgctctcctacctgcgggtcaacgtactcaacgggctcctggtggttggggccatcagcgccatcttctgggctaccaagtactcacaggacaacaaggaggtgtcaggcaactgcattcatttaatcctggccagaactgcgggggtgagacaggatgatcccattttacagatgaggaaaccgaggctcagagaggttcaatcggtcgtggccacaggtcacggccaaggcaggcgggctcccactggatattcccgccaactgccaggctgctgcagggaatagcttacaggcgaccctattctgggcctgccccagagttacactttagggcactgtggggggcggggagcagacaggggccccccagcacgcgggctcccctgacctgccttttcccgcaggagtccctgtttctgctgctccagtacctgccccctggggtcatcgccctggtcaacttcctgggtcccctgctgttcacatttctggtccagctggagaactaccctcccaacacggaggtcaacctcactctgatctggtgagtgccacccttggtggggacaagtgggcatgtaacaagtctgcatcctgctgctctcttttggttgtcacctggcacctggggtccccagctgagaggcttcccccttcactagtggcccaagggaaggcaggtacacacctcacagcacacgacctcagggccccaggtctaaggctttccaatcccccacctccaaaggaagccgccagtctggaccaagctccggccattcagtggagcaagggactgtggccaggggtgctgggaatgggctttgcacacaggaaaaccagcaacacgggacatgcagagcttctacatgccgagggtttactccccttacctggacaaccctcacgtgacccgtgaagtccagaccatcctcatcccccttgagggatgaggaaactgaggttcacatgagtgaagcgcccagccaaagtcaagctcatcgtgcctgccaggtgcaagttcaaaagcaagccctcgacctcctgggctcaagcgatcctcccgccggagcagctgggactaccactcccaggttctgccatcttctgtctcagcacttaggtcctgtctagaccccctacttctccacccctcatccagctgcagaaattcttgtgtaaagcccacctgagctcccactggcttctctccctcacgccaccctcagtcaccacttgccctaactgcttttccctctgcttcctcaaagtcagctgtgtttggtttgctttgaaactttattttttgaggccgggcatggtggctcacgcctgtaatcccagaactttgggaggccaaggtggatcacctgaggtcaggagttcgagaccagcctggccaacatggtgaaaccctgtctctactaaaaacacaaaaatcagccaggtgtggtggtgcacacctgtaatcccagctacccgggaagctgaggcaggagaatcactcgaacccaggagacagatgttgcagtgagcagagattgcgccactacactccagcctgggtgacagagtgtgacttcatctcaaaaaagaaaacaaaacaaaaaaagctctcacctacccctagctccctcaacaggagaaccactgttcccagccactctgtagccccatatcagcagtgggaatgttcacccttagagataacacgcaaccaggcacagtgactcacgcctgtaaaggccaacactttggaaggccaagatgggagaatcacttgatcccaggagtttgagaccggcctgggcaacatggcaagaccccgtctctacaaaaaatacaaaaaaattaactgggcatgatgaaagactaggacacacagtcctagctactagagaagctgaggtgggaggatcacttaagcccaggaggtcaaggctacagggagctgtgatcgcgtcactgcactccagcctaggcaatggagtgagaccctatctcaaaaaaaaaaagcaaaaacagataacatgcatgtgatgatgtttcgtttagacaatcacctatttggtctggtcatgcattgtgcagtacatatgtgtggcacgtgtttatgacatgcaagcttgtgtcagtgggcttcaatgtccataggcggcggaggaaaggaggagctcgcctgcagtcaggatcctgaaaaggccacaggcttctccaccgcagggcttgctgcatgtgcctctccacaccaggcatgagggaacatggctggactgtgcagtgtttctcaaactgatctaaaaacagaacccttggccaggcgccgtggcccacacctgtaatcccagcactttgggaggccaaggcgggtggatcacctgaggtcaggagttcgagaccagcctggccaacatggcgaaaccctgtctgtactcaaaatacaaaatttagtcagaaatcgcttgaacccaggaggcagaggtggcagtgagccgaggtcacaacactgaactcctgcctgggtgacagagtgagactcggtcttgaaacaaaacgaaaacacagaaccctttttcccatgaatcgcctggagactcggactctgagaacgcactttggaccacattgccacagacagagcaggttggaaggaggctgggcccaggacacaacatgatcccactcggacatcagccacacctatagcctgggtagagcccggtgcccatgtgcctgggcccctccacctgacaaggtccctgcccccaggtgcgtggtgctgaagctggccagcttggggatgttctccgtctccctgggtcagaccatactgtgcattggcagagacaagagcagctgtgagtcctacggctacaacgtttgtgactatcaggtggctggcagcccggcggggcctgtccctcccttccttctccccaaaaagctcacctcaaactgtgcagagccctgttcctgcccctttagtcacctttgagagaagctgtgagcagggctgcctgcaccgccgcacacctccagggggcgccactgctgccacatggtgtagtgtggctgccctggctgtggggcttcctgctctaatcccatcctcaaggcctgggtttcaacctaacgattctatcagacaccaggcaaggcacctgcaccacagaaaccctcacaggaggctaagggaaggaagggccggggtggccgtgagtggtgacgggtccccttcccctgcaccccagtgctgggagaactccgtgggggaggagctgtacaagctgagtatcttcaacttcctcctcaccgtggccttcgccttcctggtcaccctgcctcggaggtgagccccggggtgacacctccagaagggcgggggtgccgcgagcatgttgggggtggccagtggctacagccaagggtgagcgggtccagtgtggagcccgggagtaagtggcaggctgtggccatgaccaatacagcccacgcatctgtctggagtggtgagtacctggaccctcccatccctgcaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaaggtgacggctcatggctggggggtatggggttcgtgcctctgggtggatgccttgagctgggctcgcctcctgctcctgctcctgcccccttccctgggtgtcagccccctggggtctgcataactcgctgactcctggttgctattgcttgcgcccccagtacaccctcctgaagaactccagggcatcttcgcggcccttccgtgcctccagctccaccttcttcttccagctagtgctcctcctgggcctgcttctggctgcagtgcccctgggctatgtggtcagcaggtgaggggaagaggaggggggcacccagaggctggcaggggcagtttctcacccaggaccctgatgccagccccacttggccatctctcgccagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcaggttctcagggcagccggggccatgggaggggacacctggagggggaggtccttccttccatgggggtggtgagcctgtgcacccccaaccaggagccagacgcagaaagccaagggaagcaggggcctctgaaaagcaggaacctcctgggcccaccctctgggctgccatggggattgcaggatcactggggaagcaccgtgtctgggtggctgcagctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcagctggtgtgggtgagtgtcctcggggctggtgaggggacagcagcttcagtggaaacccttccctatgtgtggccgagggcctagaacacgtctgagcgggtcaggtgggttcttcccactggagggcgtggcctcaggctgagagtgaagacggggaaggggaggaagagaacagctcgggctcctgagaccaggagccagacctggtaagtacatgaccttaggggctgggcctttgcctgtaatcccaacgctttggaggcccaggcaggaggatcggatcacttgaagccatgagttaaaaccagcctgggcaacaaagcaagaccctggtctccaccaaaaataagtaattaattttttaaaaggagaatgtggccgggcgtggtgactcacgcctgtaatcccagcactttcagaggccgaggtgggtggatcacctgaggtcaggagttcaagaccagcctggccaaaatagcgaaaccccgtctctacttaaaaaaaaaaaaaaaaaaaaaaaaaccgggcacggtggttcgtgcctgtaatccagcactttgggaggccgaggtgagtggattgcctgaggtcaggggttcaagaccagcctggccaacatagtgaaaccccgtctgtactaaaaatacaaaaaattagctgggcgtgatggtgggcgcctgtaatcccagctactagggaggctgaggcaggagaatcgtttaaactcaggaggcggaggggcggaggttgcagtgagctgagaccgccccattgcactccagcctgggcaacaagagcaaaactccgtctcaaaaaaggaaaaaaggataacatggctgagtgcagtggctcacgccgaggcgtgaagagtgcttgagttcaggagtttgagaccaggctgagcaacatagcaagacctcgtctctactaaaaatcaaataaatgagctgggcgtggtggcgcgtgcctgtggtcacagctattccggaggctgaggtgggaagatcgcttgagcctgagaggtccaggctgcagtgggctgtggtcttgctactgcaatcctgcctgggcaacagggagacacccagtttccacaaaaaaaaaaaaaaattacgactttaggcttggggccaggggcttaatggagctgagggaggaacagtgacctggctaaggcgtggcctcagggtggggcctctaccgggggcgtggccttgggctgcttggggacggactcttagcgggcgtggtctagatctgcatggggtgggaccctagtggggcgtggtctcagggtgcgttgggggcggggcccttggaggtcgtggtctcgggcggggacgtggaaggagtggcatctggctgcgttgtggacgggactcctgagggcgtggtctagggctgcatcggggcgggaccctggtggggcgtggccctgggagggtgtggcctcgagcggggcgtggcctcgggcggggcgtggcctctggctactttgggtgcgggctggcccatgggccgcagagttgctgccgctgctgtcctcacacccgctcgtgggaagcagcgcctgtcgcaactcgccacttgttctcctcacagcaggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaacccctacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgactttt

SEQ ID NO: 2804 - DNA, 2962 bp, Homo sapiens
  source 1..2962: mol_type = genomic DNA
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattattttagcaaaataatcaagtatgacagccgggtgcggtggatggctcacacctgtaatcccagcactttgggaggccgaggtgggtgaatcacctgaggtcggcagtttgaggccagcctggccaacctggtgaaaccctgtctctactaaaaatacaaaaaattagctgggcatggtggcacaggtctgtaatcccagctactcgggaggctgaggcaggagaattgtttgaacttgggaggtggaggttgcagtgagccgagatcgcgccactgcactctagcctgggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggttggtttgatggtgaatctttgaaatctatttccaggggatggctattgtgagtttcagttccttttctttttttagcgttgactatttcacttcgttacagccctttcgaatgtgttagaacattgttacattaaatgaacttggtagaggtgagccatcttcattctgattttgacaccttggcagattttctacaatgtcagtcttctccaggattcttccactgttaattactctattgaaagtactaaggctttcttgggaaacatcagtctctttgactaaagttagcacatcgattaaatgccacattatcagaaactcctagccaggtctgctactgtcaggaaaagcatatttgtcaagatctatggtcatgtttttatacaaatataggtgttctttgcttgagtgaacattttactactgaaaaatgttagaaatgaataaccagttgctcctgaattatttgaggaatcatctaaaaaataattatttttaagcaatagagaaccagtcccagaaaaatgaatgttctacttaagtgcctcttaagataaaaatacttctgcagcacctttgctcatgattggattcccaagcatgtacagccactgccctatttctgtatgcatttatttatttatttatttatttatttatttatttatttagagatggagtctcgctctgtggcccaggctggagtgcagtggcgtgatctcaactcactgcagcctctgcctcttgggttcaaacaattctcccatctcagcctcctgagtaactgggactataggtatgtgccatcacctccgactaatttttgtactttttggtagagacagggtttcatcatgttggccaggatggtctcaagctcctgaccacaagtgatctgcccgcctcagcttcccaaagtgctgggattacaggcgtgagccacagggcccagcacatactcattcttttttactgaaaagatctgtttcaagctgggtgtggtggcatggagctgtagtcccgactgctctgtaggctaacgtgggaggattgcttgagcccaggagtttgaatgcagcctgggcaacacagtaagaccccacctctaaaaaatgaaaaaatctctctcacattgctttgagtcccgatgtgtactgctaagactctcatgaccacattctctgtgaagtttgggttaatgtttccgtttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 2805 - DNA, 13361 bp, Homo sapiens
  source 1..13361: mol_type = genomic DNA
tccaagagcagagctttaacttcagaattttagtgtatgtacaaaagtccacagctccagctgaaggccccattgttccgtgctcgcccctgccttaggacagttcagcttgctatgtgcttgtccaggcagagggcacaggagtgccaagtttctattagtgtaacatgattgatttaaaaacaaaacaaaacaaaacaaaaacaaaaaaaactgcttatgcactgtgaaaaaggctcagggacgaaccaggggcccccgagcagccttgctggtgaggacacccaaaacgggcatgaggcatagcgtccctcatcctcgcaaaccacccactcaggctcttgagcccacggcgcacctctctccgcgcgcacagcgctgactgtcggcggcgcgcaggcagctgagaaaagctatgtacatcgaggggttagcaccaagtaggcggctgctagctcctgcttgcccctgcaggacccctcctttccagaaaaaagtggggttggaaggcgatctcgcaggacggtccttagagctgcccgcaggggcgcagcctcatctgagaagactgggcgcgggcgggagggcggcggggccgcaaagcgcctcctcgatgtcctccaggcagcccagcaggtccatgtcgcggagcacgcgtcccagcagctccagcgtggcctcgcgccgcggcgtgcgccgcctccaggtcgccagcatgctgtattgcgcctcgcgcaggcagcgcccgttctgcagctccagccgatcgatctcgtggtcgctcagccctaggcgccgcacgaattccttccagcgcaacgggggcacgttctccaccacggcgtacagcgtcgcggggtcatcagctgcggggacgcgggccggtgagcctcgggcggcaaccccaggccccgccccgcatcccgcgccctccgcctctcgtggtcccctctgggagcgcctcccgcgctcccccggccctcccccagcctcctcgtctccagccgcgggagaaactcactgtctaggctctgtggcttgtgggcgctgtcctcccacttctgaagggggttggggatggggtcggaggcgagggctgtcgcaaggatggggtcagccccctgatagggtggtgccacctctctgcggggagccgcaaagttgggacagtcaccgggggtataggtggagctggaggtgaaggtggaactgggcacgggactgaagcccagggtgggggtgaagcctggagtgggactgaagcttgggtttggggccaggggcttagtagtagttccttcaagctccccctgaaagagagaaggtggcgcaacattagtgcggcagcgaaaaccagccccggccctctttattctacgtgggggttgggacttagagggaatgaggcgagcccccggaaagtgaaggatgattccaggggatctgagcattaggcaattataaggaatggtcagggacatttgggagtaactctctcatttcatctcacctctttttcaggtgtcgatttcccacaaactgaggaaaaagaaagaaagcatcataaatttcacttcctctctcagccctggcaccctggactcagctggcagtggggacttgtggtgacatgcctcagggcctatgtggccccagggacgagagagctactgatgcagctcgacatctccccagccatccagggccaccttctgcccagagtccccagcggtatgaactgaggggacactcctcacctccctccacacatgtccatcgcacccacccatgtcctccctcacccccaccagctccctctccctcccaaagcccccactcaccaatggagtagagcttggacttccaccgttggtagcgatacattaaaccaatgaagaggagggataaaaggcaaagaccaaagaaaatgaccaggggcaacagcactgtggtgcctgcagacaaagcaggtgttggtcagaggagcgggcagaggggggccgcagggatagatggatgggtgggatggatggacgggtgggggcaagaagagggagagggcaggtgagcatgggcaccaggtcacttctcctcacctgagtcctcagtgcccttaacattctcaatctggggtaggcacaacttcgtgcactccaggcttttcttacagctaaaagaagagacggcactggtgaacagaggccctaccattggaggaacacagaaaaacaaccacacagattgttggacatcctttctttacaaatatttttgctgtctcttgatataatttgttttgggaactgatgcagaagaatgaaacacagttaatcatagaatcatttaattttagaattggcagggatcttgaaaaggctgtgtagaaaatgtgaaaagcagtcagggtcagggtgtaaattccagttcattccttggctagcagtgtgaatctaggcaagccattaacccccaagcctcggtttcctcatcaccacagggatcgcccacctctcaggattgaggattaagcaaaatcattatgcctcatttaataagtgcttgagaaggtagccagctagctgttatgggattgttgtttcatcactgttttgctgataagaatcctttggcaaagagaggttaaagggctttttcttaaatgacactgctagttacagtacctgacttcggggagtcggggtcaaacatgcatgtgaaaaatttaaaaacacatgttactggggcagccagagagcaccctgtagaactagcagatcttccatgttgggagttgtcactggacagtgtggagtgatgggaactctatggggtggtgctggaaggaacttgagagagtgagttcccagcaggaagctgaaagcagggagaggcactttagcccaccactcaagctcatggtgagaaccacatagaatggtataaaagtgatttcaagaagagatgaagccggctgggtgcagtggctcacggctgtaatcccagcactttgggaggcagaggcaggtggatcaccaggagtttgagaccagcctgaccaagatggtgaaaccccatctctactaaaaatacaaaaattagccaggcatggtggcacgtgcctgtaatcccagctacttgggaggctgaagcaggagaattgcttgaatctgggaggcagaggttgcagtgagccgagatcgcgccactgcattccagcctgggcgacagagcaggactctgtgtcaaaaaaaaaaaaaaaaaaaaaaaagaagattaatggaaaataaatagttttgtgtcagacgtgttgtaggttttgtttgtttctttgtttttggttctcacaaattcaccaaatgaatgtcattatgcttactttaaatataagaaatctaaggcccaggccaggcgtggtggctcatgcccgtaatcctagcactttgggaggctgaggcggaagatcgcttgagcccaggagtccgaggccagcctgggcaatatagtaggaccctgtctctacaaaaagtaaaacattagctgggtgtagtggtgtgtgcctctaatcccagctactcaggaggctaaggcaagaggatggcttgagccctggaggtggaggctgagccacggttgcaccactgcactccagcctgggtgacagagtgaaaccctgtctcaaaaaaaaaaaaaaaaaaaaaacaccaaaagaaaagtcaggctcagagatgttaagaaacttgcccaacgtcacatagccagtaagtggctatgctggggttcaaactctgagagccctcagagtttattctttgcaagtgagtgacaagaacagcctctgtggagccaggagtaaggaggcctggacagtgactaatgaggaaataccatattgcatcaaacctaagacgccatcaagaataaaaggcacttttctttacattactacccagacgcaaacagagctgccaattcaaccatgatgagtcaccagttataggaggtttgatttcagagctataagagtgtatgtcctagaaccaatgagctatcgtagatccaagaatctacatatctgagttggaagggctgccagcccttggggcatgatcttccatcctcaaagacttcttcagatttgaagagcaaggggaaggactgcctggtgtcttaacgaagtgtctcctactcagccagtaggaccctgagcactctggggcatcctggcatctgttgcccagctaatggttcccaccagtcacccgtcccaacccatgccaccatccagtgcccagcagctctcagagatactcacttactacaggagacacactcgttttctcttagaaagaaacctgcatggcaggtgcacacggtgttctgtttctcctggcctgtagggagaagtgcggcacagctaaaggagaagcgcctgcacccccaccccacaggacagaggaagtgacgagggacagggtgggggcggccagagaggagttggttgtcagacccacagaatacaggagggggaaggaaaggaagtgccaccgcatggggaaggggccaacccctggggtggggagagggcttggcctcaggagagctgcgctcacaggagaggtgcacggtcccattgaggcagaggctgcaattgaagcactggaaaaggttttcactccaataatgccggtactggttcttcctgcagccacacacggtgtcccggtccactgtgcaagaagagatctccacctgacccatttctggtgaggggagaagatggggtatgagtcctgcatcctcctgtccctgcatccccttcctgacatacccctaagtgtgtgtctctgtaatacacactcacatccatgcagtgtcccaccaaaacacacaccttcctgcccacacccaccagcctgcacatagacaggcacccacacaccactcaagacccgcctgactctcctgcctgtgcacactcaccctttcggcatttggagcagctgaggcagtgtctgaggtggttttctgaagcggtgaaggagccgctctcacactccctgcagtccgtatcctgccccgggcctggacagtcattgtacaagtaggttcctgtgaatggggccgcagagttaggctgcgggtgagaacacaaggaaggagccccatgctagggacaacagccagggccgattccctgaagtctctaggagaggagggagggagaaaatcccagcccaggagagacagcaaagttagggaagaacaactggaagaagcagagaaagaagcagcaccccagacctgagggcattcaccgtttccacttgcccctacctttgtggcacttggtacagcaaatcgaattattttgagggtggatatattttccttggggacacacactatctctcttctccctgtcccctaggtgagggaccagtccaataacccctgaggggtatattcccaccaacagctccaggagcacctggggaagaatcagatagaggagacaccatcaagagagggagggatgggaagcttaggggtagcagatctaaaacttccctggctcaagtccttcctcagtgaaacattccgcccaggccacgccactcactaagtttagagttcttccttgaaacttagacagttggggccatacaatctgatgcttaattgttctctagttgtcctgtgtgttcatttttgttccctcaactcaaagctagtaggccccagatctaagctgtatttttttttttttaggcaggatcttgctctgttgtccaggctggagtgcagtgatgcaatcactgcaccctccaccacccacgctcaagcagtcctcccaccttagcctcctgaatagctgggactacggccgtgaaccaccatgcccagctaatttttttttatttttagtagaggcagggtcttgttacgttgctcagactggtctcaaaatcctgggctcaagtgatcctcccaccttggcttcccaaagtgctaggattacaggcgtgagcccagccctgtattttatccttactgtgaaatcccccacagcagctaacagtgctggacacagggcagatgttgaaaggatgtgtttttgattgggaattggcaggttacttcagtgatggccccttcttccaacaagcagccctaaagattggggcggtgtttctccatctgggtgctgggttcaccgtgtgatcgctttgcgaacattcacagaggtaaacaatgaggatctatgcacatcccaggaatatgttacaccatgaaaagctttctgaaaaagtcagctggcggtgggggcgagtgatgttcccgtgagcaccactcctggggagtggacagaagaaggaagtttatttacatgtttgtatcaaacctcaatctgcctccgccctcacattccctggcccatcccctccacctcaaaatttacaaacacccggggttggcaaggacaaatggggaggagagtaaaagggaaaggttggggatcctgcatgggtagacgggggacaaagttgagacgggggcaggagtgggcaaaggtgtgcaggacataggcaaatagagctggccaaggctagcgacccagcttggatgactgtcaggtcagagctgagggcgtgctggggagtcctggagccccctgcacaccatggcattctggaaggtgtgctttgcagtctcaggccaaccccacagcagctaaatggcttgtcctgttccggcatcagtgccaggaaagcaaagccaggagtgaatatttagctctaacttggactttgatctctgccagcttcatttctggttttccctgggcttcattttttttttctactataagagacactttgtgtaaagataagagggtgtcctcaatgtctgttaaacactggggagcaactgactcaccagatcacagaaaccctagggcagggaaggagggtcaggcagcccacagccacccagcctcaccaactccacatttcggagcaggaggccagtcaccctgagtcagccacggggagacgctgcagctgtaagctgtgcaggcccggaagttcaagcctcagccgcaaacaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacgccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgggactccatctaatcccttcttcctatggccaagtccctccttcccatccccactcaacccccatccatcccctccccatgcaaagagccaggccacagacccttgtcccacttggcccacatgttccgggaaatgcctccctctccccattccatcccgaagggaagtctccctcgaccctggcttccgcccatcaggtctgtgccctcccttccctgagggccacttggctcctcctagcccctcagcggcctttagctgaggccccgccccagctcctcctcccagttcaacaagtctccaacagctaaacccattccgtgagctctcactccatcccccaacactccccagtcccagcaggaagcaagccaaggctgccctcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgccatcccatgtgtcagttcatcttgcgaggcctccccctgtgatctctcggtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttttttgaaacagggtctcactctgtcacccagggtgaagtgcagtggcacaatcatagctcactgcaaccttcaccaccaggacggaatgtagtggtgtggtcagggctcactacaacctccacctcctgggcccaagccgtcctcccgagctcagtctcccgaatagctgggatgacaagcacgccccaccatgccccgctaatctttgtattttttgtagagacagggttttgctgtgttgcccaggctggtctcgaactcctggactcaagcaatccacacacctcggcctcctgaagtgctggaattacaggcatgaaccacagcacccatctgagatgcctcacctcacttctaatcacagtctgggcacagaatgtgccctaggagaacagcttctgaataaacgaatgaatgaattcctccacctggaaccatattcaacactcttcctccatcctctcccccactccctctaattctcccattcacatttcttagtgtttctcaacatggtttttccactcccgaaccaaggtgtctggcttcctgccaccctgcccatcaacacaaaatcccatctctccattcctctcctcttcctcacatcagtatccaactctgcttccctcctttatagctaccctgacaggcagtgacttcagatgtcagctccacatccacttttctatgaggctttccctccgccatcccatctgacacatctcttgttccttaattccttcagcaaatagttaaggggcacagttaatgtgacaggtcccgtatgggtgctagggatgctgaggtggataatacacagctcgtgctctcaagagctctcacttgagtcaaagacagtcagttgtaggcactgagatctatacagggagtgctgcagttgcacagtgaaggacactgaagcagcgtggggaagctcctgaattttctggagctgagcgcaggagctgagacctgctaagcaaggaaaggcagtggactaaggctcacctccttccccagttcctcctcctcccaactggtgctccaggacaccacatcacaatgcatttgtggatattttcctcgggattgctctgaaatcatttttcactgtaagccatcttggttactaggctgtaagctctttgagagcagcaaaatcctgtttgctttgccacagtctctcctgtatcattcttccctactcccctaccccacttctctctctctctctctctctctctcacacacacacacacacacacacacacacacacactgtgagctctgcattgcccactgaatggtgagaaattcagaaggatgttgcattccctttgttttccctttcctccagctccaggccaggcttctgtcccttaggagacataatcccacctgggctgaagcaccccaggacgcaggcacttccctttacctgttcaggctacctttaccctctgttttcccaacacaggtagccacccagtaattactactagtcacagcaatataaaaactttattgagtgctttctatttgctacaacctattcccctgatggactgtcaaagctgtgggcagggattttgttctctgctgtaatcccagcacctatcacagtgtctagcccagagcgcacacttaataaatcaaatgaacacttaacatgtatcagtctattcaatcttcaaaacaacagtatgaggtcaagactgtgacacccattttggagataaagaaacgaaggcatggaaggttaggttatataagctgctcttgttcatgcaggaggtatgtgagggagccaggggccgcccccaaacagaaaacagaagcaggatgtcagggcagctggctggtggggagaccgtgggggaaggacagtgggaagaagggaagagcgggtgggactaaggaggcaggaggaggcagaagaagaagagtgagaccctgaccagagacgtgctgcctggggacctggggccgggaccagagcggagcagagaggaggggaaggaggattagcgagaaaagatttcaaaaaaagaggctctgagaagtctgaggagagtctggggagattgctggaagaaaggaatggtaggagaggaagagtataaggcactaaagagaggggaggtaggcgcagccttcagaggccgggcagggcagggaaaatctgcctgactagatgggcccaggacatctgaacaggatgattcccggaccaagacgtggaggacgatcaaggatacattgaaacaaggctgaggccagagaaagggacattttccagtgacgaaaacaactttctaccaacttccccaaactgaactgtagaataagaaaccaagggattgttgtttaggtctgtgagaagcagcggggaggggaagctggaggacaggcccagggacactgaccaggtgggggtaggactagctccctgggaaggctcagtcccacagcggctacctgcctagcagcaggcaaaagggtaaagaatgtccccaggtgagaggccggggcttggccagggcactggggacactgtccactgggttgccctgccccatccagtgtcccagcccattctcaaatacctcccaccatgagcatcccaaacccaccacaccagcccatccccactcctcaactcactcccccacttcaccagccgccaaaatcctgccctacagggtgtgctccaccaagttccacaggcagcctcgcctccccacggcccaacaccctccaggccagccagctgaccggagggacagaattcagaaccgtctggactccccgagcactaatcttcctactcccactcccttcttttccccgccaaatctgccccaccctgggcctatctcctgcccacattcccttggccgcccacaaacttccaccgctgtcaggggccagggcttccttttactctctccctttcaaacttctcccattcccctgcctcagcgcagcccctactccaaaaggcggatgaatggggaaccccacactggcagtggctgaggttaggacctgcaggcctgaggctggcgccaggaccaggcccgggcaggagaggctcggccccctcccggagagggcccacgccagccggaaggtgcctcgcccaccagcccactcttccctttgtccctggtctcaccagtggcagcagcaggtcaggcacggtggagaggcccatgccagacagctatggcctctcactcccccatttgggctcagggcagtgtggcagcggcagtgctggggcttcccgggactcggtctgtccaggacgtcccaagtgccttggggtgacagttgagggttgagactcgggcatagagatcacggcctggtcccagtgatcttgaaccccaaaggccagaactggagcctcagtccagagaattctgagaaaattaaagcagagaggaggggagagaaggtgggaggggaagagtgaggcagtgttgcaacagcgggacaggaagagctggaggag

SEQ ID NO: 2806 - DNA, 18000 bp, Homo sapiens
  source 1..18000: mol_type = genomic DNA
tcatattaaattaaaagtaagaaatttatttcttctgtaatatgtgtcaaagatattatgaaaaaaagattagaagtcttttcccccatttttagtaatcttgatattatgaaacaagtgagtactaaaacaaaaacaacaataaatatgagcactacagcaaacatgacatactgtaatagaattttattgaaaaaaataacacgtacttactgaagttttttttttttttttttttgaaaccaagtctcgctctgtcgccaggctggagtgtagtggcatgatctcaccacactgcaacctctgcctcccgggttcaaacaattctcttgcctcagcctctcaagtagctgggactacaggcatgtgccaacacacccagctaatttttgtactttcagtagagatggggtttcactatgttggtcactatggtcttgatctcttgatctcgtgatctacccaccttgggttcccaaaatgttgggattacaggtgtgagccactgcaccaggcaaactgcgatcttttagtggtgcctcttctctcttttgacttaaggatgttgtcccttaaggaaacctggaggctactactgtgatacactacttgagagatggattgttgctctttcttctacagtctttacaaggagtagattataaagacagaagatgttaaccattgcattaatgtttggaagctgacagtcttctagatttctgctagcaaactgatatgaggtagagtcctgaaagatctttcagcaatttcattctcttgggataagtgagtcactttcagaacagtgtgtgttgtagaattttttggttgtggctgctctactcagattgcatagaggtttttttgttttctgttttctgtttgtttgttttggtcagattttttgaaacatcttcatagtgtatcatcctgaaaactgaatagtcactttgaggttattgctttttctttccaggtcagttagccaactaaaaaggccccaaaaaaactggcttcatggtccatgtctatcaagtgctcatttgttacagaaacaaaaattctgtcattttccttaagctcaaatattcccccttgatagatggaatagagtccatattctgcatctttagaccaacaactatttctagcacttttcatcaacaatatagggtcaggataacttgtgtatttgtaaatatattggaccatttgtttgtcgttctttgtgttttcttttatttcctcctgaaatcgaaagtatgtttgggaatagatgtagtaaaaccctttttcatggatgaccagttcaccattcctcaagtgcaagttgctcaggaatgaatgcccactccttgatgattcccaggagtttattttgcggcccagagccttttcattcttggagtctgtaggaaatttagagagaaagagcgttaacagaagggaatttgtagcaaagcaaggagcttttttgcagctgtggccagcctatatttttgttgggcttgccagggatttcaatctaatatcaaacttcttcctccttcaatcttaatgtggattataaattctagtcacatagaaattgggaggttcctgcatcattgtgacattgggaactgttgggagtcccttgtctttttataccttgtcagctgcttatgccacatgtgtcacacttagaatggtagcacaagggatggcccactcagatagcaatggtttctcctgggcagaacttctgccctgaatctgttcctcccgtcttgtgctggtgaacttaagtggacaatccagaaggaaaccgaaataaacgtatctatttctttaggcctaaatctcagaagttcttgccattccttttggactctttgggtccccccttgatctttctcagctctccagagtcaaaggcacatccaagcagatggcgtctctagccaaaaataatagaggcacaaagttggcaaaggagcctagatttaaagatcctcagatccttgaatctttcacactcaaaggttttgaatgaaaaatgaaccttccaaaatgatattcatttacacttttagcctatctccacgattggtgcaaaattgggcttttccagagcgtaaaccagttatatttattgatgagtagcaagcagtaacatcataataatcccctcacttgtaggcagaacatgacaatcatttataaaacatgagtccaagaatgtcaagaaggcaactacccagaagaaactaaaccaaccaaccaaccccaaacccccaaacaaactttttatctattaactgatgtctgaaatatttttagacaaatttacgggataaagcctctgacaaaaataaaggtgagtatttcttgaggacatacaatagaccagacattttgcatcattttgtgggttaagatttgtctcatctttgcatatgaagaaactgaagcttgactaggttaagtaattagctcaaaacatgcatctaggtgaagaggagctgtgattccaacctagatatttacactataagacccatgcacagaggcctggtgtggtggctcacgcctgtaattccagcactttgggaggccgggggggtgtggatcagctgaggtcaagagtttgagaccagcctcgtgtagtggtgcatgcttgtaatcccagctactcgggaagctgaggcaggagaatcgcttgaacctgggaggcaaaggttgcagtgagccgagatggcaccattgcactccagcctgggcgacaaaagtgaaactccgtctcaaaaaaacaaaaaaaaaacaaaaaaatacccatgcacagtattacatagcaacatatcgacacatgttctgcctatatataaattagatgtaacatatatggttaaactatatgaaactgacatttgtgtaagtaaaatatggtcaaatattggcaatctcctgtggtttaatttaatgtaaatgccactaggagcacctagtgattcatagggatagtaaatgatttagaacctttaaagagaagggagatttgatggcgagcaaagaagagaagtgcagagggatggaagaagtaatcataagagagaaaggctgggtgcagtggctcacacctgtaatcccagcactttgggaggccgaggtgggcggatcacctgaggtcgggagttcgagaccagcctgaccaacatggagaaatcccatctctactaaaaatacaaaattagccaggcgtggagctgcgtgcctgtaatcccagctacttgggaggctgaggcaggagaattgcttgaacactggaggcggaggttgcagtgagccgagatggtgccattgcactccagcctgggcaacaaacgtgaaactctgtctaaaaaaaaaaaggaaagaaagaaagaaaaagaaagaaagaaagagcgagaaattactctaaagaaggaaaaaaaatgggatcctgaaaactgcaaagacaaaattctcccactttgtaattttcctgaggccagttatgtcgtggcaataattgagctgtttgtctgtaatcttgcatctgaaaacagtcaatctgagatctgattaatactgagcattttgtagatagccatataaacatttcagataaaattctttaaaaaataagttacttggcacaatccttccattattttcccttaagtcacttatttgttgtttctcttacttggagaagacaatgtgttgcttcttcctctggtcccagttatgtgagctgctactctctgaggacctctttctctcactaggggagaaatattttgttgcttttctaaaagagaaatgataaagggtcatcaacacttgccaaactagttctccaataccttgctcttcataggtgttgtcaatcagccatcgtaagcatactgggcttccaaagttgattctatgagttttcataaaaataacattttgatattatgatcaacctacctcagcttatgatcaacttgaaaagtactttacacggaaagaataagcagtaacatggattataatttattagtgtctcacgggtagggtccaaagagaaacaaagtgaagatacaacaaagtgaagattctatcccttttccaaaaatataaataaagaaatagctgtagctgtgtaataatcctgctgagttaaattgtgcaaataactacgtattggcaaatttccaccttgaattacatacagaaataaacagagtggtaccaacaaacagatggtcaggagattgagactatcctggctaacacggtgaaaccccatctctactaaaaatacaaaaaaattagctgggcatggtggcaggcacctatagtcccaactactcaggaggctgaggcaggagaatggtgtgaatccaggaggcggagcttgcagtgagcagagatctcaccattgcactccagcctgggcaacagagcaagactccgtcaaaaaaaaaaaaaaaaaaaagaaatgtaacaaatgactttctctaaaagaatcagttcaaacttcccaagtgtgcttacattggttgtaagtaaattatattctttcatcaaacagacagtgctagggtaaggcactacaccccagagggctacaaatattaatcactgatttcactgaccatgtcctcaagggacttacagccttctacagaaaatatgaattagaaagtgacaatttggaggccaagatgggtggatcacttagcctgagagtttgagattagcctgggcaacatagtgaaaccttgtctctataaaaaatagaaaaatcagccaggcgtgttggcctgtgcccgtagtcctactattcgggaagctgaggtgggaggattgtttgaggccaggaagttgaggctgcagtgagccatgatcgtaccactgcactccagcctgggcaacagatttgttaaggtcatttcaaggatatggataggaaagcctagatttgaaagcaaatttttaaaagaggaaatttccaactggttatagcaaacacctcccaaaaaagaaacctgcaaatatgtatatcgaggtaccatggatatatcttggtatacagagttgtgtttcaccttactgggatgaataacaaagaattttattcttccaacactgaaaacagtacatgcatctatctgctgtagaccattaatctggtatgcctcatctgaataggtggagtgttcaacattctcactactgctttcacctttggagaaatgataagaaagaaggcttagaccccaggaacaggtcctgtcctttatatttaagaaaacatatttaataaaggaaaatgggggtgccaagtgatgaagaagtttattgcattggaaaagaataacagatttaaaaaaataactgaaaggaaatgaacaaggtacatgtgataaaaataacagagtgcagggaatttacttagaaaggtgtccagggaagccctctctgaagaggtgacaattacgtgagctgtaaagtacgatggagtgccagatggaaagctaaagaagccagcctgggcaacagtagtgcacagagaggtgggtcgagagaaggctgctgaccatgaacaagagggtggtgtggccacaggtggagaccgcaggatgaggatcgtgggtgggtagaaagattgttgggaaaaggatgatggaggaggaggcttttgtaaagaaagacctggagcccagtggtggcctgaaacaaagaagggtaactttaagggacttcatttatttctctcaatttcccagaaacgatttaagatggcttctttgtaacacattagaaggtagaaactaataagtgaagaaattaaggtgaaaggaaaattcatggggaagaataaaattaagttgaaataaagttctgaccatagatgggccacagatttggttctgagcttcctagctgccaatgtaaagagggaagtagaatcaacaagtggcttgagatacggagcagcagatcagaggatggatgagtggatgagaacacagagaaggagaatggagaactattcacaacctgtcatgaagatgacagtaaaaaattaaaataacaacaaaaaagatactaccttgaactgtagaaatggtttcctcagaggttctcaaaatcatctgcaaatattattgaataaagcttgttaatttccctaaaaatttaaactgactatagaatgcctatggctcatcttgctgatgtctaacaggaaatttctacatgcattatcaatctgggaagttttaagttggtcaagcatagggtctgtaaggggtggggtgggagctgggataaatattgagatagctgtcccagcacagcaatcaagggatggtcccctgcctgggaagttctgttgctggatgaagtcttggaaaggccacacctggagcagtgcaggaggaagaagccatccgccatgtgatgtcagccaaatgtggctgatgggtgtggcagccatgtcatgtcactttctgtgtgtggggtgtatgtatgtgcacattcatgtgtgtgtgtgtataagtgcactgggtagcagagcccaggggcttaaaattattggacagacccaagcctcaagatgcagggcacacttcctctctctcaggatgcccacagacatacatagcctatcgaggtataacctgacaacaccgtgtcattctttcacttctgagaatgtggctgagccattctcaacataaagatattttaccatcttcccatatctttgctaaatatctagtaacctcccccagcctttgtactaaccagtggggaaaaccagtaagaaagagtgaaaaccaaacctctctattaaatgggaagaccctgacttggctcatccatggcttctgaattcagctctgtccctcctgccaccttctcccatcactgccctctttctcagtcactgtagttaatgttgcaactgtcagaaacttgccttctctgtacttccagcccaaagcagaagctctctgcttctccctccaccgcaagccctgatgccggataatgggggcagggagtggtggcggtggactgactgtaatcagttccctgggcactgacttacgggaaggggaagtgagaggaaaccacagcattctctcttatctctgcctctcatttctctctgtgtgtctctctttcccactcttactctctttctcttattctgcaacagaaaggaaggaaagaaggggaagcaacaggaaaaagaaaagggtctttcctacaatgtgggaggcaaaataaaaagagtgactagaagcatggccagatgccctgcattcaaatgtttcagttactggctctgtgagactgttcaagttatttaactgatctaaacttcaatttattaatctatttttaaaatatatttaagaggataataacgatttattattcagagctgtcgtgaggattaaatgagataatgtatgaaatgggcataggatatttactggaataaatctgttcaactaatgtgcctgaaaagaaaaagagaattatttttcccacattctcacctattccctctgtgttctctcccagcttcccgctattctagttggtagcaggatgtgagaatgggagggagaatggcaggaatagcaggaaagagaaatgtcctcactatttctcttatctccccactccctgtccacagcacccagccctctcctcagtctccagatttccaccctagttctcagtctctctgccctgctggacaatcgcacctccaccctccccaagcccctatcccgggaacttgggagtttcatttctcagcttcctcaggacctttctccagcccaggcttttcctagtctcctggtccttgccccctgaacacttgctgtcatttgcagtggtggaatcatagctgcttccgtacagcttgtgtggagtgggcccccctgtctggagcaatgccgccagggcagccacagaacaggtatgtttctaggactcctagaaggaagtctagtttcatttcccatagaaatagcatctcacatgtgtcagggctctactgtgaaaacagctcaggattatcagcttgatccctaaccaccaacataacagtatttatatggagaaacagatgcagaacaccaaacaatggacttataaacatgtgtaaaacacattctcctcctaccctgggaattcccccagttaacgtctttaaacaatggtggtgtatgtggtacttcatagtttacagagtatttttatagctgtgttctcatctgatattttcacataggcagaagcaatttttttttttttttggtttttgagatagagtcttgctctgttgcccaggctagagtgcagtggcatgatctcagctcactgcaacttctgcctcttaggttcaagcagttctcctgtctcagcctcccaagtagctgggagtacaggcacacaccaccacactttgctaatttttgtatttttagtagacacagggtttcaccatgttggccaggctggtcttcaactcctgacctcaggtgatccgcctgcctcagcctcccaaagtgctgggattacaggcgtgagccactacacccggctgcaaatattatttaatgccatcttataaagaaggaagagcctaagagaagaaacttgattagatctgtcactctgccacatttagtaaaataaactgttaactaacatgtctctgctggaggtcctgtttaagcaacttccataaacagatactttttgtaatttgttatttattggctgtaaattaagaaaaaaccaccttcaatttctcaaagtatctctttcttcccttcccttcctttcctctttctttcctcttattttcctctttctttatctctatatgcatacaaaaacaaatatttaattccagacatcagcaatgtgggaagaatataaaatatcattatttgatcttctttatcttttgaatgaaaaacaatgccacacattctttatgactttgtgaccttctcttcattaccctgtgtgtgcctcagtttccataatgtgagatcaaaaggttagactagatgtggaggctgtccggggcagaggaatgaactctagaccaggagtcggccaggtcctgccctttgctgctatgccccattttcctagttctatgaatttggggaaaattacttaaatactctgggcctaagttttcttatttgtaaaatgaagagtctagacttgattatcttaaagattcctttgctttaaggaattcttctggccttctccgcctgctggtgaggtcacctggtgaggttacctacctttctaacgagctgacggagttgccacttgacttgccagcaggggctgttcatactctcttcgtcattggggtcccaataactgtcatcttcttttaagaaacaagcaatgccacttttggagtacttgtcctgcatctgggttgagatggaatataacacaatattttgcataagtgctttttatttttgttcatttggaagttaagacaacagaaactgatagcagacttaaagaagttttggcatattgagtaagttcctgtttgaaataaaagtaagcatgctctcctttgtccttaaaaaaaaaaaaaaagaataaaagtaagcagctggatatggtggaaaggatgcaggtgtgcttcaggcatctggagtcacagtgtccttccctgcctcccttactaaacagctgtgcttttcttgacaagttgcttccattctcctgtgtctgtttatagttttgagccggttcactatggtgattctgaggtctcttccagttctgccatggtatgtatcccattttgaagctggaaacctacctagatacaaggtcggtagtggagtcagtttacattttaggatcctaaataaaaaacagccaagtcatttgggagggggtcatgttctgtttctagctgtggctagctaaatagattctagttactgatctgatttctactcctctggctggcaaaatctggaccatgttgccactagaaatctgaatgctgtctcattaaatgtttacactaactagggatttattggtagagaccttaaacactctttgaaggttttctccctgttctgattgaaagtaaacaatggcaatagtcagatcattatcaacgagctcctcaccctcatcaacaaatccttgcttgatgttataaacacacacacacacccacacacaccccatcccaaaccacccagaactctttaggctgataattgtttaattgagaaaaacaggaaacagaaggtccaaacaaagccagaagggttttgtttgtttgtttgtttgctttgctcatttcttctcttccgttttgttttgttttaacaagtgggatggaagagacgttatttccctgaaaaaatctgctgaattggccaggcgcggtggctcatgcctataatcccagcactctgggaggccgaggcgggtgaatcacaaagtcaggagatcgagaccatcctggctaacccagtgaaaccccatctctactaaaaaaatacaaaaaattagctgggcgtggtggcgggcgcctgtagtcccagctatttgggaggctgaggcaggataatggtgtgaacccgggaggcggagcttgcagtgagctgagatcgtgccattgcactctagcctgggcaacagagcgagactccatctcaaaaaaaaaaaaaaaatctgctgaattgactacctagggaaataaatgagaaaatgacaattttaatctgttatttgaactaaggtactgcaaaggttgaagggaggatcaaattgaacgatgattcactccttcctatagaaagacaatatcattttaaatcaaaatatcttaactgtttatgagaggtcccagctagaatcacacagttctgtactcagccatgtaacccttggacatttggccaaggtccctcaaatgcaaaggtgcaaacttgagttaataaatttcttccacacaccctgacatagatcattcatttacttttaaacaaatgtttattttgtttcttcctcttttaaattacaagagaaaaacattcccgtagtatatgtagttggaggtgaagctggggcctcctgagttgagatatgactggccatggacttaggtacatttccttgcccctgcctgccccacctgtaaacatccagttgcacctcgaattgacttgggagatgcaaaacctttccaaggaaggcactcagtcacatatgattcagaaatatgagagcatgtctagcaaactgtgggaaaggatcaagaaggaagagacgagaaactgggatcagccacaaggcccgagggtggttccaggaagagcaaactttccctggacactgtcccagttcactcagtatgagttggctctggccaagcttcggtttgattacactgaacaagcaggctcacaagtctctgtaacttgttggggcaagaaggtgtgcataacacagaaaggagggagcggtatgccttttcacttcacatcagctgtaagctatctcagcaggaaatggctgaatatgggaggcttcagctgtgagaggcaaggtgcagagttgaaagctgcctgtgatcaggcagtaatggcagcaggcaacaacttatcaactgaggtggagtttgacaaggatggtcgtggtggagcttgtgccacagggactagcccaggttagcaccaattgctggctagagcctgtgatcccttctgagtattttccagaaatactttcaggaggaggtggaaggaacctggaaaattgagtaaggtcctgggtataagtggatgggaggttaacaagttaatgtagctacattattacccaggagtttataaagcctggatacattcaggatacacaggcaagcagggaagcatggaaaagtaaagaacacttttctaaaagaaaaaaaaaaccctccaaaaactaaataagtaaatcacaaaaacaaaacaaaacaaccactaatagcagctatattctcacctcctacttaacctttggatgatatctcttgtttacaggggtgagatcagactgtgtgtgtgcataattttgagtatggttgttttctcataagactatataaaaatgctgtgttctttaaatctgtatgaaaattatacatggatagcatggatatttttataacattccctgtagaaaatttgtaaaatatagaaaaataaaaaggaaaaaaagtacccataatcataccatctagagatcacattgtcattttggtgtttctctttctagacctttttatgcataaatattgatttctgaacaatagaaatccagagaggaagccccagtcactctctccaccctcacatgtttcttgcatcatgaattttggtagtttctcctatagaacttggccaatgctggtgactagacacatggcgggttgacgtgaggtgctgtggttattccaagaatgataattaatacgatacgtctcccccgcctcctcccatcctttccacttcaaaatatgagtttcctgcagcatatcataggctgaggctatattctctaactaaccacacttgggcattgggggcagaaggtagcgtgtggggattattttcatttgcgtgcctctgaaaagaaagctcttgcactgggtgcctgttcttcagctccagaagcccttggttctgaaaagtggatttccatggtgactgctcttggtgctgttacaaacacggtggttgtctaggccagggtcaaccagtccttgatggggcttgaggtcagcagggtagactcagcaaggtagacttcaagatggcagcaatgaccctgtctgctgcccagacattagtctctggcaatcattttctgcaaactgcaaatagcataaaggatcatttatggagatccgtggagaggaagcccttctcctttttcctccccatctatgatgtcacagtgacaggccattcctttatcataaaactttctcagagggacacagatttcaggggctaagcccatatttgttgttcatgtttgctggtctacaggctatttgtgaaggtccaatccaatgttatgaagccttccttaacccttacaccctataatccttgcagagtgtatcttctgcaaatgttcaccagacaaagtggagcctgtattcaattttaagaaattaatacttatgttgaatatacttttccaaagtctacacagaagattcaaacttattttccctttggaaaatttctgatgaagaaagtgacaccttcaggagacttttcagcagtaattagaacgctactataaaaatagcattgtattgtattgaaaaaatgtattgtaaaaaaaagtaggtgcttcaatttattgagtacctccttcatgcctgggttcaaaatcaggttttaccttttactagttttgtaatcttgaacaaatctcttaacttcgcctgagctttagtttgttcatctgtaatatggggtaattatacttacataatagaattgttatgagaattgaaaccaggcaatacttttcaaagttgctggtacacagtaattgctcaatatctgtaattctcctagctttctagcactctcaatgaattcttctgcatgcctaatgtacatgtgttcatatgtcaatatgcaattaggaaaaatgtatgcaagtgggaagatcttaagccttatatgaaatttccatttttatagtagaattgaaaaagaaatttgattatatatacagacaattgcatgagtcagttgagtaaagaactggttgattcaatcttaaaattagtccaacttgtaatgtaagcaaattgatggagctacttgtgtgtggagtaacagctttactctgtttatgctgcaaagttaagaaaggttaggaaattctggctccaaattggtgaacatagcagtattccagtctctcgtgtagacttaaagctaaaggtatgattacagtttcattaatatttttttcttacaaaagaaaatcttttctaaatgtgtcctacaataaacctgactttactggtcatctaatagtagccataattttcataattagttgcaaataaaacaagagtctgcctcatccatttccaaaagaaaaatttccgactgattgggataaccaaacttacattccacaggatatgcaaactacatttccctagcaaatagttactactctatgtcttttgcacaatttatacttttctgagatccttagcctttcatttcctagtcagctggcagagttggtgctgcaggatgcgctgtgcatgcacagtgtacatcacaaggtgtagataggttaaccctgtggacatcccactgtggagggaagagcctacagacctgggtgctagccgccccacggccagcctccaaagccttgtctgaacttgagtacattatttcttgtctcctcgtctgtaaaaagtggttgtggtggtggggggaggatctgacgttccttgcagctcataattctctactatttaatatacaatgaattaaaatatatattagaagtcaaaaactgagttggtttattttcagcaattttgcagtcatagttccaggggttttcatcgagaaaatcataaattaaaatagcactgtttgtttgttttgtctgtcaaagatacctcaatttgtacatggaccatccacaggcagagattggcagtttgcttttcaattgttttatcatgaacagctgtgtctatctgataacttctttattacagattttacccatgacatgcccgtgccccaggaataggcagaatgccagtcctttgtattctcacttattgtcaacacaggaatgccacataactaaaagcaaaacatttcaaagatgtgaaagttcaccaggactagctacatctggaatacaaaacgggagtgttcagtgacttagggcctggctttgggttgagcctgactctacccttgtcgcctgcatattcgtggtgcctaccacatctgtgaaggctgttcattcactcaataagtatgtagtgaaccacaagtattagtattagtggctacttgggaaccacatgctagacccagaggtatactaatgagcagaagcagacacagctctgatacagctaccctcaccctcaagaattcatgagtcaagaactgtaactccaacctgcaacaacaaagcagggaagatggctacagttaccaaaacagcatgttactggtatggaaacagatacatagaccaatggaacagaacagaggcctcagaaataacactacacatctacaaccacctgatctttgacaaacctgacaaaaacaagcaatggggaaaggattccctatttaataaatggtgctgggaaaactggctagccatatgcagaaaacagaaactgggccccttccttacagcttctacaaaaattaactcaagatggattaaagacttaaacgtaaaacctaaaagcataaaaaccccagaagaaaacctaggcataccattcaagatggcatgggcaaagacttcatgactaaaacaccaaaagcaattgcaacaaaagtcaaaattgacaaatgggatctaattaaactaaagagcttctgcacagcagaagaaactatcatcagagtgaacagggaacctacagaatgggagaaaatttttgcaatctacccatctgacaaaggtctaatatgcagaatctacaaggaatttgtttcttgtaaaacaaattgacaagaaaaaaaccacatcaaaaagtgggcaaaagatatgaacagatacttctcaaaagaagacatttatgtggccaacaaacatgaaaaaaagctcatcatcactggtcattagagaaatgcaaatcaaaaccataatgagataccatctcactccagttagaatggtggtcattaaaaagtcaggaaacaacagatgctggaaggatgtggagaaataggaatgcttttacactgttggtgggagtataaattagttcaaccagtgtggaagacagtgtggcaattcctcaaggaaccagaaataccatttgactcagcaatcccattactgggtatatacccaaaggattataaatcattctactataaagacacatgcacacatatgtttattccagcaccatttacaatagcaaagacttggaaccaacccaaatgctcatcagtgatagactggataaagaaaatgtggcacatatacaccatggaatactatgcagccattaaaaagaatgaattcatgtcctttgcagagacatggatgaagctggaagccatcattctcagcaaactaacacaggaacagaaaaccaaacactgcatgttctcactcataagtgggagttgaacagtgagagcacatggacacagggagggcaacacacacactggggcctgtcgggggtgggaggctaggggagggagagcattagaacaaatcctaatgcctgtggggcttacaacctagatgatgggttgatgggtgcagcaaaccaccatggcacatgtatacctatgtaacaaacctgcacgttctgtacacgtatcccagaacttaaagtaaaataaaaaaatttaaaaataaagaaatctgtttgccagaattcacaaagagcaatagacctcatgtgagttatgaatctgaacttcatcctgctgtgtgctattggataaagactctaagagctacattacagattttttcgacaggaagtatcacagtaacaaggccctatttaaaggctgttgctactgctgtggaacagatttacccatttgtgtttgaaagcaggaaagaaattttatcattcaccacttaattggttagaatctcttactgtgcaccttttaaaacctgctgcacattggactcaaaaggaaaactgaaccaacggtaattgaggaaatagactcttttatttattcatggctacagtgtaagctccagtccctttggattttattccaaaccttgttataatataaaaaaggaagtttacaagacatgtcattgctgcttttacaaaaggacattctatttattttcgcaggaattctcatgtccccataagcagagctgtcacagtgtgcactaccttaggttgttttattgttgtcattgttatttttttccattttgagctaatgtgttttatctgtgaatagtcttttacatttttgtatgctgaaaatgggcaccaaagaacctgtaaaaattatctttttcaattgaatgtgcacaaataaaagtttggaaaaggaaaacaaaagaactacaaagcatttagcagaaagctttcatgaagagttgcaatggctgatattataaaatacacatacttttaaaaacaaaaaatccctcaggagttttgttgcccacatctgctagtaactagtgaagccagttgtgtaactgcacttagtttacacaatttcttgaacttacagttttgcaaagacctcagttgttatgtgatttagcagttagagtgtacccacagagaaaggaagcaggaaagtcttcagagaggggcaagctgacatgcaaagaagcaggtaaccagacatttgctaagcgcctcgaagactgagtgcactgcactgcactgacctgcttcagctcgttggtaaagtacacgtaagttacagccacacagagagactgcaggagcactgtgaagatcacgatcagcacgcaggtctgtcccaggctgggtcccccctggacctccatcatagccatgatcctgtcagagtctgactgctgtaagtcagccaggcagccggtcactgaagcccttccttctctattcttttatagtcagtgaggaaatgaaagcgaatgagttgtttttctgggttctgt

SEQ ID NO: 2807 - DNA, 6121 bp, Homo sapiens
  source 1..6121: mol_type = genomic DNA
gaacctggaaaattgagtaaggtcctgggtataagtggatgggaggttaacaagttaatgtagctacattattacccaggagtttataaagcctggatacattcaggatacacaggcaagcagggaagcatggaaaagtaaagaacacttttctaaaagaaaaaaaaaaccctccaaaaactaaataagtaaatcacaaaaacaaaacaaaacaaccactaatagcagctatattctcacctcctacttaacctttggatgatatctcttgtttacaggggtgagatcagactgtgtgtgtgcataattttgagtatggttgttttctcataagactatataaaaatgctgtgttctttaaatctgtatgaaaattatacatggatagcatggatatttttataacattccctgtagaaaatttgtaaaatatagaaaaataaaaaggaaaaaaagtacccataatcataccatctagagatcacattgtcattttggtgtttctctttctagacctttttatgcataaatattgatttctgaacaatagaaatccagagaggaagccccagtcactctctccaccctcacatgtttcttgcatcatgaattttggtagtttctcctatagaacttggccaatgctggtgactagacacatggcgggttgacgtgaggtgctgtggttattccaagaatgataattaatacgatacgtctcccccgcctcctcccatcctttccacttcaaaatatgagtttcctgcagcatatcataggctgaggctatattctctaactaaccacacttgggcattgggggcagaaggtagcgtgtggggattattttcatttgcgtgcctctgaaaagaaagctcttgcactgggtgcctgttcttcagctccagaagcccttggttctgaaaagtggatttccatggtgactgctcttggtgctgttacaaacacggtggttgtctaggccagggtcaaccagtccttgatggggcttgaggtcagcagggtagactcagcaaggtagacttcaagatggcagcaatgaccctgtctgctgcccagacattagtctctggcaatcattttctgcaaactgcaaatagcataaaggatcatttatggagatccgtggagaggaagcccttctcctttttcctccccatctatgatgtcacagtgacaggccattcctttatcataaaactttctcagagggacacagatttcaggggctaagcccatatttgttgttcatgtttgctggtctacaggctatttgtgaaggtccaatccaatgttatgaagccttccttaacccttacaccctataatccttgcagagtgtatcttctgcaaatgttcaccagacaaagtggagcctgtattcaattttaagaaattaatacttatgttgaatatacttttccaaagtctacacagaagattcaaacttattttccctttggaaaatttctgatgaagaaagtgacaccttcaggagacttttcagcagtaattagaacgctactataaaaatagcattgtattgtattgaaaaaatgtattgtaaaaaaaagtaggtgcttcaatttattgagtacctccttcatgcctgggttcaaaatcaggttttaccttttactagttttgtaatcttgaacaaatctcttaacttcgcctgagctttagtttgttcatctgtaatatggggtaattatacttacataatagaattgttatgagaattgaaaccaggcaatacttttcaaagttgctggtacacagtaattgctcaatatctgtaattctcctagctttctagcactctcaatgaattcttctgcatgcctaatgtacatgtgttcatatgtcaatatgcaattaggaaaaatgtatgcaagtgggaagatcttaagccttatatgaaatttccatttttatagtagaattgaaaaagaaatttgattatatatacagacaattgcatgagtcagttgagtaaagaactggttgattcaatcttaaaattagtccaacttgtaatgtaagcaaattgatggagctacttgtgtgtggagtaacagctttactctgtttatgctgcaaagttaagaaaggttaggaaattctggctccaaattggtgaacatagcagtattccagtctctcgtgtagacttaaagctaaaggtatgattacagtttcattaatatttttttcttacaaaagaaaatcttttctaaatgtgtcctacaataaacctgactttactggtcatctaatagtagccataattttcataattagttgcaaataaaacaagagtctgcctcatccatttccaaaagaaaaatttccgactgattgggataaccaaacttacattccacaggatatgcaaactacatttccctagcaaatagttactactctatgtcttttgcacaatttatacttttctgagatccttagcctttcatttcctagtcagctggcagagttggtgctgcaggatgcgctgtgcatgcacagtgtacatcacaaggtgtagataggttaaccctgtggacatcccactgtggagggaagagcctacagacctgggtgctagccgccccacggccagcctccaaagccttgtctgaacttgagtacattatttcttgtctcctcgtctgtaaaaagtggttgtggtggtggggggaggatctgacgttccttgcagctcataattctctactatttaatatacaatgaattaaaatatatattagaagtcaaaaactgagttggtttattttcagcaattttgcagtcatagttccaggggttttcatcgagaaaatcataaattaaaatagcactgtttgtttgttttgtctgtcaaagatacctcaatttgtacatggaccatccacaggcagagattggcagtttgcttttcaattgttttatcatgaacagctgtgtctatctgataacttctttattacagattttacccatgacatgcccgtgccccaggaataggcagaatgccagtcctttgtattctcacttattgtcaacacaggaatgccacataactaaaagcaaaacatttcaaagatgtgaaagttcaccaggactagctacatctggaatacaaaacgggagtgttcagtgacttagggcctggctttgggttgagcctgactctacccttgtcgcctgcatattcgtggtgcctaccacatctgtgaaggctgttcattcactcaataagtatgtagtgaaccacaagtattagtattagtggctacttgggaaccacatgctagacccagaggtatactaatgagcagaagcagacacagctctgatacagctaccctcaccctcaagaattcatgagtcaagaactgtaactccaacctgcaacaacaaagcagggaagatggctacagttaccaaaacagcatgttactggtatggaaacagatacatagaccaatggaacagaacagaggcctcagaaataacactacacatctacaaccacctgatctttgacaaacctgacaaaaacaagcaatggggaaaggattccctatttaataaatggtgctgggaaaactggctagccatatgcagaaaacagaaactgggccccttccttacagcttctacaaaaattaactcaagatggattaaagacttaaacgtaaaacctaaaagcataaaaaccccagaagaaaacctaggcataccattcaagatggcatgggcaaagacttcatgactaaaacaccaaaagcaattgcaacaaaagtcaaaattgacaaatgggatctaattaaactaaagagcttctgcacagcagaagaaactatcatcagagtgaacagggaacctacagaatgggagaaaatttttgcaatctacccatctgacaaaggtctaatatgcagaatctacaaggaatttgtttcttgtaaaacaaattgacaagaaaaaaaccacatcaaaaagtgggcaaaagatatgaacagatacttctcaaaagaagacatttatgtggccaacaaacatgaaaaaaagctcatcatcactggtcattagagaaatgcaaatcaaaaccataatgagataccatctcactccagttagaatggtggtcattaaaaagtcaggaaacaacagatgctggaaggatgtggagaaataggaatgcttttacactgttggtgggagtataaattagttcaaccagtgtggaagacagtgtggcaattcctcaaggaaccagaaataccatttgactcagcaatcccattactgggtatatacccaaaggattataaatcattctactataaagacacatgcacacatatgtttattccagcaccatttacaatagcaaagacttggaaccaacccaaatgctcatcagtgatagactggataaagaaaatgtggcacatatacaccatggaatactatgcagccattaaaaagaatgaattcatgtcctttgcagagacatggatgaagctggaagccatcattctcagcaaactaacacaggaacagaaaaccaaacactgcatgttctcactcataagtgggagttgaacagtgagagcacatggacacagggagggcaacacacacactggggcctgtcgggggtgggaggctaggggagggagagcattagaacaaatcctaatgcctgtggggcttacaacctagatgatgggttgatgggtgcagcaaaccaccatggcacatgtatacctatgtaacaaacctgcacgttctgtacacgtatcccagaacttaaagtaaaataaaaaaatttaaaaataaagaaatctgtttgccagaattcacaaagagcaatagacctcatgtgagttatgaatctgaacttcatcctgctgtgtgctattggataaagactctaagagctacattacagattttttcgacaggaagtatcacagtaacaaggccctatttaaaggctgttgctactgctgtggaacagatttacccatttgtgtttgaaagcaggaaagaaattttatcattcaccacttaattggttagaatctcttactgtgcaccttttaaaacctgctgcacattggactcaaaaggaaaactgaaccaacggtaattgaggaaatagactcttttatttattcatggctacagtgtaagctccagtccctttggattttattccaaaccttgttataatataaaaaaggaagtttacaagacatgtcattgctgcttttacaaaaggacattctatttattttcgcaggaattctcatgtccccataagcagagctgtcacagtgtgcactaccttaggttgttttattgttgtcattgttatttttttccattttgagctaatgtgttttatctgtgaatagtcttttacatttttgtatgctgaaaatgggcaccaaagaacctgtaaaaattatctttttcaattgaatgtgcacaaataaaagtttggaaaaggaaaacaaaagaactacaaagcatttagcagaaagctttcatgaagagttgcaatggctgatattataaaatacacatacttttaaaaacaaaaaatccctcaggagttttgttgcccacatctgctagtaactagtgaagccagttgtgtaactgcacttagtttacacaatttcttgaacttacagttttgcaaagacctcagttgttatgtgatttagcagttagagtgtacccacagagaaaggaagcaggaaagtcttcagagaggggcaagctgacatgcaaagaagcaggtaaccagacatttgctaagcgcctcgaagactgagtgcactgcactgcactgacctgcttcagctcgttggtaaagtacacgtaagttacagccacacagagagactgcaggagcactgtgaagatcacgatcagcacgcaggtctgtcccaggctgggtcccccctggacctccatcatagccatgatcctgtcagagtctgactgctgtaagtcagccaggcagccggtcactgaagcccttccttctctattcttttatagtcagtgaggaaat

SEQ ID NO: 2808 - DNA, 18000 bp, Homo sapiens; identical to SEQ ID NO: 2806
  source 1..18000: mol_type = genomic DNA

SEQ ID NO: 2809 - DNA, 18000 bp, Homo sapiens; identical to SEQ ID NO: 2806
  source 1..18000: mol_type = genomic DNA

SEQ ID NO: 2810 - DNA, 3317 bp, Homo sapiens
  source 1..3317: mol_type = genomic DNA
ccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcaggtgagtgaggggaggagggtgtctgggagaggatggttagcatggggggtctctgggcctcctggtctgcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagaatggggagagatcccggaaaaggagagcagtgctcacccaaaaacagaagagtgaggcttccagggtgcagcaggggtgggaggtgatcaagcagcgtggggattgtaagcccgagtcagggtgagggtggaggctgccaacagcacaacgggggaaagtggatgcggctgagattccctccttctctcctcagagcagcactctgtcctgcacctggttcccattaacgccacctccaagggtgagcactattttaaataatggctttggggaggggcaataaccaggaactcgggctggcacttgggctcaaggggtccttataggtgaaagggaaagaaccaaaaagcacctgagagtgccaagaagtcctgaccgacacactctcacctccagatgactccgatgtgacagaggtgatgtggcaaccagctcttaggcgtgggagaggcctacaggcccaaggatatggtgtccgaatccaggatgctggagtttatctgctgtatagccaggtaaccccagccacactctgagcttcacagagggcctctttggccccctactgagggttcctgacccctctattcataccaaacccagcagacccttctttcttccctcgttagcgctcctgaggcctcccagaactgagccaggccatcctgttttcttcaacatctcccttccctgccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgagagccgtgtgggcagccgaaagcaggacgtctctgaccgggggtagcagtgcagggagctaccgctaggagggaggttggaaacctaaacagaggcgggtctgaggagtgaagtgcagaatgccgggtccttacaggaggcagaggaacggtggagctggagaaggcagggggaaacagggcatctggatggctgtgcttcactgcgaatctactttctctcttttctcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 2811 - DNA, 3317 bp, Homo sapiens; identical to SEQ ID NO: 2810
  source 1..3317: mol_type = genomic DNA

SEQ ID NO: 2812 - DNA, 3317 bp, Homo sapiens; identical to SEQ ID NO: 2810
  source 1..3317: mol_type = genomic DNA

SEQ ID NO: 2813 - DNA, 3317 bp, Homo sapiens; identical to SEQ ID NO: 2810
  source 1..3317: mol_type = genomic DNA

SEQ ID NO: 2814 - DNA, 3317 bp, Homo sapiens; identical to SEQ ID NO: 2810
  source 1..3317: mol_type = genomic DNA

SEQ ID NO: 2815 - DNA, 3317 bp, Homo sapiens; identical to SEQ ID NO: 2810
  source 1..3317: mol_type = genomic DNA

SEQ ID NO: 2816 - DNA, 3317 bp, Homo sapiens; identical to SEQ ID NO: 2810
  source 1..3317: mol_type = genomic DNA

SEQ ID NO: 2817 - DNA, 38856 bp, Homo sapiens
  source 1..38856: mol_type = genomic DNA
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaagtgagtttgcagcagctgcaagacgcaggcaagatcctgcctacactgctgcctctccctcgcctcagctgtctttctaataacttgaagtttttctgttcatagatctttgaaccaccagctccaggagaaggcaactccagtcagaacagcagaaataagcgtgccgttcagggtccagaagaaacaggtatgttttgggcacagacacttttaggagtcagggattagagaataacatccagtctgggggagctggaggtgagtatcccctctatgaacctattaaatagagactatgaaatttgccatccaaagcagacattgctttagagcaaagccccagcgctggcaaatgtaacaggctgcatgggtgtgctttttcctccaatgagcagatcgtgtgactggaagcatttctctgtgcgtgtgtaagtatttatctgtgcattaagcatagaggagataaaagggccatatgtgtttcctcaggtagataatgccctcccatgtgagaagcattattcatcactccagaaaaataaaaaaaagcattacatgttagaattagactttgcttactacctgggtcatagaaagttaaagacatctgttttctgaatgtacattacatgttgtgaaaccaggtgaaggttgtaatgaaaggccctgtatgttgtactttaattttgtttatttgttaaaaaggttattttacacacacacacacacacacgcacagacacacacacagattttaaagcttctctttaaggtacgcttttccaggggatccatgcatttatcgtcttcttataatcgtcctttactgatttctgactttcttcatgttctgctcattccacggaactttacagagttggtggggcctaccaaaatgatcgattctagttctttcatttgaaggtgaaaaaaagaatctttgtatacatttattaaagttataatataacaaattcttaatattattgtccttttattaaatatattgaaagaatattttttgagcacctggaacgtatcgtacagctatagaccagaataggcattttcaaacatactatttcgtttaaccttcacagtgacgctatgaagtccacagaatacatgcaataatttatgtatattttcacttctgaagagaattgcataagaaatgtagtgagagatagaccagggacccttctatcacacacacacacacacacacacacacacacacacacacacacacgcatgaggtaccctgactataaacttattttttgactatatgctttattcataaaaaattgtttcttattttataaaaccataatttttggtatctggttattgtatctttatactagttatcaggaataactgggcttaaacatttttaaattaggaaacatgcacatttttattattttaacacatcaattatttttatcgtctgcattttatagtctatatttcctacataattgaaaataatacggaatatatactataatattttttgttttgacttatacaataaggatttttcctatttctaagtatttttcatatatctgtattaatttatctaacaattgttttaaatggttatttccattctctttgctataatacaacatgcaaaagttttgcacagaactcttttatttctgtgaaattatatattcaatataaaattcatatagtggaatatctgagctagggagaagaaacatcttcatcacccttgcttccgactgccatattgttttcaaaatgagttatacatgcaatcaaaaatgtggtgtaccggttctccacattcttgcttgcatgttatttttaaagtgtattttgactagtttagtagttgtaaaacaatatctcacatttattttgatgtgttgcttgtttactaatatgaataaactttctgcatattttgattatttataattttatcttttgctaatttttatttataactgtctccacttgtctgtcccatgtttttataattttggataagctcttcctaattagacatattgataattgatcaaaattttgatgtaaatattttaacagttttgcttctttttttacttgaacattttgcatttctctatagtaaagtgataatctttaaaaaattttccctaatattaaagctaaaaatacatttgttcatgttttcttaagtagttgactccctgccactttgactttttcatagttgagtgttttgttttaactcattagtccttctgttgtttattttgatgaatcatctcacattggctttaacttccccctctctcttttttcctttctaactggtatctcaaccaaatgtattaaatagttctttttaactccttggtgttgaaaagcttactgtgttttattaagttcctcataagagttgaatctatttgagactcttttttttaattgattattctatttatatgctttaaagaatatttttaaggtaatttgtattataagaggcttcaataactagtagggtcaggatccttcaatctccttaaccttcactgctaatatccccgtttctaaatattagttttaaaaataaactttaactttacaattaaaaaaaaagatgtagactcatttcagcagatttaagaagaaaagaataatagagtaggaaagaaataacttcttgggtcacattttcccaaaattctcctattaatacttttatgtatttgtgttttaatggcatccaggaatagtatactgatgagaatctttcaccaaataatttgcaatttgtagattctaacaaagtgaaaaaaaatttgcccagatttccacagcccagaagtagctactattattatttcatggtttgccctagactttttaataaaccttaatacagtgtgcatataggtatatattgcacacagttgagccttgaacaacacaagttttaacagcatggatacacttacaggtggattttttttttcaataaacctattggaaaattatctgtagatttgtgataatttgaaaaaactcatggaagaactgtgtatctttgaaatgttgaaaatattaagattaattagccatgtcatgaatgtataaaatatatgtagatactggtctattttcttattactatcataaaatatacacaaaagttaaaaattctcaaaacatatgcatacaaacagactgtacatagcgccctttgtagtctagagaaatggaaacaaacataaacatgcagtattaagtcatcactgcataaaattaactgtggtacatactgtactactgtaataatttcatagccacctcctgttgctactgcagtgagctcaagtgctgtgagtatctgcttaaaacaccatgtgatgctaatcatctctgcatgagccagttgtatctccaatcagttggatattgcagtaaaaatgatttctcatgatttgtgtgtatttttcttcttgtgtaatgcaatatcataaaccttgaataacaccatgagacctatagaaaatgcgatagtgatgctggaaatgctcccaggaagcaaagaagagtcatgacattatagttgacccttgaacaacacaggtttgaaccgcgagggtccccttgtatgtggattttcttccactttccacccttgagatagcaagaccaacgcctcctttccctcctcccccttagcttactcaatgtgaagaatgaagaactctataatgatccacttccacttaatgaatagtaaatgcattttctcttccttatgattttttaaaataacattttcttttctctagcttattttattgtaagaatacactacataatacatataatttatgaaatgcgtattgattgagtttttgttatcagaaaggcttctggtcaacagtgggctgttagtaattaagatttgggagtcaaaagttaagcacaaagttttgactgcatggggtcagtgaccctaattcctgtgttgttcaaggatcaactgtatttgttcatatacatatgaacaatacatatgaacaatacatatatgaacaaatacatatatttatacaaatatatgtacaaatatatacacatacaaatatatatatatatacatatatatacatacatagtgtgcatatgtgttatgtgtatatattcaaataggacatagtatacacactcataactttcacaaatccaaggtggaagatttgaagataagaatcttaatgacatcatgtctactattccttgttaataaaattaggaaattcatttgaatgttgttctagatactattctttggtggagggaaagtttattttatttagcatactccaaaattaatgtttatattcccaaaaaagttgtctgtaacacaaggacgttttttagtaggaattttttggcattgagaaaattctatgcagctttctttgatttttgttttcattcaagttctgatttattttcagtaagactcaaaaccttaagttgtcctttttacttttaaagtgtttatttatgttcatatttattaattgtctacatgttttagaaccaagtatttttattggaacttcacacaaactgtagaagaagggaggggaattaccatcagccaacatgtcccaatgatactctcttccaggcatcccatgggtaaacagtggttttacttaatgttttaattttagaatttagtactttggctttagttttgtttttcttaattactttgtgtttcaaaccaaaatctcattaagcttaatgtatttcataatatcatttttgattgtagtataataaacagaaatgtggggaaatccaggattaaaaaattgccaaatagctcatattagccaaaaattcacttttaagcccgtaactgtgtttggagatattcccaatttaaaaattaactaaaacaatatggctttgaaaatattacgtaataaaatttatttacaaatggaatcatgaagatccacattttgaacatcacttaactataattttattaattttaagaacctaaagatgaatgtctttagagtctatcaagaaagtgaattctttcaaatgggtatcactgacctaaaaaggttcattgttaaaattaggtaaccattgtattttctttcctgttaattaataactattagaaatttatgtgttttaggatacagaaagacaaaattatttttattgataatgtttattataattgtctcaattttaataataaaataatagtaaaaatatggacaattcaaagtaatgtaaagcaagaatagaaaaaattgtccgtatttcaccttccaaataattatcatgagatttttggtcaatctactttaaggtatatttttcttcatttttaagtgagcttgggattgtttaagaattacacacagcttgcaaagaatacagtgtgttggcatgtacccctatccagcttccctaatactaacatcttatatgaacatggtatttcattacaaaaaggaaaccaacattaagacttaactattagctaaattctagacttaatttgaatttcacgagtttttctactaatgattttatgttttaggatccatcaggatatcacattgtatttaacattttttaaattaaaattttgaatgtagcatatataaacaccaaatattataccttaagttttctatcggataaacctttctaattgctaaaagtgaagatatcaatactatttttgagtcttcttttttgaaatccaaagtccaactcctttgcaaggaaagatgagatgtttgacaagtctgtaatgtccagtctttgcccggttggcatttctggcttagctgtgagttccaggctgtaacatgagtgttggaagcgtgcaatgtagaacttgaccatccagcccttatcaaaattaggctgacttgagcctcttacccagcaagggtgtgttccttcgtggaacagaaccagctggctgctgcttaggcgatctttgaccagagctttccctgagagttattttttctttccccctgcttcaatagtgagacttttcttcagtgttgcaagaactggcttctgttcaacttctggaaaagcatttaaaattgaaaacgttgaccttccaaccaaatctttgacctgttcttgttaagcttgagattttgggaaacggaagagctaggaaacaaatcagtcaacacagccaaatgtgatattgtgtctcttttacacaatcttacattatcgtgagttgaagagaaacagaaaaatgatagtacatatagttaattagcaaattaaaatacaaaaaaatggtaaatatgttgaaaaagtgaaaaggttagggcaggtgaatgagtatcaggaatgtgaagggtgaggaagggaaagaaatgcgttttcattttgaatggagaggccaggttcattaagcctttttatcttttcttgaaagctcaataattctttatacttttgactattttttttaacattgcagacatgggtaggtgatttttaaaataaattcaaaatgtttatacctgtgttgtttttattagtaattccatatgaatggaaaatgttagttttaatgcttattctttttatagatcaactcctacttaaaagaactgcattgagcagctgcatttttgttgtggtgatattttttttttaaaagacattcccatttctgaagagttagagaaacagaaggtttctcttcaaatagatttatcacccactgtttctgcaaatatctgaggtaggcactccataatatacagagaagaggacagcgaagctaacaattatcaggcgtgtttcatgtgcaaacactgtgttgggctctgggaatgtatatcatttactttctcaacaactctgttagttgggcattattgttttcattttagatgagaaagctgcaacccagagaatcaattgcctctctcagcaagctaattatttaatagttggagaagttaagccaaattgatgcaaaatttaaaagaacaataaaatagacaagttatttacaattcataaaacacatctaaatgatgacttcaatctattttcgcagcagtatgaaatggatattgctattcccattgttacaggacccaacactcacccaaagttaacctttgggtcgggggtttctgtactatattcccttctgtggtcgccagagaaatgttacaggaaaggagtcccgatccagacccccggagagggttcttggatctgacgccagaaaaaattcggggcgaatccacagggtaaagtgaaagcaagtttattaggaaagtaaaggagtaaaagaatgccgaaaccatagacagagcagccctcagggctgctagttgcccatttttatggctatttcttgatgatatgctaaacaaggggtggattattcatgcctcccctttttagaccatatagtgtaacttcctgacattgccatggcatcatgacgctggcgggagtgtagcagtgagaaccaccagaggtcactcctcgccatcttggttttggtgggttttggctggcttctttactgcagtctgttttgtcagcaacgcctttgtgacctgtattttgtgctgatctcctatcccatcctgtgacttagaatgccttaaccatctgggaatacagcccagtaggtctcagttattttacccagctcctatccaagatggaggttctctggttcacctgcctctgacatcattatacagatttaaaatgcttcaaaattaagtgtcaaactcatggtttgacaactaattgataggagaggtaaggtttgaattcattatctattgattataaattctgatttttttcaatgataatggctgtacatgcttaattttcaagtgtgccaccagatttgagaaaaaatattgggtctgacaaggcccagggtattacgattaatgccagtgagagagacatcaagttaaggaatcagagaatgttgttagtggtagagatcacagactgcgagattatctagacagtggtcaagagagctgaagtgggtttgaagatggagcagacttgggtaagaggacagaataactgaggttatgaggacaaggtagaaataggaaacagaaataattcaagaaaaggccttgttttagtaggcatagaggcttatcccatacaaacatctttatattatccctttcctcttctaaatttgtaaatttttgcaagtgctgatctgttgaagtgtttttgcaaatgcaagctttcttcctaccccctcctctcctcctcctccccttctcttcctcctcctccccttctcttcctcctcctccctttcctcctcctccacttctctttctcctcctcctctcctcctctcctcctttcctcctcctcttcctcctcctccccttctcttcctcctcctcctccttctgatcaggttatttgagacagggaagggtaagagaaaagggaataactgcgctgtgacagctcctgacagcagctatgaagtctcactttcaggcctttttctcttctatctgccccactggagcctctggaaattacaaaataagacattttaggaaaatggtgcacaactacttactttaaaaatattatagagtgctacacttctgtggatagagattcaaaaatgtattattaaggttttctcttgaggaaaatgtttcctatataactgagggttcaaagcctattatgagagagtccacaattcatggaaattgttttgttttatggaaccccttttccctcaagcaatgacttgatttaacacatttcataaagctggatttagtgactggtttttaagaattgtttggaaaagttgagtgctattttttatgtaaattgtttcatatattattccacggatttttttttaagtctgctgtaaatcagacactgaaaatttgtgaatggttgtccttaatatcaagtgattcacaatctagggagagaaacagttacagaaacaattgcgtgtatagtaacatgtatttcaatagatgatatgcaaagtatagtgggatcaaatattttgctagaagtattgtagaaaaagtttgtatttgatttcagtactgaaggatgaatggagttccactggatagaaggtaaagtatatttagtaggagggaacagcagacatacagtcatggaagcatggaagatgacctctcattctgagatgtgtttaagtacaactgggtttgggtgggtgacacgcatgagactgtgaatgttggctgggccggggcatggaggaactgttttgtattccagggagatgcagtgagtgaattgtaagcattagaatgagaagaacaaatttgcacttagaaagataattcaggaggaaatgcaaatgatgggctaggaattgtgaaaaagaggcacaacttggtaggctaatggaattgtcaagaatggtgaggtagggattcgaatttaggctgctatgctcctcatcttccttcctctctctctgtgtccctcccaacatcaccctctgcatagattcatgagctgttaattttgtccgtgatgctcctattgctcctctttttttctgattttagttgaagtgtcacctcccagagaagccttcctgattggatcaaatgcccggcccgggcaccaagaattaaagttgaaactttaattctgtccgtgtgatgttgagtaatacccatttcttccactggattgtaaactccctgggggcagggatggcgtctgcttttttttttttttttttgctgttcttagcacaacacctgacgtagattaagtccttagtaaatttgttaaaatgaaatgaatgagagatggaatctaaattgaaaaaaagttaaaaatttaaaccattcgaacttgattattagttgaactccaagattgagaaggcagaaatcaggaatgtttataaagtttgtagcttgggcaactcagaggatagttatatatccactcagagagaaaataagtatgcatgagaaagataaagcattatatttgagacatgttgaatctgaagtatcactaaggcatccaaatggaaaggtccaaggggaaagtgaagatttaattgctgattggggaattcattagtaacttcatacattcaactgtttttctatttttggctttatcttccttgacatcaggttggtttacacgtgatattgtgaagctactgttcttcactggcaagctcctgatattcagtgcgttccaagaatatattattaataaattgaaatattctaacataattcagtgaagtcatggagaaacacagatgatgattcaagtataaaattatcaatttaaaattaaaatattagatgaatagtaaactgaagcaacattaagtcatgataatgctttttttttttttactcttagtgcctatgaggcaatacaaaaggcttgcaattttacatctcctatattgctttaagcacaaaacatagttaaaatatgagtggatatgtgacaatgatcaattagtgcttaagattctgtctatacaaacacacacacacgcaagttacagaaaattatcatttgaggccgggcgtggtacctcggcctctaatgccgaggtatttagaggtattagaggtattagaggtaattagaggtagctcacacctctaatgccagcacttcaggaggctgaggtaggtggatcacctgaggtcaggagttcgagaccagcctgaccaacacagagaaaccctgtctctactaaaaatacaaaattagccaggtgtggtggcacatgcctgtaatcccagctactcagaaggctgggagaatcatgtgaacctgggaggccgagtttgcaatgagccaagattgtgccattgcactccagcctgggcaataagagtagaactctgtctcaaaaaaaaagaaaaagaaagaaaagaaaattatcatttgaagtatttgtcatcattccatcagctgtggttttttctattctatcaactcctttccaacacccgcttccaaaaaatacccagcacccctttcttactttctcaggaacactatagtgctattatctttctgaattctccaaaattaaaaactattggtcacgacttcaatttttcttcacaatgtatcttagatgctgcatttacataactgcatttgagaccaaaccatcctcaccctatgtcttttcccagtagatcactgagacctttgctgccaccctccctttacaggagctcgcttcacacacagacaggaacatgattttcctcaagtacaaggtctgtcaggcagacccctcccaagattgagaactctacttataagaatttctagtaggccaatatgtacttctcgatctagttttctcaaaattcaaagttctcgacttttattacttttttaagtaagcaaccaaagcaaactgcttatcgttggtcaaccttataaactagcttccctcctctaaattcatgtgttttaatttcagtgaaaatgttaattcaataccatgctttccccattttcttcataagtctttgtcaaatattaggtcaatattgagatctttaagtgttttttttttctagttaacatttttctgccactgattatttattcaaagctagttcaagaaaaattaaacagctacatttgtcataacttacgtttaccaaatgataagttttgcagaaatgaaagtgaggcattgccgtccaagatcctccttctttaaaaacatatggtgcaataaataagatgacaggaaaaaaaccacacaaagagataagggaagatgcaggacttacatctcatctggaggaggcttcttgaatgagatgagtgagaagcactatgaagaatctgtgggtgcaggtgatatggatgggataatcgtaatgggaatgctctgtgtgtaatgtttttcatgggagacacatataatctgcagtaattgcgttatttatggtagttcatattagatttagctttgttgaaataatgaataataaaccagtttcaagttttaatggattcagttccagtacagaaaatagtataacagatattaccaattctctaaactttcaaatcactttttctgattaaatggtatttagacattatacttcaaaaggtggcctttcaaactgtaaaaatgtttcccatatggttagtatttaaattacactctaattgtgaagtattgaattttattgtgttaaatattgatcaatagcaaattatttttgtccttaaattcttattttggtaattttattttgtaaacattttgtgatcattataatattttgtttttagaaatgttttatgtgaagtttattatgatgagtaaattctcttatgctgtaaaacggcattttataagattatgtattttacacattattacatcataatccccagaaatgtatattcagaaatgtgtctccataggctcggaagggttttaatgtatattattgccttgcttagttaaaagaaaaaacaataacaaacataaaaaaaactattcttaacctcttgtgtaattcctttcaattgtagtagagggagagatgtgtgaaaggcatttgagaaccaaacaataatcaattaatatgataattactatcaaattgtgtttcttatattaaactacgcattttcaaaactcttgtggttagatatctgtgttactggaagatattaaaaataatattgccatttttgctcctctctttgtgaggcaaatctctagctgagcactaatctccagcctaagaccagatctatgttgaatgagaaagaaagtcttaaaaggctgaataggagataagttgaaatagctgaaatagttgaaattcgataatagctatcaaatttcctaaagcgaattgccttggaaaagtcgagtaactttgtctggaacaaggacaattattcattctgcatccctaggcaatttcaccattgtgcaaacatcagagcatacttacacaacttcagtggctgtaatttaaacctcattattgaaacatcaattttatatcttattttctcttctgaagaacagttcttgaaagaaacttttctctttaaagcacattttctgctaaatgttagatttctgctactacatgagagaatagaccactgtttttcaatgtgtaggttgtgactaagttttaattgggctgtggagactaaaaaggagacatattcatggtgtcaagtcattacttattaggtaaacttctctctgactacatagaacatctaaatctgccttagttcattcaaggctgttataacaaaataccatagactgagtggcttgtaaacaacagagacttatttctcccagttcagggggccggaagtccaagaccaagatgcctaaagatttcggtatctgatgaggacttgcttcctggcttgtagatgatgcctcctcactgggttctcacgtggggaaaatagggcaagctagccctttgggatctcttttataaggatactaattccattcatgagtgctctgccctcatggcataatcacctccccaaagtcttcctaatagcatcacctcagcagttaggtttcaacataggaatttgggggcaacacagacattcagaccatagccgtctcctactgaagtttttgggaaacagagaaagggtgacttgaaataggaagtcatggccgggcgcagtggctcacgtctgtaatcccagcactttgggaggcgaggtgggcggttcacgaggtcaggagatcgagaccatcctggctaacacgatgaaagcccgtctctattaaaaatacaaagaattagccaggcatggtggcgggcacctgtagtcccagctactcgggaggctgaggcaggagaatggcgtgagcgcgggaggcggagcttgcagtgagctgagatcgcgccactgcactccagcctgggcgacagagcgagactccgtctcaaaaaataaataaataaataaataaatgaataaataaacaaacaaacaaacaaacaaacaataaaaaaagacaaaagaaataggaagtcatacattctgtatttctttagcctttatcagctgcagttgggcagcatgtttccacggtgtccttccatgatgttttctaagttatttgccttgatattattaagaacaataatgctaacaccactactgatacaaatagtcaagatttatttattttgcaggtgttatgcactgagtatagcgcaaagtgcttcccatgcattgtgtcatttactctttacaatatacgtataacaaaggaaagatgcaaagtttaaaaatctgactttgacgttcatcaacatcctcccttgtttttgatgtggaggaaagatgagagctttgtatgctctgattgaccctagtgccactcagaaacctgtcagggtgccttgtgaataataattacttaagaaggatttgttggaaaaataaaaactcttttaaaataggttgaatgtggctactactgtactactatagagactgtacgcttggggctttagctgccccggaggctttgttattcctttctttcatgctgtcctcattcactaccattcttcctgttaggatgcttttccatacttccagcagaacagagtctgccatagtgactaacgaatcatgtttttcctggggcacaggcatggatacctttcttgtataagattaataaaagaatcctcagagtggaccaaaatgctctgctcctatcaaaatatctgaaaattgacataaaaatgtgttagaaaagctttatagttataaaggaattatagtttttaacaatatattttcatctttaaataccaagaatttcttaacagattttcttatgtgaccacaccctttaatagtatgtatttatacaaactcaaacttatttagctactgctatgttatttcaagttttaaatacattcatgtgttgcttaataacagggatatagtctcagggatacattctgcatccctgggcaatttcatcattgtgcaaacatcagagcatacttacacaaacctaggtggtgtagccttctacacaactaggctctgcagtacagaccattgctcctaggctaccaacttgtacagcatgttactgtattgaatattgtaggcaattgtataataatgcaatggtaagtatttgtgtatctaaacatagaaaaggtatagtaaaaacttggtattataaataatcccattgaaccaccatcagatatgcagtttctcattgacctaaatattatgcagtgcatgactgtattagaaatttttcagctaatctccatacaatcaccaactagtcacagtagaagttccctactgtgtcaagttcataaaatgtatacattgagaagcatctttataaagtattactttaactcttagtaaaatatttggtagataaaaaactacactaatattttcttaatctaaaacatgcaagcttagatttctgtttcatatttttcacagacatttactgctttattgtatcttccctacagatccagcaggtgtacttaatttgcttttgcctaaaggcatttctccttatttaacacaatgttatttagtttcttaaatattgactggaatattctacatgtaatatgtgatgtgaattgatgttttcaggaagctttactaactatatgcacttgcatggaagtcttccattttatttgtaaaagatgttctatctctctttctctctttggtccaatatattttaccaaaagcttgactttggatccagagtgaaacaggtggggttgaaattctggtcccatcactttctgtctctgattcctgaacaagctgtttgcactttccgagccttagtttccaatatctaatttttaggattcttgtgagggtaaaaggaagtgatatatactgtcttggtacactgtctgcacttaaatctgttcaatacgtattagcatttttttttttactttcataagtgtcagaaatagtattttctgtagtagtaggtcattatttaatgttagattttttaaaaccaaagattgtttagaatgttcttataaggttaactgtttcatgtatttggtagacttgcaaaacaaatgattaaacttgctttctcttcagccatttctcagagcaaattaggttaaactgtaagggtgatattatattttaacagcacatagagcttttctgaaatgtcatgaatttcatatatatatatcatatatataaatcaatgggcaaatataaagtaactttaagaataatgtcatgcaatcaatgtaaaaagtataattgatttagtgtttctggaagagtgggtttctagctttgtgttctcagtttctttattatttctactcaagtaactaaaatgataaatttttgctttttagtcactcaagactgcttgcaactgattgcagacagtgaaacaccaactatacaaaaaggtaataaaatatagcaaagacttggaaccaagccaaatgtccatcaatgatagactggattaagaaaatgtggcacatatacgctatggaatactatgcagccataaaaaatgatgagttcatgtcctttgtagggacatggatgaagctggaaaccatcattctcagcaagctatcgcatgttctcactcataggtgggaactgaacaatgagaacacatggatacaggaaggggaacatcacacaccggggcctgttgtggggtggggggaggggggagggatagcattaggagatatacctactgttaaatgacgagttaatgggtgcagcacaccaacatggcacatgtatacatatgaaactaacctgcatgttgtgcacatgtaccctaaaacttaaagtataataaaaacaaataaaatatccccagtactttttccacttagaattcagtccactccaaatatttgtaagtttcaagtctaaagactgtatttgaattgcatgtaaaatcaatcagccatctcagaacttcttataatcaggtaaaaaataataaacctacatttattcaaaatgacttgggaataaataataattaagaccaaagtaataatctaataaggagaatgaccttagaggcacgaatacttagaaatgttaaataattaaactacaataaaataaaaaccaataataaatcaaattccatttttattatttagacagcattttatctttaagaatgactcaagaccatcttcacaaatatgaattctcctgttatattcaattgtaaaaatcatagaaagaggaaaataaaactgaacagattattaaaaatctgtatttttaaaataaatttccaacatcaaattattgcttgataatttaccgttttctcacagaggtagaatgttttacatttttcagttatttgaagccttttttagttttaattttagacaagttaagtgttttccataataatggcctgaaaccaggtttacaaagaaacaacttttaatgtcatttcccaatatgtgtcacctagaatgttaatccagagaaatggtccttgaaataagagtttcagtgtcgtataagtttggaaacacagcatcttacatatttttctttgagtcacaaggcacattagcaagttattgaatctaagtagtcctactttaaaaaatgtttgtttaactttgtttcatccagtttttcacaaatttttgtgactatgctgctttatcatgtatcgacctctctctgaaagcaaatgggaattgatgctctataatagcatttgtttatataagataactagtgaacaaaaatgtactaaaaaagaaccattcgttcactcacacattcattgattcatttagtttacatttattaattaagaatatacaatattttaattactgtatgtttactgggtgtatcagtgactaaaatatgcacaaatgctccttggcttacaatggagttatgtcctgataaacccatcctaagctgaaaataacgggccttgaaaaaagcagttaggacatctaacttaccaaatatcatagcttagtctagcctaccataaatgtgctcagaacacttacattagtctacaattgggcaaaatcatctaacatgaagcccattttatagtaaagtattgagtagctcatgttgtgttttgaatactggaatgaagtatgatttctcctgaatgtatgtggctttcacacctttgtaaagttgaagattctaagccaaaccatcgcaagtccatatgcatggttttctactttgaaagagcttacctcttgatgaggagaaaacaaacgaaaggcccaacaacccacaaatgaacaagtaaaatgtagatgagacgaaatgctgtggagggcagcaaagcaggcgggggcaggagaaagttttgtgttgtgaacgaactacgagttcaggagtatctggaggttaggctaggcgatgaggaatgggcaaaacaacactagcacagatgatgaatgtgagttggcactggtaatgattccctggcatgctcttttcatctgtgtttttttctgcgtgactttaattgtcctaaatgcaacacaagtactaaactacttgtaaatctattatttattgttcaacattttcctaaatcatgtttgcaacttttaataagcagcacactgtttcctaagaagtaaaagaaagccagaagatcttaagggccaaagttacagtttttaaaaattcttttgaaaaggtttactttacacatctctcccccaccccccaaaatgctataaattgcaccaaattatgcagctgctatactccaatgtgcgtgtgaactggagagtatgctgtgatcttcctggagtggtgactgcttgccacagatccaggggtgctgaactggggtgattacctgggatgcttgcttgcagtgctccaacctttaggatggacaggttgcccttgtgatgtcagcaaacccttgaccagtatataaatgtgagtgtgcatgggcatttagcaggcagattgcatttagcaggtaggttgcattttgttaaaaaaggctgtactcactaaagcattttacttgcacaggtccataagaagacttctgggaaaagataataatatattattaatattattagcatattatatgtaattatatattatataatatataatgtattataataattatatataataatatattattatcttctggggaaagaatttatatatataaatattattagcatattgtatatattatcttattgtattatacataacatcaggtcttgagatgaaatcatgttatgtattccagagacatggagattcaaaggagcggggctacgttcatctgatattttgagttcctatgcttgctctgccccatacttttgtccagacagtgagggcagaggtaaacttcacaaaagagaaaaagacaagaggggtttatcagagtgtagtctcatgtcttttctgttcatttgtttttttgaattttaatctagattttgaataggtaatgcattcacacgttgcaaaaaataaaaaagcatgaagagtgtggattgctccttttcccatctgttcctgcccacactcacctcactttcagtttcctacatagacttcagactccctctatgttaacacaaacaaatgcaaatgtagctctgcttccctcctttcttatagtaaacacttaaaaaccatattttcaatacatatgatttgaaaatgagattataacctgcattctttacttaacaatgtatattgcagacattttgatgcctgtgtacagagatcctcatatgaaaaaaaaagcagcatagtattccattgtatgaattgaatgtatttaaccagtctcctaccaatagacttcttggtgtccatcttttgcaatgcaggtgcttcgaaaaataattgtgtgcatccgtaacttctcatatgtcagcctatgtgtgggacagattttgaattttgacagttattgctaagtggtcctataggggttgtaaagtgttatgctatcacttgcagcaaaagagcatcaggtgaaaaatagcatctcttaatttgctttctttcaagccattcttttgtatgttttaagaaccatttgtatttctgtctttacattcttccaatttttcatgtctatttttatttttttctgtgagccatctgttcatatttttttccattttttcgttggacttggtcatttttaaactgatttctgtgagcaccttatatctcaagcagattaattctttatattactaattgcaagcatttcctcccatactgtcatttgtcttaattttgcatactttttttttctgtcaaatttgtcaatttttttaaaggattctggatttgggttgtgattagaaagaccttttacacttaaacgtattaaggaaagatctcgtgttccttctgaaacctttatagttattttctacctttaaatactttatctatttgcaatttatcctggtataagatgtaaggtatgaaaccaacttaattttcccctgtgagggcatcacagtctttttttaatcgcccatcttttccagactgcttgaagacattaactttaacttttattaaattccatgtttagtctatgtttttttcactttttaaatacttttctgttataccatattgacttaatgtctatttatgcaccccaataaaatggcattttggttactagggctttgtattattttctggtaaatttaattcactcattttttctttttacttctagaatttttcttttttttctattaaatataggaactgtagaatcagcttacttagttaaaaagaaaaagaaaaatacgtgctatttttgttgaatctcatatttataaattaagaaaaataccctcatgataacagatgtacagatcaaatccaagaacatgatatatatttatatttttttagtctccttttttttcttttagtatgtattgaaattttcttcaagaagttcttgcatatttcttattaatatcattacaaagtgttttaccttttcaaatgctatgataaatagaaacattttctttcattatattttccagctggttgttctttttgtgtataaaagccttgaattccatgatatatcttttcaatattaaagttgaaatgttttcttttatttttggattgcatttccctagcatgactttgcccaaaattttacttttaacttctctgaaataatttttctgtgtttctcatgtatgcaaaacagagttgctctttgttttttgatatcatcttaaaataattttcatttattgggtgatataaatcaatttacatttacttatttcagaaatgtatttggcttttattcatcataatgtgctatactgtgtattgtttttcatgttaacaaaagagtttctattttatagttttaaagaggttgcttactatgtaggctatttgctttgctttttctgttagcgtagacttctaaatgctaaatactaggggtagctaccttttcagttatatctttttattgaaattaaattcatataacataaaattaaatgcacaattcattgtaatgtagtattcacaatattttacaaccaccaactctctctagctccaaaatattttcttcagccccagagaaaatcctgtatccattaagcaatcagttaccatttctctgtctccccatgcccctgtaccagcaatctgctttatgtctctgtggattcacctattttagatggtttatataaaggcagtcacacaatacgtgacttttagtgcctggcttctttcacttagcatgatgttttgaggttcacccacattctagcatgtattcatacttcatgcctctgtatgaatgtatatcattctattataagtaagccataatttcattaagggtatttggtttgtttccaccttttggctattgtgagtagtgatcctgtgaacatttgcataaagtacttcctgagtgcctcttttcaattatttggagtatacatcgatgaatcgatgagtagaattgctgagaaaatgtcaacctgttctctacagtgctgcaacattttgccttccccccagcaatgtactagtgttctaatttttccacatcctcactgacacatcttattttcaatgtttttattagtattgccttcctactgggtgtgaagccatatctctgttatttatttgcattttccttatgactgatgatgttgagcatcttttcatgtcctttttggtgtcttctttggaaaaatgtctattcaagtaccttgtccatgtgttttaattgggttgtttgtctttttgttgttgagttgtaaaacttccttatatattatggatacaagacccttatcaaatatctgatttgcaagtattttctcctcttttgtggattatctttttactttcttgagaatgtcatttgaggcacaagagtgttgtacatcagataaatgaagtaaaatttatcttttttttgtttcttgtgattttagtgttatcattgaagaactcattgccaaattcaacatcatgattcacccatatgttttcttctaagagtcttgtagttttatgtcttatatttaggtaattaatctattttaattcatttttgtatatggtgtgaagcagaggtccaaaatcatcttttagcatgaggatatctagttgtcccaacatcatttgttgaagaagatgatttcttccacattgaacggtcttggcacacttgttaaaaatcagttgtacgtagatgtatgggtttatttctgtactctcaaatttattttgtttctttatacacctcgccttatgctggaccactatactatttggattactgttatgttatagtaaattttgaaatttaggatagtgaatccttcaatcttgttatttatttttaagattgttttggctatttgatactcttttgcaataacaaatgaattgtaaggctggctttttcattttggagaacaaaaggtcactgaaatttgtatatggattagactgaatctgtacataatactgagtattactgccatcttaaactaaatctatcaatccatgaacacaagatatcttctcttttatttatatgtcctatcatttcttatagcaatcttttgtagtgttcagtgttaaagtgttttatgtccttgggtaaatttacttctaggtgttatgttcttttgaatgctgtttagtcagttcagtttgctataacatattacactagactgagtggattaaacaataaaaatgtatttctcacacttctggaggctggaaaattcaagattaaggtgccaacagatttggtttgtgaatggtggtcttttcattgtgttttcacatggctgagaacagagacaaaagcaagttcttgtgtcttttcttataaggacattaacccatcctgaaggctgtgctaccacagcctagttatttcccaaaggcaccaccccctaataccatcacattggaagttagaatttcaacatatcaattttgggtgacagaaatattcaatccataacggatgctactgtaaatgggattcttttttaaaatttcctttttagattattcattcctggtatattgaaacacaacagatttttgagtgttgatcttgtaccctgaaacttaactgaattcattgattagttttagtagatttttttgtaaattcatggattttttttttttttgagatggagttttgctctgttgcccaagctggagtgtaatggcatgatcttaactcacagcaacatctgcctcctgggttcaagtgattctcgcacctcagcctcccgagtagctgggattacaggcgcctgccaccacacccagctaatttttgtattttcagtagaaacagggtttcaccatgttggccagactgatctcgaacttctgacctcaagagatcttcctgcctcagcctcccaaagtgttagtattacaggcgtgagccaccatgcctggctggaaattttctgtatatagaattatgatatctgcaaatagagatcgttttactactctccttgcatttggattttttttttaatttccagcatatgttgaatagcagtggtaaatgcaggcatagtcttgtttctgatgttaggataatcttgaggattattacctttatattcatggttgattctggcctgtagttttttgtggtgtctttgtgtggcattgatatcagtgtaactctagacatacagaacaagttaggaatggttcccttctcttttactgttttttggaagagtttgagaagattgatgttaatttttctttaaatgtctagtaaaattcaccagtaaaaccatctagttatgaattttgagggaagacttggattaattaaaactctacactggttataggtctgtttaggttttttatttatttttgagtcagttttggtagtttgtgtgtttctaggaatttgtcccatttgtctacattatctaatttgttggagtacaattattataaataataaaaaggtatagacattttatttccaatgggccattaataatacctccattttctttaatgattttattaattggagtattttctcttttattggtcaatgtagctcaatgattgtcatttttgttcatatttttcaaaaaaccagttttcagtgttattgtttcgtctttttctgttctttttttgagatggagtctccgtcacccagcctggagtgcaatggtgcgatctcggctcactgcaacctttgcctcccaggttcaggcgattctcctgcctcagcctcccaagtagctgggactacaggcatgtgccaccaagcctagctatttttatttatttatttattttttgtatttttagtagagactggatttcaccatgttggtcagactggtctccaactccttacctcaaatgattcacccgccttggcctctcaaaatgctgggattgcatgtgagccaccgcacccagtcctttttgtactctttattccatctaccttctttattattaccttctttattatattatctgatctttattattttcttccttctgtcaattttgggcttagtttcttcttctatttctatttccttaagctgaacttaggatattatgttgagatctttttttaacataggcatttacagttgtacatttctttctgagtgctactttcactgcttcctatgaatattgctatgctgtgtttttattttcaatcatctcaaagtattttctattttcttctaggatttatttatagatcaatttgttgtttaagaatttgttcaattttcacttatttgtgagttttccaattttccttatgttattgaaggtagctaaaatgaatgcttaatagagagccatttcagattgaaaaacataaacaggtttcaaggtcaaaggatgaaaaacatatctttttaaaatacaagatatttgtggaattcaaatattttaaaatttaatgagaattattttgttgcataacatggtctatcttggtcgatgttcatgtgcatttgaaaatatgtgttctgctgattttaggtggagtgttttctatgtgtctgttaggttcagttagtttacagtgttgttcaagttcactattgccttattgatctcttacctagatggtctagctattatttcaggtgagatactgaaatcttcagctgttactatagaaatgtctatttctcctttcggttcagccaatatctgcttatatcttgaggttctgttgagtgatgtttataattattaggtattcttgatacattgactctgttatcaatatttaatactctctttgtttcataaaaatttttggcttaacatgtatttattctgatatcagtattagccatccctgttatctttggctgctatttgcaaggaggcatatttgtcatcctttaatcttgaaaccttgaaacacaaaaacctgtttgtgtttttgaatctgaagtgagtctctggtaggcagaatataattagatcatgagtttgggcttttaaaaaaattattttaccaatctctgtattttaattgccaaatttaaatttagctcatttatatttaaagtgattactgataaggaaagaattacttatgttgctgtttgttcttttataagttttgttcctcaattcctttattacctctttattttgtttttaatagacttttataagtacatcattttgtttttctcttaatttctttttgtgcatttttaaaagtcattatcatagttgttattctggtgatcacaataaacatcctaaatttataacaatgtggtttgaattgataacaacttagcttctctcttatgttgttattgtcacaaaatatacgcttatacattgtaagcccttaacataaattaataattattattttatgtatttgccttttaaatagtataggaaacaaaaggagaagttaaaaactaaaaatacacttacaatggcttttatatttgcctatgtatgtacctttacttgtattctttatttcttcatatgtctttcaattctcacttagtgctttttgttttatttctatctcctttagcatttctcacagggtaagtctgctaccaatgaactctctcagtttttctttatttgagaacatcttaatttttcttcacattttaaggatattttcccacatatagaatacatggtagacagtgtttttcattcagtactttaaatatgtaattcccctggcttctggcctccatggtttttgatgacaaatcagctattaatcttattcagcatattttatatttgatgaattgcctctctttctgctttcaagatctcctccttgtcattatcttttaatagcttgattttaagaagtcttggtaggaatcttttgtgtttacccttcttggagtttactgaattttcttagatgtgtacattcatgactttcttcagcgttggaaagagtttggccattatttctccaaatattcttttttcaaattttctctctcttctccttctgtaactctcataatgcctatgttcatctgcttaatgtatcctgggggtctcttataatctgttcacttttcttttttcttttttattttaactttatttttagagccattttagattcacagaaaaattgaaaggaaggtacagagatatctcatagacctcatattccctacggatgcatatcctcccccattatcaaaatcccccaccagagtgatacatttgttacaactgataaacctacactaatatatcattatcatccagagtccacagtttacattagggttcaccttaatgttttactttctataggttagcacaaatgcataatggcatgtatccaccattgtagtattagagtattttcactgtcctaaaaattctctgtgcttcactccaactacctttccctttccactgcttatcccctggaaatggcattttttaaatgtctctgtagttttaactttgttccagagtgccatgttgttggaattgcacagtatgtaacatttttattttcacttcttttttttagtaatagcaatttaagtttccttcatgatatatcagtgtaggtttatcaattgtaataaatgtatcactctggtgggggattttgataatgggagagtatctgtagggagtatgaggtctatgagatatcactgtaccttcctctcagtttttctgtgaatctaaaatggctctaaaaatgaagttaaaaaagaataacgaaaagtgaacagattataagagaccccccaggatacattaaactgatgaacatatgcattatgagagtcacagaaggagaagagagttaaaatctgaataaataatatttggagaaataatggccaaactctttccaatgttgaagaaagtcataaatttacatatctaaaaagttcagtaaacttcaaggagggtaaagacaaaaagattccaaatcttattaaaatcaattatagtaagtcttgaagtagagtagtgttagttctcccattttgttcttatcctttaatattatgttggcatttctgtgtcttttgcttctctatatattctttagactcagtttgttgatattcaacttgctttgattttgattaagattgcattgagtcacctgggcacggtagctcatgcctgtaatcccagcactttgggaggccaaggcaggatcacaaggtcgggagtttgagaccagcctggccaatatggtgaaacccctctctactaaaaatacaaaacttagcccggcgtagtggcacttgcctgtagtcgcagctactcgggaggctgaggcaggagaatcactcgaaccccagaggcagaggttgcagtaagccaagatggcacccctgtctccagcctgggcgacagagcaagacttgggaaaaacaaacaaacaaacaaacaaaaaacaaacaaacaaacaaaacattgcattgaatctacaggaagaactgacatcttgacaatattgagtcttcctattcataaacatggaatagctctccatttatttagttctttaaatcttttacatattttgttggattattcctcagtatttcattttttgaggtaataatctcaatgccattatgtttttaatttcaaattccacttgtttattactggtagaaaagtgttagatcactggtagaaaagtgattcgctattgagtattaatcttgtaataatgactttattcttttggtccgctgagtagttcataattttctctttctttgtatgccttgaagtttcttcttgaaaagtgaacagttaggcagttaggatgttacaatgtagcaaatctggaaatcaaaattactcccatcctcagggttttctgttaatggatgtggactgcagttgttcacttgtttagtaatttttccaaaatacttttttttttgtttgcctagactctattccttgtcctgtgtggacacaggagtccttcttctattatctcttttgttggcctggtagagatgattttatcgctaatcctcatcctgacagagatttcgttaaacattaaaagtcaaaaaataaaaataaaaatctctcctggtatttacaaacagcctctgaactggggtatttcttcaaactttcactaggctgtctgcagttaaacttagtctttacctcctgtttgcagagagcccaggtaggtatgtggatgtgcgtatgtgtgtgtgtggatgttggaggaataaagacaatatataaaaataagtaaacatgttctctatcactttaataagattattgccagaaagagatgataaaatgcctaaataaaatgttaagagacagtaagaatagagacctactaagtatttgttttattttctaggctgacaatgcaccagtgacatttactaagaagtgggtctttaattttatacatataaatttaatgtaaaaaatctaacaaatcaatctaaattattataaaattttagtaaacaaatatctctagccagaatgtaaacaagtggttttagaaatttgtattttacttaaatttaagagaatatactacctctatgatggagggcatttcattaccaagaatttcagtaacttggtattaaaatgcttttaaaaaaacaattgaatacctgtgattaatttttacagtacattgctattttgaattatattatgtttaaatttgaattcattaatttaataaatatttgctgcatgtctactgtgggtcagtcatgatgttaagccctgggaaaatgacagggaaccaaacataaatggccctttagctcagaaaatttagtatctctcaagtatattatttttttaaaagctctcttccctccaagcatcaaatgaatatcattaaactatgaaagcaactgccttggtgaagtcatcagtttgtgttttacaataatgacagtaactgtattaactcttcctcatttttcagcactccaaaaagtgctttgcatacattatgtcatttaaacaaaattaaaaactattttattataatcttttcactgaaattatatcgtaaaagaggcgatgatgattttgcatttgtaatttgtcattgaggtgatcttgtgttaactattactatacaagagggcttttcttttaaggaaaatattcccttctttgggaaaagccaattagacctgcccatatcaaggcacattcacccttggtgagagacagtgacagaggtggctcctgggagtgagcaagaagcacaggccgacaagaacatgtgctgaagaagacctgggaagtttcttgatccacccatagatcctccatccttcctctgcactctccctgacatctttcctccctctgtctatggtaataggaactcaaagatctgactagggaaatgttatttatttcaacttgaatttacaatgtaatttgcttggttatcacctaggattcttactccttagaaacaatcagaaatatgtggttcttattttatattcttccctccataatcttatttggaatgggaatataaattagtgtagccattatgaaaaatagtacacaagtttctttaaaaattaaaaataaaataccatatgatccagcaatcccactaccaagtatatatccaaagaaaatgaaatcagtgtgtcaaagagatatctctcatccaggtactaaccatgcccaactctgcttagctcctgaggtcagacaagatagggtgcattcggagtggtgtgaccatagaagagataactgtacttcaatgtttattgcagaattattcacaatagccaagatattaaatcaacctaagtgtccatctgcagatgaatggatgaggaaaatgtgcaatatatacacagtggaatactattcagcataaaaataaggaaaccctgttgtttgcagtaacatggatgaacttgggggacattataacaagtgaaataagcacagaaagacaaatactacatgatctgacatatatgtggaatctaaaaaaagtcaaattcaaagaagtagagagtagaatggtgttgaccagtggctggggtggcgggggtggaggtgaaaagacgttggtcaaagattacgaaatttcagttagactggaggaatacgttcaagagatctcgtgtacaacatggtgactacagttaatgaaaatgtatttttgaaaaatgctaaatgagtagatattgtgttctcaccacaaaaatgacaactgtacgaggtaacatatattttaatttacttgactcagtcattgcacaatgcctatatatttcaagacatcatgttgtacatgacaaatatgtacaattttatctgtcaattaaaacataagatcaaaaaagaattttatttggaaaaagtttaaatatgtttggtttgccttggaaacactatgtgaagaaggcatgtacacttggcagttgtatttacagaatgtgaacacactgttagctaccacatcatcctgtgcccctcatgaaaacccacaggaaaaaatattctttaatctcaattctagaaatattgttatcttcttgggcttctagcctattgtctgttgtggattctgaattttattatcaattttgttttcatttttgctatgatcaggatgaaatttggagacaggtatggttcaccattaccaattatatagggacatttaaagtatgattttagactaacttctatagctctattttactattttatccttatattacagtccctcaatcttctttttattcattttacatcatttaatttatactccccaaatttcccaatctccagccttagggctcaccctttattcaacacacccatgagaaatccagggaatgtaaagtatgaattcacaggaaaggaatgtctctgctctcttaatgggttttgatgtctgaacgcacctacagattctggctcagcaatgtagtccccccatgtgcctactcactgatggctactgtcttctctctgtccctttcatctcacccttgagcacagtggtctccttgtcactacccaagtgacttttgatgggtaatggaggagaattatcactgaactgaacagaagccattgaaactcaaatatcatagatggttgttacaaagttccttgaccgttcttagtaaaggttgtgtcttagtcactttcttctttcttccgtaggctcccttctgttgccacatttgggccaaggaatggagagatttcttcgtctggaaacattttgccaaactcttcagatactctttcctctctgggaatcaaaggaaaatctctactagtgtgttattcagagaaattttgtccactctttgcttcaaactctcttatccagatcagcctttattatgaaatagccgaaatatagaccaataaagggaaaacccagacattcatataaagggttagctctcaggttcttgtatctgatatattaacccaggttaacatataagtgatggcaaagaatccagtgcagtaatgtgacttgtattcctttttccttttttttctttctttctttcttttttttttaggatggaattatcttctaagtttcagaggtagcttaacaactaaatggaggtgaaaactgcttttcttggtttctttccttataaatgattctcttcattgcaggatcttacacatttgttccatggcttctcagctttaaaaggggaagtgccctagaagaaaaagagaataaaatattggtcaaagaaactggttacttttttatatatggtcaggtaggttgaaaccctaattctggttttactgttcaaagcctcccattttgtgttcatttctgacacagttttttggtttgtttcttaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggtaaatattagttctcacaccctgctaattgtgaaatgaagagactttgacgaaaaatctgagctgcaaaatgcaaaaatgaaaggatggtgccctaaaatacaaatagacagaaagacattcctcaatatattgtgttttttaaatcttgaataataagctagtctgttttaattgagaaagatggaattattactaatagttttaccatttttatatacatttagaaagggtagtaatttcatagcaacttctaccttgtacataatacatggtacatagtacttctacatagtaacttctacattgagaaaaaattctaatgtattttcttcaacacttaataacaacaataataatatctgacaaggatagagtgattaccacttgccaggcactcttttctgcatgttatatatgcttgcttatttaatcttcgcatttaagggagttaggatctaggcacagagaagtaacataacttgtcccaggttacacagctaatttttagacttggtttaaaccagccagtctggctccgcaccgggagcaaccaaaactcttcttgcatgctgtggaagaaatgcccctggccaggcttgagggtaagggaaagttgtacaatggcttctttctaaatacaggtgacatcttgtgtcagtggacaccagacaggagaaatgcccctggccaggtttgagggtaagggaaagttgtacaatggcttctttctaaatagccacaagtattgacaattcagatgacatcttgtgtcagtggacaccagacaggtgacttaggaatgcgaaagtgtaggcgcaaacctacctttgcacccaggagcagtgagaggcagagagcacggcagatcttgtaaactttaggtctgtttcagctgtaattgccaacatttccttcattttatttttcaagggtgatttaaaattaatccaggctggttttgcagaaaaatatttaccttaaacacatttattttctctgttgattttgtaaaaatccagaaccctgaggaatggcttcagttccagatggttaccgtgaatgaccgtgtgacacacaggaacggaggctggctatgcattttgaaaaactgtatttcaaaggcatttacaaacaaatgcccaataagtcagttagaaactaaggaaaatagtttctaataatggaaatgatgtcattctggatctgcagccacagatagcattggtggggagatgaggaagtttataaaattagaattccctaactttcataaagagatgtttcccttcacccagtgctgactagtagtttggagttgcaaaatatttataaatggtgagactactccaatctgttatttatttatatttattagtactaaaaattttacaagtaactctttaaaacgtttttctaatcatctgctcctctaacacttacttgctgttagaggactctgctagatttcttaaggtgtcttactttttaagaataattcaccggactttaaaaatatttttcattactagtagcttactgttgtatatgagtaccatcctctagtaagtttcaggtttgcaattttaatctgttttagggcaaatttatttaaagccatttaaaaccacacattagagtatatataagtacataaaatgtttccatagcaacctgaaaagatgtaaatggccaacttaagaaacccaacataataccaaagaaccacttatatacctaaagctgaatcttattatttattgtattaataaaatgtttattagaaaaattatacctgattgctgtaatctggaagaattgaagtagccgataatttagtgttaaaatgttaaatggactctatagttgttcacacccacctaatccttagagttaatattacttaatgctttgtgagctatggtctttgtcaaaatgttaggtcatttccaatctctatgaaaatgacaagtctgttcaacaaataaatctcaatctttttattcttactacttaaggtagtcctcaaaggctttgtcaattctagaaagtgtacacataacctttaataagtcctgaaaaactttcttttgcttgtattctgtctttgcccattacaaaaaagcatacccagtggggatggaaattctgtcatccttgatcactactgtgtgtttgtctagaagggtggctggtacatagtaaatgttcaataaataaactccccctggctgctgcctgagcaaatttgcatgctttgggctttaggttagaatagacatgaacatacatgtgtttatgtaggtacattttcactatgctaatgaaacaatgaaactattctaaaaatagccacaagtattgacaattcagatgacagttttaatgtttgttagtttctttatttcttctcttcccccatttcctcctctttcttcttcatatttttgttttgaagtggggtaaataattacctgatacattgagtgtagtccctgaatgtattttgtattactaattcacagatgcatttgtccttgtaaattagttgcacacagatttattagtcatttttgaagagttaattacactgttgtttttgattataaagacaaacatggtcatctaagaaaacaaaatataagaggttgtgaaaagtaatccagataatgcttaaatccatagtcgggactctcaagaaaaactatattaatgaatgtggtatgttaagaaatggtgttttcttcagtttttaatatttatgcttttcatttgtatgtttaaaactataattaggaatatctagtatatatatgtgtgtgtaatttttcacatttttatttaacattattataaaaactttccctgtcaacaaaattaaacaaaactcatcactaataatttaatattctatcaagggatgttccatgatttacctaattgtttaaaaagttatatattgggcttcttttggggaagtccattttttaatgagtaggtgataaatgcatacatatctgttgtaactccttttgcttatttcttctaaatttttttttaggctaagataattgcaatggtttagaagtccgttggtgtattttgaagtgtgaatgcctatgttaacattttttttttacagaacaaaatagttttatttaagattcttttcttttctgttgtataaccacttatagttcttgtaaatcattttttcccaggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttgcctcat

SEQ ID NO: 2818 - DNA, 38856 bp, Homo sapiens; identical to SEQ ID NO: 2817
  source 1..38856: mol_type = genomic DNA

SEQ ID NO: 2819 - DNA, 51142 bp, Homo sapiens
  source 1..51142: mol_type = genomic DNA
tgttgatcttcttcaacttggatttatgtccatgattcgtgcaaatagctatccagggatggacagccaccctaatctgggcttctggcaccacaggcctccagctatggggtccagggtctgaacctcagggcctggcagcttcaggctggcgcccctcggcggacgtggctggcatggccttctcccatctgtgatggcttcagcaaggctactgtgagtggtggtggagagggccccagagccagaatatccatcattctcttctgttctggagacaaacccacacttcccacagctcctcacagaggggtaggggtgtgcgtggggcaggtcctgctacagagcttgaagcaaaaattaaacacacacacaaattggtcatggcaactagagggcctgaaaccacttccgggaggttttgaaggaagggggtcttggctgcctcccactcttaggattgctgctcctggaggcttctgcaacggatggtgggtcaaagccggatgaggcctctctccactcagcagcagggaaggagtttttcccagtcactcccagcagagtacaaatgaaagccttctgggtggagcctccccagtcctgtaaacagctcagttcagggactggtgtacaagctggccacccatctcagcctctcatccagctgaggctctggccacaccgtgcaagtggcttctagtttcttggcaatctgagatcagctggctctgcaagatgaaggtggagccaaatgacacaatctggtctcactgaggcccctcacggtcattttttggagactctaaataaacaaaaattttgaggacttcatgattatgtggtagagcgagtttcaaagtctcttatggaatgcagtgcaggaacagtgaaaataacagctagggttactgggtgctaccaagtgccagggctaagtaccttaagtacgctggtcatgtaatcttcacccagccctatgaagaaggcaggttattatcccattgtaaaagagggaactgggacactaagaggttttaaatgacttgctcatagttccaggtccaggaaatagtggggctaggatttgaacccaatctcaaatcctggagcagttctggggagggagcccctcccattataccaatctctaccactcatcaaagcagcctccaaggggctccactgaacttgtagggttcttcagggaaaaacagaaaatgactgagcagcccaatcccttcttccaatcaccaaatcctccaaactgcaacccctccaaggtgtccgtcccatggcctctactcacacacctgcaaagggacactcgccacctcccagagctggctccatttctgcacaactgtgtcccttagaaagaaagttcctcttcatgttgcgatggacttggcctccctgtcattcccacccactagttataattctgttcccagaagtcccacaggcgaggtggtgccttgtgccccatgagagctctacagggagcaatggcagtcgctaaggtcccaatcttttcacgagtggacacagctccaggctcttcagcctttcatggtggacaccatggtcaggggagcttttcaaacagaaatatggtcatgccactctgctttaaaaatgtccagtgactacacattatgctgaggataagacccaggcctcccaccatgctccgcaggcctgcacggtcaggacccggctacgtcctgaaccctgcgttgcccctctctttccctaccttgttcttggctccagccacgctggtcttccctccgatcctcaaatcagctcccctacttcccctcctcccaccacggcctctgcatttgtcatgttctctgcaaaagcatcctccacccctacctctccacctagctagtgtcactcattctgagagtctcaactcaaatgctgcccccccggtctaggtcggcttcctctgctatctgctcccacagaaaccggctcttcttcctttagggcacttgagtgcagcctgtttgtgtggtgtttgtttattcatttctgcctccctcattagacattacgctgtataagggcaaggactgtatctgcttctgttctctaggcatccatagcacctagcacaatgcctggcattagataatgcactagaatgaatggtttcagcccccctcactctgtggttgccattactctccattcaacactgttttggaaagctgggcctctcctccaccaagagcagaaactaacgacatcacccccaaactcaggcaatgctggcagataagatattatctcccccagggaggaccaagactcagtattaggggctcacctggttctgtaggcctggctgtgggagggtccatcacttgggagctctgatttggatttcgaacccctccacagggtagacgccaggtgtattccggctgcgacaaaactggtgcttaataatcaataatcacacccaaaaattacaatagcacctactgtgccaggacaatactaaatctgtattagtcaagtataattgaatctttataacaacccaggctggcactcccatttcacaggtaaggaatctgaggctcagaggggataacttgctgaaggtcatctagcaaggagaatggctaagcttggatttgaatccaggtctttgtaaatccagagccaatctcttaagcgccatactatatactctggtgtttaaagatgtgtaccaagaagggtcatatgggagaagctgaaaaagaggccagccaggaggtttctgtaatggtccaggggagagctgggatgcctaaggtggggctgtggcagaggactggggaaaatgggacaagtgacagcagatctttggaagaagaatgataagaagggaaaagaggccaggcgcagtggctcacgcctgtaatcctagcactttgggaggccaaggcgggtggatcacctgaggtcaggagttcaagaccagcctggccaatatggagaaaccccgtctctaccaaaaatacaaaaaattaccgggcgtggtggtgcatgcctgtaatcccagctacttgggaggctaaggcaggagaatagcttgaacctgggaggcagaggttgcaatgagccgagatcgtatcactgcactccagcatgggcaaaaaagagtgaaattccatctcaaaaaaaaaaaaaaaaaaggaaaagaaaataaaaaaagagaggagagaagaagaggaggggaggggagaggagcggaggggaggggaggggagaggaaaggaaaggaaagagagagaaacatggtgaggctctggaacctagttacacgtggaagttataagaaaaagcaaacccaaactctgatacccatggcctggggcctggagggagtcctccttcccaccctgcactcttactcagccttctccgtcctagaccagtgaccctgaacagctgtggggcagccctgcgggactgtggccagatccctgcccctgggtagcagcccagagccaggccctggacacccacctgccaccacggtgctgtttagttcagaaggatgcagtttctgaacccctcacttaaccttcctctctggaaggtgtctggggcagcctctgtgtgtgccctggagcaagggagggacacagactcaccagatggaagaggcgcgagttggggagtgggggcgggtgctccatggccatggggggaggggggtagcggatctgggaccagtcctcgaagccatggtgtggcaccatggctggcatgggcgggtaggcgtaggggtaggccccgcagagatgttctgggtggggctccacatggtaacgctctcctgaggcctgcaagaaaggctgacgtctggctttggcctgcaacaggctgcaaaggacacccatctcatcaccctctaaatagaatgttagctctctgaaggctagcaggctgggtaccaaaggctggtatgtggtcatgaaaggctgctacatgggtacagaaatctggatacatgggcatagaaggctggatatatgagcatggaaggctgcatgggcatggaaggctgggtacacatgcatggaaggttgtgacatgggcacagaaggctggtacatgggcacggaaggctggtacatgggcatggaaggctagtacatgggcacggaaggctggtacatgggcacggaaggctggtacatgggcacagaaggctagtacatgggcatggaaagctggtacatgggcatggaaggctggtacatggacacggaaggctggtacatgggcacggaaagctagtacatgggcacagaaggctgctacatgggcagtgaaggctggtacatgggcacagaaggctaggtacatgggcagtgaaggctggtacatagacacggaaggctggtacatgggcacggaaggctagaacatgggcacagaaggctggtacatgggcacggaaggctgggtacatgggcacggaaggctgggcacatgggcatggaaggctgggcacatgggcacagaaggctcatacatgggcacggaaggctgggtaaatggacacagaaggctgggcacatgggcacggaaggctgatacatggaaacggaaggctgagcacatgggcatggaaggctggtacatggacacggaaggctggtacatgggcatggaaggctgggcatgggcacaaaaggctgggcatgggcacaaaaggctggtacatgggcacggagggctggaacatgggcatagaaagttggatacatgggcacggaaggctcatacacggccaaagaaggctagtcacatgggcacggaaggttgctacctggacacagaatgtcaacagtgatgacagctaatacattgtgggcactgcctctgtaccaatactgctctaaggcttttcctgtattactcatcagttagttagcagaggatgtccccacgcccgagcacacactgtgcatccatcaggctagctccatgaggaaggtaagaggatgtcagtgctgctacctccctcaagcctcctcacctttgctttcctcttctgctgtctgagggcttctcttgccttctcctcatctttgaatgcttttagctgagagaagaagggagggagaaaagactgtcggcacaggtggtttctggccaggcctggatccagggcctaaccagccacgaggactgaccggctgatgcttccctctgggccaccatgcgtgggccagccccgggaaagggccctgagggcggagcacagcccaggctgttgctgcaggccacctgcttgtcacagtggtctgtgcacaggtcaagagggttcacgtgaacctcgctgcttctctgctaacatcttttagttccactctgggagagtaaagcccagaactgactgtggaaagtcagaggtagagatatcttagagtaaaactcgtaattgtacaaagaaagagtcagagaggggaagggccttgccgagctcaaatatgattgcagagctggagagaagcagtgagggtcctgacatccagcctcaccagggccctccaatccatgccccctctccccacgaggacaggccagttgcccttcctgggtccagtcactcttacctgggcatttgacagggtgacctgggcctgcagcttctccacttgcttcttcagctcttccttctcctcattcatgcgctcacgatcactgcgctccctctggaagtcctcctcgaagatcttcacctggtgtggagggagggtgaagagagggagggggatggtcctgagtggggatttctcctcaggcccagactcccatgcctcctgctggggtcacagatggcagagctgggggtcgccatggggagtgggacagctacacctccagcctccaccttaacttcaaacagagtagttctgtgtccctctatcttacattctgggcttcaagctaggactttatttgaacaaaggatatatggttttaaaaaaacgttgaaagccatcaaccagtgcaatcctttcactccgctgagacccacaggggcagtgatcacagaaccagagtgtggtgtagaccagagtttggatctgctggttctgagggcagagaccctacaaactccgctagggctccagggtgccctggcagaggtgggttgggtggggcctgcctctgtctcttagcctgtagtttcacatccttagtgcagatcagctgagacactggctaggttcaaggcagtttaggaggattaaatagcacagagacaatgggagagccacaaccttttcgctttctttcaccccaatccttctgtgtccctcagggctagtaggtctttaataccattttagtacctgccaatctcctttaaataaaggagaaaagaactccagttcagagtcttcatttggcaagagtatccggctagagtttaataacattgttctgtttttattgtttattgcgtacagttactttctacttgtgacaaataataaatggttttttccaattacagcagtgatataaagctcccttttaaattcatttatttagaatttattttttaaatactaggtaaataatagcacgtgtggggcatagagatggctaaatcataaaggtggtagaggaacgacttaagctagggttatggtgctggaaaggataaacctagagccagtggggggccctggccaatggccagaaagtggattactaattacaggttccatgtgattccaagccgtctgggccctcaggaaagctccagctcccacagagcacctcccacctgatttcctcccggaagcctcacctgctgtttcagcaactcattctgcgtgaccagctcctgtttccttaggagggcccctgctccttctgggctcccaaatgctgttggtggagatgatggcggggtttggatgctcagtgcttcctccagggcctggaatcaggaaaagatgggaccatcagcaggaacccctggaaatcagggccctttggaggggtcatcctcagggaactccttcctaataataatcatactaataatagccaccactaccagtcctatttaataaatgctgccctatttatttgcattctacacatatcatttcattggatcttctgcacagtgccatgaagaaaagactatgatcatcatcctcattttacagatgtgaaaactgaggctcagagacctgaaggggcttgtccaaggtcaaggtcacacagctagtaagtggcagagcacagattcaagcccagcacatgctcctacccagcaggctaaactggggttgtcatgcagaaggggaaacctccccttccctgaacatgtgtggctcaattcttagcacccagacctagaaggaagattaagtcctccgggggaagcttcagtctccccaacaactgccctgccctgagattcttcactttcagcaacccattcccatccaaaccaccccttccatcctcaacacttatgtacatagagaagactggatttaatttctgcttagttaatattttccctttctaacactgaaaatgggctgaaatatcatcaaataacattttgaaaataaaaaaatactcttaatctatcatgttcacaatagattatataaacagtgtgcccacatcttcttaaaggtttcagttaaccgtgtttcccctttaactctgttaacatgttactcagaactctggaacatgtctcaagactgggcaccctggactttggccccaggacagcatcgcccatgggcctccctggaccgaggggagatagagacctggcccaacttggactcgggcttccacctggtctcctcagctcccctagacacgcaaagaaactgcaggaccgagagtaaattcaggatgctccgaggggaagttatggctccactttatcttcctactccaccccacttttaaatgaaaagactgaggtccagcgacagggagatgcctaggtcatgagcaaagaaggccacatgccctgcattactcatccacatggtgtctgtccctggctctgccaagaaaacctccaaggtcatctttatgatcagcaacatggacaattctctgcctggatttagagccccaagtcccccagctcaggacagatcgcgtttctttctctggaaacaggtcaagggccccagacttggcataatcagtgtttacaaaacaccaaaaccaaaaagaaagggtttccccagcaggcctaggaatgctcaactcatgccagagtccactgtcaccagggtcaggaggcagagggaaaggaaaaacaattagcacgaaacgaaaagctgagccatgaacttaactcctccaggccctcagagaatgtttcctttcaaagctccctcctgtcagcttgcatctttgaaatgtgctggaaagcaggcagaactagagccgttcccaccagggctcggatggcaaaactgaactggagaggctggagaggctaagctgggactagaccactccgcttggctcagaccagagggtttctggtttcctcagcctctaccctgggggccccatctccctggatcccactgcacaagggcgggcccctcagcccgtgctcctccactcccatcagtgtttgctgaacatgtgcttgatgccaggcgctgtacaaggcgcccagggtatacaccttggtgaaagtatgcacctcccaccaccagatgggaagacagaattaaataagtgatgacgagccatgagaaggagtgtcagagaagttgctggtacctcaggagcatagaccagggcaacctgaatgagattctgggaaggctttgctgagcaagtgagggtaaaacaaaccctgacaagcagggtgggcaggtgaggcacaaggggaagagtgcacctccagagggaagggtgacacaggctaattcaagggctgagtcactcccagtgtgggaggcaatggcagagcaggcgggaaacaggatgccagctcactgactgggggttacccttcctaagctgaatggttgggggtgccagtgatggggtgggcattgcagctggactcaagggagcccagccaagggacccgggccaaggcacccaccttgttgagccgctggatctccttttcctggtactcacgctgtcgggtgagtgggctcagctgatcctgcaggtacttgaccttttggcgcagctccttggcctctgctgtcagctgctccttgtcggtctgcagggaatacaaggttggtaagctggctaggatggcctctccaggaggcctcggattctctgtcctgcctggcccagcccttacgttctcccctggccatcacttcacaatgctcacatgcaaagcacctggggtcggtacagtaatgtccatccggtcctgccctcaattattatgtgtcaatttaaaataataattaaaaaaagaaaaagcagtagctcagttgagtaaaagaccctggattccgacaccagttcatccactaagcagctgagacccctggcactgccacagccctctcttgtctaagcttacctacctgtcacaggtacggggttcctaacgtgagtcacacagagacctcaggaggcctgtgagccccaaaactgaatgcgaaattttgttgtgtgtaatctgctagaaagaaaagccatagttctgaccagattcacatgggggtcttccgtgatccacagaaagcgataaactacggataatccctaacagacactgcagctcatacagccttggagcctagaggagagatgacacgcccagagagaactgtgacataaggcagagagtgctcctccagaaagaaacaaaatactgtggggctaaaagaaagatcaccacagctgagggaaggcttccaggaggcggttccataccctctacggaaccagcagggcttcgccacagccagccaagactgggatggcctttagacagcatcaagccccagccctgtaatacgatgggaaacaaatgtccagagaggggaagtgacgtacccaaggccacacagtgagctggggctagaacccaggtttcctattcccttgctctctctccttccatgtcaaaggaggtgttgaaactaggggatggcagcacagtgcagtggaaagaccaggcacatccccaaataaactatatattcctatgtgtacatatatgcgagaaaggtctggaaacagatgcaccaaaatggtaacagtggttccctctagggagggcctgggatcatggcagtgggaggtagtccagggaaactttcactttgtagcatgtggacatttcataactgtgtattcacagcatgtgattaagagaccagtcgcaggggttagttttcacccagccctgtgtgacctttagtcagtacggactgcagagggcaggcttggtcagacctccctgggaattgttctggactccccatcaagaggctcccggatgggcatgggctttaccgaaattcatccttatctacagggccacgccttgtcatgaaacgtcctaccttccctgtagctgacagggaagagccctcacattccagggatttgtctcacctaccactgtgagcaagggagaggggccaaagagccaggatgtctggctgcgagtcaccaggtatgactgtgcactcataaggaaagacagaagtgttctccctaccacacctccaaggtaagggggtgtcacagacgtaggctgactgctcaaataaggcccctggtgtcccatgctgacgggaggaactgtgaaaggcaatccaggttgaaaatgtccatttttaagctaggcaaaagaccatgcccagttcccatgaaggggaaaacatggtgacataaataaaatctcccaagagtctggcagtcaagtggcctttcctctttaagctgctccaaggtcctgatgggccttggctggtctcattcatacatatgactgggcagatactactacttcaggggacctgttgtttccccccaagaaagaatctggtctcacttatgcccactctctgatctctgtaacttcttcttcgtagtactttttttttttttttttgagacagggtctcattctgttgcccaagctggagtgtagtgacacaatctcagctcactgcaacctccgcctcccgggttcaagcgattctcgtgcctcagtctaccgagtagctgggactacagacatgcgccaccactcccagttaatatttgtatttttattagagacggggtttcaccatgttggccaggctggtctcaagctcctgatctcaagtgatccgcccaccttggcctcccaaaatgctgtgtttacaggcatgagccaccatgcctggccatacatttttcttttagagaaacagggtttcactctgttgtccagtctggagtgcagtggcacaatcacagctcactgaagcttccaactcctgggctcaagcaatcctcccacattagcctgagtagctaggtctacaggtgcacactgccacacccagtgaattttttaatttttgtagagacaaggtgtggctatgtcactgaggttggtctcaaactcctggcctcaagcaatcctcccacctcggcatcccaaagtgccaggatcataggcacaagccacccaacccggccttctctgcaacacttaacacacttttactttatttgcttctgtaattagttgtctggcacctctttcccagcgagggcagggttgagctgttcctgtggactctatgccaaagcacaatgcctgagacaggctctgaagacaaatgccgggatgaatggataaatgaagctctgtctcatgttgtagcccctccccaacaaatcaccatcactatgctgaacacttggcagcatcccaccccaccaagtgccatacagcaggcctgcttggatcttttttttttttttttttagcaagagtttcactcttgttccccaggctggagtgcgatggtgcaatcttgactcactgcaacctccgcctcccaggttcaagcaattctcctgcctcagctacctgagtagctggaattacaggtgcctgctgccacacctggctaagttttgtatttttagtagagatgggatttcatcatgttggccacgctgatcttgaactcctgacctcaggtaatccacccgtctcggcctccccagttgctaggattgtgagccatcgtgcccggccacctgcttagatcttttatatggtgtgcttccctgtacagttccccattccctacaattttaatggaacaaaaagttctgaataaaaacaagaaaatgtgaaaagctgtagttaatgtaactttctcaattttcagatgggaaactgcagtgcagggaaggaacgtgcctgtgtttttggtcacctagctctttcgcactagacccccgggtctcctgactcctgcccctggcttgtttgctccacagaactctccgctaatgtggaggggaactgactctgcagggaccagcagtcacacttgcctcctccatttcaatcttggacttggccaggaggagcttgcggtcaaagtcacgctgcttctgctcccgctcggcctccaggtcagtcacctgcttctgcaaatcagccagcttctgacgcagctcagtgatctgggttcagaggcagagaggagtgtgtgaggcaaggatgtagagcacttgcaggatgtgggcagggcctggctgcccctgggccctccaacactgcccccaacttctcctctgggccatactggggctcagcgtggccactccccaaggttcaaagctgctaaagaggcagcgagatgaagaccaggcatgccctgtgggcgtggccaggaaccccacattaccttctgctcatactgctgcttcatggaccggaaatgctggtcccactgcttgttcacttccagcagctgtggggagagactggagttagcaggagatgagcagagaaggaacaaggagagccatctcctgccccatgtacaccagcgtcccaaggtgtgctcggtgtgtgtgaatagtggctacagacactgtctccatccctcagctctcgaaaactcaatgttgctcaaagccatccaccttcatccactgctgcattttaccttgccaggaaagcaagattaacactaagacatggaaactacatagttttggtgaataattatggaacacacacacctctttggagggcagtctgggattatgtattgaaatttcacattttcatcaactttaacccaataattccactctgaagaatttaaccaatagaaacacttacacaagtgtgcaaatatatatacacaaggctaatcatctcagcaatacctgtattacaaaaaaatccagaggccaatctaagcacagaagataggttaaagaaacgatagtataaacagacaatgtgcagctgttaagaaaataagaaaataggccgccaggcacagtggctcatgcctataattccagcactctgggaggccaaggtgggccaattgcttgagttcaggagtttgagaccagcctggagaatatggcaaaaccccatctctacaaaaaatacaaaatttagccgggcatggtggcacgcatctatagtctcaactactcaggaggctgagatgggaggatcacctgaacttaggaggtggaggctgcagtaagccgagatcatggcactgcactctagcctgggcaaccaaagtgagaccctatcttaaaaaaaaaaaagaaaagaaaaaaagaaaacagaaaataaagcacctaacacacttcctcagtttgaagatgacactatccaccatactcttgatataacaattcctcagggaagaaaaacaaccctacatcatcaactaaataaaacaaaaggagtattggccctgccccttaagatatgtcataaggatccacaccaatttcaaaaacattgcatatgataaaaaaaattacaaagaattaaaggaatatagcatatgttatagatatgaatagatactctcaaaggcagttaattttttttttggaggcaggcctaggctggagtgcagtggtatgatcatggctcactgcagcctcctgagctcaagtgatcctcccacctcagctcccccaagtagccgagactacaggtgtgtactaccacacccagctaatttattttttgtagagacagggtcttgctatgttgcccaggctggtctcaaactcctggttgcaagtaatcttcctgcatcagcctcccaaagtgctgggattacaggtgtgagccaccacgcctgacccagttaattttttaaaaaagaaaagaaaaaataatctgtaaagcagtgtgtgtatatacatatatatacacacacgtatatgtataattttattctactttgaaaaaaactgagggatattcaacaaactgtaatcagttgtggttttctctaggaggtggtattcttgatctttttgtaatgagcattatatcacttttgaaatcagaaaaaaagacgcttataacaatacaaaaagaaatctaaaactaatatgcacatcaagaagctttcaaatgtgcgggaggacaaggggaggcaggctcagggttctagagaagcacctgggctgtgtggagaggggctagacggaacagacagaacaagtgtctaccaaaaaggagctgcacttcgacctcgggtctggaaagactggactagactgggggtgtgaggagggggaggaacacatgtgagatccatgggaagaggcggaatggactgcagcacagggactctgctgcgtggcttctctcttggcagcagagggaaactaagagcctcttacgaactggctcctgcaccttagtgggactgggggacatttaaactacctaaagacctggccatcgccttaatggagtttaggaatccactcagtattctgtggcaggcttcggctgctggctggtccttttcattcttgcctaagaaaattcttgaaatgggagtctcaaaatatctgcaaagtagctacaccaatagaggtaggtagctatttttttttttgagatggggtcttgctctgttgcccaggctggcacgcggtggcacggtctcggatcactgcaacctcagcctcccgggttcaagtaattctccctgcctcagtctgagtgggtgggattacaggcatgtgccaccatgcccgctaattttttgtatttttagtaggcacagggtttcgccatgttggccaggttggtcccgaacctctgacctcaggtgatccacccgcctcagcctcccaaagtgctgggattacaggcatgagccaccgcacccagccaaggtagcttttaacgttaaaaattttgacagtaaatttatggagcctccaggctagtgggaagcggccttaatcccttccttccatgatgggtcctccctaaagcatctctcaagggtccctccactcctcatcggtgatgctaaaacttgcctaacttatcacaacctctttccaccatccaaggtctaccataggagcctgcctaaactgtagccccaacaattttaggccatgccccacatgccacctcctcagagtgaccactgtaggcaaagggactgatcaagagaggacagtccagggcaaggagtcagacctcatccatgggcaggcaggtcagtggtcaccatgccaactcctcatggtgacctgggacctgccagagccaggaggccagggcaagcctttgtgctgctggtcccgggaggtaagagggatcctcccactactgccacctcggccacctacctcactgcgctgctgctccagcatcttcaccttcttctcggctgcgcccaaggccaccacctctgggaccttacctgccgtcacactagcctggggagaagcacagaggagccttcaccaaaacctcaatacaaattatctcacccagtctcggtgctcctctaagacccctcacccaagtggccccagccctctgtctccctattcctcccacccagcaggacaccactaaccatcccagtcatgactacgtccccttctagaagtctacaagatgatgattccccctccctgactcagggtggctgccaggccctctccccttcccttctcccctccctacggtcattctccctgtttaggtacaacctctaaggtactaccagccactctcctcactccctacacacatcagccaaaaaactctctggcctggaaggtaagacatttgagatgtagatacagacagatatagatatagatatactcattctataaaacatatatgttttataaaacttttacaaaagttgaagttatataaaatgtttatttaaaaacatttttagaaagatgcagaaataaagatctgtgtaatacacatagatgtttcccagctctgtcctctgtaaggggctaaagcagagacatccagcagcactgagcaaacctagtgctcagttggtttctaaataccattttctttttattaaaaagaaacagggctgctttgaggggctggagcagataaaatataaggtgagtttgatgcatcttatagtgatggaaagtaaggaagtgctcaaatgaataatactaataacaataataataaaagagcatgtcaaaagggcacaagagacaacctgaaaaaaacatctatggccaaaacgggaacactttgaacagcaaaatacatcacaatagtattggattataagtcacagtatgaaataaatactcttgagttcatactgatagaacaaaatagctgaatcaataaataaatgggggagaagggacagctcttccttacaaaagaattctgattaataagtgtaggaagaatgaggaaaatatgaaatcaccattccattactacagtaataactgctgcaggtggagatccaccaatggtcactaaaatcagtgagtgaaagtttaagaaaaaatagagtatttgcatagtctctaagtttctcctcaaaaataaacacttattaattacaaagggaaaattggtcacttgattgcagaaacttgaaagacagcacttggccaagtgatgaaggttaacagtagtaaaacactgacatcatgtacccctggtctgctggactgagaaatattctgcacactctgatgtacacagaacgtcacctccgtgagattcttgccaaaacacgtaacctcaatctcctcatgagatccaatcacttgtgaggcctcaatcgtgacagcaaataagtctatactgaaaaacattctacaaataactggccagtacaactcaaaagtttcaaggtcatgaaaagcaaggaacagctaggaactgtcacagactagaggaaaatgagggagaagagacaactgaatgcaatgtgggatcccagactccatgctggcacacgacaggacatgagtgcaaatctggtgaaatctgaataaagtctgtagtttactaagtagtacatgccattaattcctagttttgatcatttaacctgggttctataagatgttgccgttaggggaagtaaaggaaggggataggggaactctctagactatttttgcaactcttctgtaagtctagttataccaaaataaaaaggtttaaaggttaaaaaaaaaaatagcaagtgctggggtgaaacagcagacaaggccagtagtccggagggtgtgtgtcgactctatctccaagcccctctgtgatggacaccaagaccctcgtcttctctgggcttcaatgcgatgagaagctcaaacagaagaaggtctgcaggccccatccggacttctgacattgtctgccatcatcctggagtcagattctctctattctcagcgttctctttccagcgttctctttccctccacactgcacccccaagtggcttcaggtagggctgggtgcagagcttgccccctacaggctcaggcctgtaagcacaccatagcaccaaggagcaaggtgagggggagccctccaaggaaggtcaccccctttgagaaaggggacagacaggcctgcccacttgaaatctgcggcatcttggatgggagctgtgcttagcaaaaaggtcaacaagttaccggggaaggaggaagagggtggattccaggctctagggtggtgcaccctgaacctccgcgagggagagaggagtccacgtggagtcagcagagctggctgctggccccaaatctcccctaaagagcaacagctaacgttcactgtttacgacgctaaacctactttacaagcattgcatcactgaatcctcacaaccaccccttgaggcaggtgttactatcttcattttacagaggaaactgaggcctaggagtcttatgtgacttacccaaggttgcagtgctggtaaaaggtggagctagtattccacctgcatgcaattccaaggcacactcgtcgcccctctgtaacacatgcctctaatgagacaggtgaccctggggcacaagggcaagtcgctcccactctcaggaagggcaggaagagcatctggctcggggcattcaaggaagacgagtggagattaaagggcacaggaaaagtaaagagacctgtccagggaattccacacctgaggcagctcagagaacccaagggagaacagccgagtctacaagtcccttccacaagagggcagacaaggccggatctgatttggggaataaagggaagaaaagaggatctccatgggctgggattcggaacaccagggaagagcagactttcaccatttatcagcatgtttccctggccgtaccctacatctgcctgatagcaggtcacacagaaatcctgattatatgatgttacttgacctctccaaacctatggccatagctatagaatggaatactagtcccagccttgcctactctataggtagagatgaggcccaaataagaaaatagatttgcatgtcctgggtaaactctacattgtcacacagtaataaggaattaagccattacggtaattgctactattgcataggtgtagggtgggttaaagacattgagccctactgttcagctattaaaccccattaaagggtgaagtaaaaacacgttggtaaagagttgggactcagctctgcagcaaggggaatggtaacgactgggcaaggggtgcagagtctgctcctgcttgggacctggatgtggccagtgctgggactagaggataggggagtgggccagccctgcagcatcaccagaccacacagacactagccaacaccctcccctctccactttagaggctccagagacacaatcccaggagcttagcagaatccaagggagcttgctcaaccaacctaattctgccaggaatatcaaagatgttaaactgacttttgggaaccactctctaagacagaccttgacaaactggaatgtgtttacggaatgcacccagactgagcaaacgactcaacaccaccttctatgagcaatggctgaaggaactggagctatttagccaggagaagagaaggcttatgaggcccatgaagccacagtgactaccagcagcctctaagcatggaggtcaggccaagtaaagaaaaaaacacgtaacagctagaaccttctaccactggcactggctgcaggagggaggaggctcactgtcactggaggtggtaagcagaggctgagtacctgcaaccaaggatgctacagaaggaatttctgaccacatacctgctgctgtccagccactgccttcttgcctgtcccttccatcttcggtgagcctggccgcccagacgcaccctctttgttgccattgctcatcaacaacttcttgagctccaaattttcctccctgggatggaggtaaacagagaaatcacaatgctgaccctgagttaagaaacctacagggctccttaatgctcactatcgcatgagttgcagctgagccccagggagtactgcaggatcctgaaacctgccctcctggaaaaccaaaaagggcatcttcagctaccttgctctcaatctgtggaggtctctgattgtcaatggcagggtttccccagctgtggaatttctatgcacacaagaccttccggatatatccaaacactgcattaaataaccctggatcacattctagtgagaaagtgacaccctttccaattatcttcacatttcttgtgtagaccacggagacggtgcgagcttggtgctaacaggccctgggcacctctctagttactcgccagtttccctcgttaacacagaaggtgcaggctgcaggcccagagccttcaatgtgcaatgatccttagcctgaatttattaacatcctttcactttcattgtatttagagttatcttctatttatcacaggtaatgctgttttccatttactctagttaaagttgcctttataattttaagtaaaaagatgaatcaaattaaagtaaaattctaagtaactaataaggcaggtgatagaggagatcataaaattagtgatgtggattcaggtctgactaaaatgtttcttctttcttttttttgagatagggtctcgttctgtcacccaggctggagtacagtggcccaatctcggctcaccacagcctcgactgctcctactcaagtaatcctcccacctcagccacccccaacctcccccaccacacacccccaccctcttgagtagctgggactacaggcacaccaccacacccagctaatttttttggtattttttgttggggctgggggaggggtggtgatgtatttcaccaggctggtctcaaactcatggactcaaagcaatcctcccgccttaacgtcccaaagtgctgggattacaggtgtgagccacaacgcccaaccaccacttctttatgttctatttgccagctgagtttccgcttgaaaaaccaataagtaaaatgactttcccaaggtcatacagcagagacttgcattcttgccttctaatccgtgacttttttccccagcttcagtttctgaatccatggatggggtcactagggctataaaaaccccaaaagtgcatccttggccatccaaaagcaaataaattacacactgattcaaaatagccagtggctcagtagttaaacattacttctgtggccatacttacaaagtttatattccttctctttctgttgattctaataagaaacaggagaggagggaaaaacagagtggcaagtcctgtctgtgacacgggcctttcctatgtgcctgagcccagctggtacccaccagatgactcatcacccaaactgtccaggaccacagtgcaggcaggaattgtggccactcacaggatggagagcaaggaggcccaagttcctgttgtaagactccaatcaagtccctgcctctccctgggcctcagtttcccctctgcacagtgagaggtctgtctgcatgatctccaagggcttgtcaagctctgacagtcaagatcagtgtttcccaaggcgtgatcctgtgcctacctcgttcataatcacagagactcctggtgaaatgcaggctcctaggtcttgcctaagacctgtcaattcagaatcttgcaaaggaaggaagggaaggcgtataaacttgtaatgcctttccctgaccctcaaccctcagttaagtctaagccccctagtccagtgggggagctctcatgttctcaggaagacagagcaggttgggatggtgaccagcaggaggcagcaaagtcctgagtcctctggacagccagttcaccgttaacaggggagagaggcaagtgctggaggaggaaggaagtacaatctatgctgaccttcttctgaagctctcaaggcactctatacacctcccaaggtggcaaaagggccagagagaaaataccaaaagagccaaggagaaggatcaagagacgtaacctccaaatagggctctgggcacagggcctcagagccacggtcctcaacccagaaatcagtgctgcacaccagcccctcctcctgcagcccccactcctcaccccttctctgaggggcctgaacttaccgcagcctctcggcagcctgatcccgctgttccaggcccttatccaacttggccttcagagcctcgttctccttccgaagctgctcacacagggtctgtggggcaggggaacagacagggtgagggaaaggaggggcccctcccaggtgcaggctgagctagaggatggtggggggcctgtagccaccccagggcccaactccttatcccctttgcctggcctcaccccatccctctctaaggagctaagccacttggccacccacgtgtcctctcccttgggagccaactacggagaagcctgaccaagtatcagccatggggccttctgctcctccaagacagacagctccatcccttctccttcatccctgctcccactgccgggacccctattccccaccagcctcccccagctgacttctacccttctttgaagtcttagtttaaatcccatctcctcagagaagtcctccctgactccccgatccagctacattaggctaactccgttatccttgctcacagccccccgcttttacgcttctcagcacctgtggcagataaagctaaagaactgttcgtgctgctgttttcttaatatctacccccttacccctaattaattcctgagctcccggagggctgggacccctaaccatcctcttgttcactgccagatccccagcccccagctcaaagtttgtggaaggaacaacatgactgaacagccaaatgagcaaatggacaaatgagcaggcgagtcctaggggggctgaaaggcacaccaatttgcaggtgtgagaggtgcccagtgttgccaaggggaaaaccagaagacaaggcattcagtcgggacctcactatgccctcacgccctcacaatgtggctgtgacacttggttcctcctctacaaaagaaagacaactgtttctcttttttttttttttttttttttttttaagacagagtctcactctgttgcccaggctggactgcagtagcatgatctcagctcactgcaacctccacctcccaggttcaagagattctcctgcctcagcctcctgagtagctggaactacaggtgtgtgccaccatgcctggctaatttttgtattttcagtacagacggggtttcaccatgttggccaggctggtatcaaactcctgacctcaagtgatccacctgcctcagtctcccaaagtgctgggattacaggcatgagccaccacacctagcccagggacaactgtttcttctctgcctcctctatagggctgctgagagggacagatgagacagtgagagtggaagtgtccatgaaccatcagtcacttgcttatgtgcggggactcatattggaagctctgtgaactgggggcatggaagaggggtcgccagactcaggacctcacaggctggggggaagggaaggtgctgactagcaatgctagcatacagtgtcagcacagagttgttcaatctttccacagatcctcactgagcacctcacctgtgccaggtacattgctcggtgtttctccatatactgcctcactggtgcctcacaacttcctcaaagctaagtaactcatctctatgttaaaggtagggaaaccaggtaaaatgatacagtctaacaggtgcacagctgctaagactcatcactggcggggagtaaaactccaattggcagaccccacactggtgtctctttcccctgtgatgaaagatcagagaagggagagagatggtgcccaaaggaggggacagcctttgagctgggccaggaccagggccattcactaaacagccatctgctgccttccacctcccaggcctgttgcaggtggatgcaaccatgtgactagttctggccaacaaaagaggtgtagaagggacaagcatcactcctggactggcctacgcacaattctccagtctctttttcctggtagcaggggctgatgtggatgcctcgtattctaaagggcaccggaaagttgggcccctgtctccctgggactctaaggaactgtgtagagcagaaacaaacccctgccacacagaataggagggaaaacttttgttgtgtaacccagggagatttcagagttgtttcatttctgactcacaaaggagactcttgggaaggctgaatggaggacacagccttcaactggaggtggctggacaatgagggagatgaggcttagcaaacagagaaccagctgggcatggtggctcacaccagtaatcccagcactttgggaggctgaggcaggaggatcacttgagcccaggagttcaacaccagtctgggcaacatggcaaaaccctgtctctactaaaaataccaaaaaattggccaggcataagggcgcatgcatgtagtctcagctattcagggaactgaggtgggagaactgagcccaggaggtcaaggctgtagtgagctgtggtcgcaccactgcactccagcctgggtggcggagcaagaccctgtcccccaacaccccttaaaaaaaagaaatcaaaaaattattgttatgagtccattcaatgcctagcagagagccttatgctatacctgaccttgaatatgtttgtttagtgaaccaagaaacacatcagtgaatgaatgaggaggaactggatcaatacacctccacccaggcagtaaaaatacccaagatgccatgtctctgggcgaggcctccagggaacagaatggcctgctcctagtccctaagggaaggccaggacaaggcctcacttgctgtcctacccttgcagtctagagagctgtttccttggagtctctgggccaatgccctgggtgcaaaccggccaatggatagaatcatcagaggtcacaaagatcatcaccttccatccaaggtgctacgagagctatgagttcatttgatcatttattattttgtcctttcattcattcaccaagtgtgtatgaagtgccacgaactgggacgcaacagtgaatacaacagacatggtgcctgcccccctcaagcttaccttctagcagagagtataagaaaaaaaagagtataagaaaaaatgtattaaataaaattattacaaactatgataagagctaagaaggaaataaacaaggaggggactgaaataaaaaataacagaggttggcaggaccccttttaaggggcctaggatctatccccatctcaaagctgaaaagtggatgcgcaaagtgctctcaccccaggcaccttcctaccctgcccacagcctaggcactgtgccaggctcaccttgccagggttcagcctggataccttgaagcctcactgacatcttaaaggggttcccttctctcagcctggctctccaggcctctgcctctcgttcagcctcacctcccaacacacccctcccctccaggtgggatgggcatcctccgtgctcctctacccccacacctctcctcatactgcatctccaacctgattgcccttcatgccctcggcaaccaaggtcacgcaagggggactcccccttctgccatcagcggggcacttgagtgcctgctgacatgaatgagaccacagatcagagaatggcctgggaggagagtctgcagggagtaaggaggcttcaagtcatggctctgtcactaaggtggcgggcactcagatcacgagcagtccctcagaagcctccgttttgccatctttagaatggtcaccaattataactgaacacttccccgctgctaaagcccacaaggctaagaccccctgcccagtgtggatgcccgtcatgaactccgaatggggacctctcttccagcatggactaggttctggactgcactgggtgcttcatgtacatggcctcatttaatgcagcaatctaaccatggaggcacttctagctcatgttactgataggaacattgggggatagagaggataagtgacttgtccaaggtcatacagcaataaagggtcactactggaaccaaggaccatataactccaaggtctggcctggcctagcaaggaaatctgtccattccccacagcacagggaggctttcaaaaggaattcaataggggaggcaggttgggatggtggtcaagagtatgggctttggaatgcgagagatcgaggttccaatccctacttcaccatttaccagctgggtgaccttgggcaaaaaaagggctgcttccccacctgtgaagtggtgataatgagggtgcctaccctggggggaaagaggcattatgaaaggagttgacctttgttccctcccttcccatcccccaaccctgcacatgagaaataaaggcagggctgctgggggtatccccaaccatgacactcgcattgcccatcccgtatttccccatttccttcctcttcctcatccctccccacaacttccttatcctgttcatcaccctgaacaaaaagcccgaagtctgcccacaacacagccttcagaagtccccatggtaccagtggattcccaggagcaggaaggtgggaagagctcggggggaagcacgcctgcctgtctcgggctgccctccccacgcgcctcacctgcagaatggaggtgcgctgctcattcttgtgcaccttggatgccagtcggttgaactccagggccatgcggcccaggtgggtgaagagctggccgtggtccggctcctcggcacacacactcagcgtggtctccaggcgctgcaggtgcagcatcaggttgccgtcctcacggggcagggggcccagcgcctggagagggaaagggcacacggcccactcttcaccaaggcctgagtaggcgccgccagtccattctccctctgcttcctcatttctcatgactcagtttccccctgtgaccccagctcagccccgggaaattctccagttatgcaggttccctgtctggggctgactcacagggcagaacccaggactcacaggccactggtggctccacagcagcggggccaccatcctcccacacactgggccttgcagagtgcctgacagtaagtcacttgtctgctggacctcagcatcctcatctaccaaatgtccgcacaacccttccctcccttcaacctcacagggttcttaggaggatgaattgacccctgacagtaacaagcccagaaaagggacatcactgcacagtcagccctccatatccatgggttccgcatccatggattcaaccaactgcagatcaaaaatcttctaaaaaaacaaactggccgggcgcgatggctcacgcctgtaatcccaccactttgggaggctgagcgggcagatcacaaggtcaggagatcaagacggcctgagtggtgaaaccctgtctctactaaaaatacaaaaattagctgggcatggtggcacgtgcctgtaatcccagctacttgggaggctgaggcaggagaactatttgaaccagggagtcggaggttgcagtgagcagagatcgcaccacagcactccagcctgggcaacagagcaagattccgtcccaaaacaaacaaacaaaaaactgtattgaacatgtacagaatttttttcttgtcattattccctaaacaatacagtataccaaaatttagcatttacattgtattaggtatcgtaagtaatctagagatgatttaaagtatataggaggatgtgtataggttatagggaactactacgccattttacatcagggacttgagcatccatggattttgggtatcctcagggagttctggaaccactctcccatgtttaccaagggacatctgcatatacgtcctgcaacctccgcctcctgggttcaagcgattctcctgcctcaggctcctgaggagctgggattacaggtgtgcaccactacaccaagctaatttttgtatttttagttgagacggggtttcaccacaatggccaggctggtcttgaactcctgacctcaggtgatccacccacctcggcctcccaaagtactgagattacaggcgtaagccaccatgcctggcctacacatgtgtcttctggggaatggcccaagcattcatcagcttctgaggacccaagactcaaaacagtttaaggaaccacagctttagctatttcagaaagtcccaaactagtacagtatgtaagaaataaagcacaccgtgggccagatagttgactctttctctctagtctatctggaatactcctaccaaagacattgcctttgttacaccaattccactcccaaggacctgcagtgttaccctactgcagacggcactgggcccagctcccctgctgggcatctaaggccctacagccgcaggtcccatccacagcagcatccagttgggctccccactttaccctgcctgaacccacacacaccaggtctggtgtctctgcatgtgtcctctctgtgtcctctctgcctctgcaagttctgctcatccttcccaccctgtccacggctcagctcctccagcagcctcccggaaacagttatgggaatcacaggacagcagagctacagggagcctcagagatcaggccgggaaaccaagctatggggaggaggaacttgcccaaagttgccctgtaagtcagtggcagaggtataacgagaactgaggtttcctgactcgccatccagtgctctgctgcactgacctcccacttctctgaactctggaggaatggcaatgactataaccccaacttggcattccctgaacacctgtgtaatggcgtcagtgtgccgcattctaacaagaggaaatgctgctgtttcaactctgcatccattcccccactgcctctttccacaaaggagctgaggtggcagatgctgctctatttaaggctcatgcgatgcttcccatgcctgcgacttctccagactacaagcttcagagcacagggaggctgtgttgtcttggctcaagtggctcagcagagacaggcacactgtagagctaatgaggaacttactacgtcagttaaagttatcggtccaaagtcagagtgaaacactttctgagcaggggatcttgcctccatggccagcatctcagagccctcagggacagaacaggacaaggggacagaaggttccaggcgacagaacataaagagcctttccaatactcagagctgcctgaggcagtggtgagcctctcaacactgaaggcatgctagttagccagacagccacctgagggggccctgcactgggcactgacaggtacatggggcaaccagtgaacacaagcatatttgtcagccaaacctttgtgaagggaggcagcagggatcaatatatcagtgaagggctagagcacctattgctcgcataacaacaattaaagaaaaaaacttaaaagtgggaaggaagggagaatggagaaggtagaaatttaagtcgtttaaagaatcttccagacttttcacaatggttcttcaataagtctgccattttaagaaagaacagaaggagatatagttaggaaaaaggcagccagtgttgtaaggtgtggaatgaggatgctgggcagacgctccagagctgtacgagagacagagagagagagagagagagagagagagagagagagagagagagagagagtgtgtgtgtgtgtgtgtgtgtgtgtgtgtgtgtgtgtgcgcgcgcgcgcgcgcatgcgtgtaagtggaaagttgaacctccttcctgtgtgctccaagagtctgcacaaagagcaaatcacctgtcttacagggccctgggccttcctgacccttctttctcccccggggttggaagcccacagacccaaagggctgagtcatagtgtgcggaggtgcctggcccctggcagaaggcaacagggctggcaaagagcccaggctttcacaacggtcgggtgcccgtgtgctccaagtcggggaagtcactagcccaggaatttgcatatgtgagcgagaagcaccctttgctcctgcccctcgtgtatccccaagtgactccagggtacctaagggatctgaacaggttctgtgcctctcacatggtagcaagtgacaggacacaaagagggcagcaggtcaagcccggggtcctgcccgtccactcaccatcgcattggcatggctgctgctctctggtgaattctgctcctcaggagtgaccacttcaaattcagaggaggtgccctgtgcagaaaggaagttaggtgctgcccgagagaaaaacagctcacccctcctctgcggccctgtggctgagagcagcaagggggacaaaatctcttcccattttgagtacacagggaccgttacatatcatctcacatgagatcacaaagcaggattctcgacaagcctgtcatagccctctgcataatgtgaggtcatatcccctcgatggccaatcctcttttgtagaagggagatgtgggactagctgaccttgaaccagcagcactgtaggattgcattttttaaggccgtgtactttttaaatgctttcatgagctccattatttctcagggtgacccatggagtgggtcagaaggttatatcctctttggaaagatgaggaaactacagtatacagttggttaatgcaaaagcagggattgaacccaagactgcagatccagcattcctgccacggccccagagctgtctcttaggcccagacgtctctgatcggtttcccagaacacagatggcagctgttacggccaccaccaagcatgtcctgtgctggccttcccaagccagtcctggagatcccagaggagtgaactgatctgagaaaagtcccagagatgattcaccaaatttggagactatttcaggattcaaccaaatccacggtggccaagaaatcccagattttttcacatctttccgtcattcctagtagaattactggtcattcaaccaaccaagaagccaatggcccacctgaaccagccattagctctgggatctgggatttccatgtcccgttaaacctggtctgcagcctcccttcatcccagaaaggggcaggatagatgagaggagtcagtgctcagcttccagctgaccctcatggccaccaagaactcacctctggctcttggccctgccctagaaagtctccctcctccatctacattttccccattacccgtgtaacctcagaacaggtccttctttccctgcacctgatctgtaggataaggatgctgaactatgcaatcccttgtaggataccaagcaaaacttctccagccaaatctgtagatttttttttttttttatgagagggtctgactctgtcacccaggctggagtgtggtggcatcaacatggctcactgcagccttgacctcctgggctcaagcgacccttctgcctcagccagcctcccaagtagctggaaccacagacatacaccatcacacctgactactttttttcttagagagatggagtctcactatcctgcccaggctggtctcaaactcctgggttcaagcaatcctcctgcctcagcctccccaagtgctgggattataggcatgagccactgcgcccagcctgtagaagatagtttctgagccctctttgagaatgtgagctccatgtcacatctgtctgttttcctagcactgtgcacactcagtgatacttaacagtatacaacttagtaagtgagaagaattccttgtacataccagggtcttcctggtaagttttaactatgaccttcatttcaaaatggggaggctgaggccccagagagtttgcgatggacttgcccaatatcacccagcgagacggaacacagtttcttgacctcaaccctctttcttcatgttcttgtatctgtcagtaggacttgaggtccatccaggcaacctccacccatgactccaaataaaacttacactggatggaggcttctggactggtgctggcttgtcactggggcatgcaggggctgtgggagatgctgtgacatttgagtcctttcctggagaatcaagaaagcacagatgaactgactgggaaggggagaagcccaggtaccaccctctcaaggacagcccttgacaaaagggttctcagacaggattccccactcgagtgtgggagaatgggaggtggtctcatcagggccaggtagtctgagaaaatggcctgccctggagtgacggggcagagcctgagcagagagaccatgctccctgggcttactgggaaaatcccaagttggctgctgctccttgctgccctgaacaggcctcaatgataaagacaatgatttacaatttgaaaagtctttatgtatctattatcccagccattctcataaaagccccatatccccattttaaaggtcaggacactgaggcttgggaaggtcatcaacttgcccacagccacatagccagcaactgcaaactcaggactgagacttggccctccctccctgacttcctgcagtccttgctgcagggagctccttgaaggtagcttcatttctcactctgagagtggacctggcaccaatcaggaactcaggaacattgctgaatagacaagcagaggctggaaatgcccactgactgcagcacagtggactctgagaccatcactttcctccatttgtccattcagcaaatgcaaccaccagccaatagaaggctgtcacattggcctgggccagataccatacagtagagctgcagcaggaggcatctgagtccagctgaggtgcggatcatttccatcctggtcccagaccttaccctggacttggagacatgccagagtaatgcacactctgtacgcatggtgatgcctctaccatacatgggacttcaaccccgagccacagtcaccctgtcctttaatgggcagcacacgtaaccttacatctgaaatacgctgcagcaggctaacaggcaagcccagcttcttccctgggcctcagcttccctaattgtaaaatggacgcgcagggcacgaccagggagcttccaactcatatgccagctccaagtgacagggagtagctgcttggagtgcgatgcctggcacacagtagctgctcattaaatattaaatatgctgataaagaccccaaggccacaggactgcaatgtagtcaactgttgtatctattactcatgtctgctggggcctcaggagtgctgagtcactggctatttttaacaagattgttttgaagtcccttccaaatctgaccttctgggggatgtggcagccaaaacatgaatggaagggtagcctgtgacctaaggataaacgagagaatgtgggttttggcataagaagggagttcactgtgaaggatttgggcagtttggggtacagggagagtcagaggtacccagactcctcttatacctgtgagctcagccagggggtcgaaggagcccaaggagggagaaggtggtgggagcagctcgttgtccttcactagctcctctgccttctgccggagcctggtcgcttccatctgggactcttccaaaagctcccctagagttattggggaagaggaagcaaaagcatttactcggctcagtgtgctgcttctccccgtcccaggcccctaaccgtgctgccgcctggcttctgaggctccaggccctggacttcactcccaccgttgctctgtgggccaagtgggacaaactccatgctggtccaccataagaaacaggctagagcaaggacgagggcccagcaatcgggggacacaggagcggaaggaatctatgagaaactcctcggctcccccaacccccagcattctctttctgccccactcccttcacacccagccagggcactccacagaaagccaggggctcccccaccctacgggctacccacagcctgagccaccagggcaaagggctgcctgcagggcggagaccttggataattccaaccagccctctaggcctccattttccttctcctacaagtggagatggggaaaccactcctccctccccagtcggccatcccaagcaaggatctgccaagcaaggagaaagcattttaaaaatcagggggctatgctcccctctaaaacatgagactagagaagggcacggcaaggcaaaggaagagtttcaggagtgtggaagaaagagagccccctctggatggggaaatcaatgaaagccttgtctggaggagaagggggcacagcaactgggtgctgatgcacagggcccgtcggtcgtgtggagggaggtggggttgttctaaagtggggatggcttgagcaagagccaggagaagagaactgagggacctaccacctccttgcttcaagccaagctctgctccctgctccaacacctaggaacgcgtgccccagttgcctggtcatgctggctctccccatctctcgtgccccagaaagaggagaccactctagttccatggccattaactgggccttccagccccctttcccttagcccacgcctccctcttggacctgagtcctgtcatcctggtttccgggtgctgaggaatcagggttgggaatactgtcaccatgctacatggtgcatagagacagctgtgaggcaggagccagcgctgggccaggagggacaggggatgacttgggcagaggcatatgccagcttcattctccactgctagtagagggactggcatcacagtctgcagggaggggcgctcgcagggaggggacagggtctgctttacctaacatctttatcccttgcattttttccttcagccgggaattctccttcactaggcgctcaaaagctgcggatgcctctcctgagggcacgctgcccccagggtcgtagatccggtacggtcctctcccttccatgagggtagctcagcccctgccgtggtgcccgcctggctgtaaggacaacagcagcatatcagcaggctggccaggccatgggggcatcctttgcagagaagctctagtctgtcaatgccccagaaggcagtcccccactttaagctggtctgaccatattatagtaaagcaggacagtcacctccttttatctggacgctctgcctctattaatacaaccttagaatggcattagtttctcttagcagcctcaatgcactgttggcttgtttggaacaggagtccaaataaacagtagggtgcaatgtgggatacaagaaagaacctggacttggaaaaaaaaaaatctgagttcatgtcctgtctgtgaggtccagaagaacaggaatcccatatgttttacccatcattgcatcctcagagcctaccacagtattagctatgaattttgcccaataaacacttactcaattaatggtctaggcattaatttactatgggattatgggcagtcccttcccctctctgagggagggaaatgaaagtcttaagttaatttagtaatctttaaagtgaaatgcttgtaccctaagggataagcaagtcaacccagtccaaagttccatttatatgtgtatcatcttctttaaaaaaagaaaagaaaaaaacaccctgactaatatttaatacactgtcaccctcctccgtgagtctcatatcatatatggtctgtcccttgcagttctaaggaacagaagaatttttcatcaaaccactgtctatttgagcaccaaggtttttttttagtaatctgttcagtttcatctgctttatgtcactgaaaccagttggaaaggtgattttagaatcctaactctgtggcttagtagagaagctctctgtccattcactcatccattcaacaattacttattgagcatcgactccgtgctaggcaccagtctgggtgctgaggaattatcagcaaataaaacagacaaaaatccttcatggagcttatagtctaggggtgaaagcagaggaggatggtggggaacacaatatttcaggtaatcaaaaagtctatgcacaaaaggccccaagcataaggagctattttagccaagacctgaaagaggtgagggaactagccatgaagacatctgaaggaagaacattctttgcagagagaacagtaagggcagaggccctaaggctgaaacaccgagccagcctccagccctccaaatagctctccagcatgaaagggccaaggccttcactggggacctcagaagggtttgggggctcggcaccttcctcccaaggtcaccacccccaagacaaaaactgtttcatcaggaatcctcaaagaccctcccaagtccacacaccatgctccgtgggtccttggcgctgccaggtgactacgaccataccaccctgctcccagaatgtaaatgaaagatcagagtgagaaaggattaacagcaacaccaccatgcttgaatcgcctccttgtcaggcactgcattaaatgtttcagatatacaatcttggaggagctgcacagtaactctaacatgcatactaatctcatctgcattttacaagggagaaactgaggctcagggcggttaagtaactcagccacgatgacccggccgcaataagagccaagatgcaaagtcagccctgcctgctgtgactctgacccccaccatactcacacagccaggacacagagccagaggggcagacagggagttcaaatctctttgtagggcagcaccatgctatcaggtcacctctgggcagtttcccttgccctgcagcataagaaccaataaggacttgtccaagagcgtccataggatggaatgggccagaaagaaaaacaaagttctgatgagaaggaccccttctcccaaagactgacagatacaagatgaatacaccgtgtgggaggcacccacgccctgctgagcctgcgaggcaaaggacagctacccacactcccatcacaagtcatcacccggcttaggggtgacttgtttttaacctgaaaggtcagtgttctacagcatagcacaaagtgcagatgtttccaccgaactaagaaacagtgtgggggctgcacttagcactggaactggcacatagtaaagtactcaaaaatgttggcagacattgggggtccttcccctctgcttgcctctgtcctcacgaggcttgccacctggtacagcatgtgtctgactggtgcgggcattgcccatctggctgggaacttcctgaggcaggagcgtactttgcacatctttgtattcctgtcgggagcacaggagggtgggccttccttgagagctgcttggagttcaagaacagtgaaacagagggctacaaggggcctggagccaccttgcatgacaaaggcagcagtgtcctggttcttgtccaccattatgcattcaccctaaatggaactcacagtcaacaccacatgaaggcatggggaatttcttactcaatgtctgccttgtcctgtagattagaggctgcatgaggacagggagcaagtccatcctgtgtgccagggtatcttcagagtggcccagagtagggcctcggtaaaccttgaattcagagaagtcagactgaagggaacaagcccttgaccccgaccccgcctcctgcaaggccatgtccaacatcccagagaaagcctaaccctgacccactgaccagacgcacttggacgcccagacacttctagaatccaggctgggccagccatgctccctcagagaggcccagatgtaaggcgaagggacaaagcaggatgcaggatgtgggaactgaaacccaccccacgtcctccaaaacacgcaacactcagtttctcttggcgctggggagtcaacgggaaaggggttcatgggaaacaaaaagtgggcagacagagctatgctcccctactttagcctcagggggcagagcttggggagaaagaaaggcagtgggcagaggagacgcaggagaaatatcctattgtgggaaaaccctctctggagatcagaggagccacccctggagggcctggacttctggaggaaagaaagacaaagagggaaacagggaatttccaagttctgctgacctcatgcccagatggtcagcggcagtccctggatgaccactgggcagacgggaactctccctctgatcaatgaggtttttataacttctcccagagagaggactcattctcaggatgacagagctggaggggactctccaagggcaatgaggcgaatcctgcattatcaggtgggagagagatgcacccagaaacactcaatggatgaggggctgcattcgaacatgacgatggcatgcactcccctctgctgtccacaaaccacgaggatgttttcaaaggggaaaaggaagcactgaccactcccctccatgtggcagtatctggagttcagagcccaggagtcctcgggcatgagctcatctgattctcactcacggcacaggcagtgcagcaaggcaaggccctgagcagggaaggccaaggtcacaaaggagtcaggatggagctgggaccagaagatccctgctctccctccaggctgcccacagcccatcctccatttcccttcctgcccagcaatcccatggcacaccacaggcccccaccacatcttctcagagtctctttccacctggcctggttccacaaactacaaatcagcaggtgctccaccagcagtgggactccagccccgcttgcccaaaccagaaacagctggtggtatagaagcagccagcgcagactttcttccaaaacaagacctcagccagcggggcctccacagcctgccccagaggggccctggggctgcccgctggaaccagaaaggcccagtttgggggcagaaaggggcccagacagacggcaggtcaggcaacaaccacagaccgtgaagatggaagtgatgctgctgaaaccgaaggagccacccactagcaggcaagcacttgtgggtggcagggaggcagtagtccccagggctcaactctcagccttaccccagaaagagaggggtatgataaagactacattcagaattaaatttacattctagcttttgctctgaaatgctttggtctgtcagattatcttcccattagcagtgttctggtggctgggtaggggggtggtcccagaccccccaaatgatattcacttgcatagccactaacatttgcaaaatacttcatagtgtcccaagcattgtttttccatctgattatcacaacagccctgggaagaaggcagggctgatacctgcctgatggataaggaaactgaagtccagcttggggacttaatcagcccaatttaatgcctttggtcactggctgcatcctggggccagctatccctgcaaccctggagcaggtgatgccctccctggcccagagggaaaagtgtaagcaaatctctggtacagggaggtggaaggtcatcgaggccaacatctacctccccagcagaggtgagggctgccagggatgctggcaggtgggctggcagagggggtatagggaaggggtctccaggaaagacggcacagaacagaacgtcagagaggtctattctagtgtctactctgctgtgtatggaaccatgggctcattccctcacatgcaaggggaggagcatgggccacacagaaaccgggtgatggctaaagctggcctcaggatcaagaagacccaagtctcaggagctagcagcaagctgaggaaagagagagagccagcaccatggaaacatcgctgccttggaggcaggaagaaaggtccacacagggaaagtgctcaaggccaaccttgcgaacacgaggcctgagagggggcctcacctgcactagcctcagctctgtccaccctgtgggctgtgaaaccctggagcagccactcacctttcctgagcctcaggtgcctcatctgtaaagcaggagtaataatagaacctacctgatagaagatcaaagaaattaaatgaaacaatatgtgtatagttggaagggaattctcactttctactttaggcaatacttcctgattatctgatttaacaagaaacacatctttgttttataataagatttccaaaataataagagtatacagtaactagctcagcatttgacacacagcaggtgcttaataaaaggctgaggcaaccccacaactgtgcccagcttatctaagggccaaggctttccccatttgttctctcctttaatgggattttaggctcttccgtcagctcagtaagctaggttctggcctccacttattctctagtgacctgcatatcaccatttaactgtggttaagcagggtgcctggacacaccatagctagtgaacatgtagctataagaagcccttgaaccacgatgccacactcaccaacaactgggaatctgagcctcatttcctctgctgtaaagggcaatatcctgcaattccacccaaggatgaaaggaagtgagatgccatgatatcacattgcagacataaacaaaaaactgtccacatatttgtgttatgatgacctccagtcctccccaaccaatttccaggctggggaaactgcagcctcaggtccatccatcaaaggccgggttggatttttcaggcagtgaaactactctgttcaatactgtaatggtggacacctgccattccacatttgtccaaacccatagaacatacaccaccaagagggaacactgatgtaaaccatggactccgggtgacagtggtgtcaatgtagattcatcaactgtaaaaaatctaccactctggtggaggatgttgataatgggggaagctatgcctgttaggggtggggggggcgcagtatatgtaaaatctctgtaccttcttctcaattttgctgtgaacctaaaactgctctataaaaaataaggtctttaatttaaaagagaaaaggaccaggctgggctctcctgatggctgtcaggttcacacatgagtgaggacacagcacatacttgagacagtgtgtattcaaggaccgcaccctggcatcctcaccaacaaggagcccagacttaactcctccatccttgcaatcaactgagcaacaatgaggctgcagacacagagtctcatatagtaacagctggggcgccagaactgtgggatctagtcaaggtacactagggcgaacatcttaaccctcactaggcctcagttacctaaaaagagggagctgcaaaaatagtaataacatggggggttgtgcgggataatcattaaggccccttccagttctaacatttcaggatctgaaatttattagcactactttctttaaccttctaaccttaagaaggctccaatccccagctccaatcccttctaaggcccaggtggatttccctaacccatcagtcctcccataagagctttcataggtgctatcccctccccgagggcagtcagagaccctcagctgacatccgcagccctgtgccaggtcctcccctcctgcctaacttgtaccaggctctggccaagcctgatctgtgttcctcaacatggcacacatcttcccatgtccttcatcctcccctcccgagtcacccacaaagaaggccccactgtctccactcagcctccgaggcccagattacacaccacccgctaaacacctgagccagaattcacactgcaaaagaggactggagagcacctaactaagctggagagagggtgacagttcgttaggcgctaccgtatgccaggtgctgggccgcatcatgacgcacatgacctcattttcttcttgccacacagatatggaaattatcatccacactttccagcaaggaaaccagtcgacgcagctacatggatgaggaagcagactcagagaagttaagtcatttgcctgagaatacacagctggttagtggtagaacaaataatgcagcctcaatctgtcagattccaacatcagtgccctttccactgctctacactgcctggagaggcggcaggctgaagctcagaggtgggaaaccagacctactttccagttctccagaacgtgccccaagttcctagcccctgcctttatatgtctctagctttatatgcaaccaggtggcaatctgccccacatcacctgcagtcaacagggtttagaatctcaggctggaagggagctcagaggacattccatcctgtgcttacccagtcctctgaggagcccagggactccagctggccaactttagcaatccagatctcaccaacttcctccccaaaacaattcctggggcagccagcactggctacagttaggctgctcccagttctgtttccactggcccttctctcccctctgtggtcccctggaataaggaacaagatgcccatcttcagcatgacagccagccctgaggacatttggaacctgcagccttctctatactgttccacatagggactgccccccctccagtcccccaccaaccctctaccccacactatctctagttggttctagcactggacccaacattccaggcatggtttgcctgaccaaatgcaggctttcacctccacccttttaggtagtatattcctattgagggagcctgggtatacatttgcttttcttacagctgagtcacctactgaagaatgtcctttctcaatgacaacaacctgcatgtatgcctaactggtgagaacaaagttctcatgtagaaacgtgtgcttgagggctgggtgcggtggctcatgcctgtaattccagcactttgggaggccgaggtgggcggatcacctgaggtcaggagttcgagatcagcctggccaacatggcaaaacccagtctctactaaaaatacaaaaattagccaggtgtggtggcgggtgcctgtagtcccagctactggggaggctgaggtaggagaatcgcttgaacttgggaggtggagattgcagtaagccgagatcacgccacagcactccagcctgggagacagagtgggactccatctcaaaagaaaaaaaaaaaaaaaaaggggtgtttgaggaggtgtgagttacctaagggggcagaagtaactgattgattcagtaataccctatctaggaatctagagatctttgcatcagtacacagaagctggacaaaaatatgcactgccacatgctttgtaatagacatttttgctattcttgaatgtccatcaagaagggactggttaaacaaaccaccattcattcgatggaatactatacagccatcaaaaagaatggggtagattgcttggcaatgatacagaaagatgcccataaaatacaaagcaaagtgcagatttatatgtgtaacaggatgctatttttttcaaaaacacattgtgtgtgtgtgtgtatacatacggaatcttaaatgtgcatagaaaaaggcctggaagcccagtgctttgggaggccaaggtgggaggattgcttgaggccaggggttcaagaccagcctgggcaaaaagcaagaatagattctctattaaaaaaaaacttttttacattagcagagcatggtggcacatgcctggagtcccagctactcggaaagttgaggtgggaggatcacttgagcccagcagttcaggctacagtgagctatgatcatgccactgaactccagcctgagtgacagactaatactctgtctcttaaaaaaaagaaaagaagaaaagaaaaaagtctcaaaggatacataccaaactgctactagtagactgctctacagaaggacctcggtaaggaactaaaaccaaaagaaacttttattttacctatgctattttaactctttacatgggaaatctagtcctgttcttatacaattataaaattagtttttaaatacagtagggacagaggaaggggaaaggaaggagagagaagacaactgtcattttttacattatatcttttgtactgcttgagttttggggggtttttccccaataatcatgtgctatttggtaattttttttaaagggaaattttaaaatatttttctaaaaaatttaagtgagctgagtgcagtggtgcatgcctgtagtcccagctactccagagacagacgcaggaggatggcctgaaaccagagtttatctaaccctgtaactcccctgcctccaagaggtaagatgccaattttggggaattcctcttatacaaaatatggtggaaagagggtttcacagattcaaatcctggctatgatcccttctcgaatgaccctgggtaggcctcactttccttgtttctccctatggaaatgttatgaggaccaagtaggaaccatagagttctctgtaaaccttaaaatgctacccagacaggagcagtaatggctgccaaggagctaggaaggaaaaggggctggacaggggctgaggtactcagatgaaagccaaagatgccttgtgttaacaacaaaaagctgaaagctacctaaaatgaagagaaaaatgaataaatacattgtggcaatttcctatcaggaaatactatacagcagtgaaaaaagaatgagccacagctggagatacgaacatgaatgaatctgggtctcactctgttgcccaggctggagtgcagtggcatgatctcagttcactgcaacttccacctcccagcccaagtcatcctcccaccttagcctctcaagtagctggaactacaggcatgcgccaccacacccagctaatttttgtattgtttgcagagatgggttttggccatgttgcccaagctggtctcaaactcctgggctcaagagatccacctgcctgctctgcctcccaaagtgccagtaaggcatgagtcaccacgctcagcctaaataacatttttaaacataaaaaaatactatgtattatttagggatgcacacattaaaaaaaaaactttaaagaaatgcaagaaaaaaaccccactaaattcagaacacttgtttcttgttggtggctgatgaaggagaaatttcaactgattggaaatgtgttatttcttaaaccagatgagtgagcatgtaggtgcctgcgtgttaccctcggtatctgagagactccttcaatttttcttttttctttttactgtattgtttgctttttttctgcttcaacttttattttagattcggggggtacatgtgcaggtttgctacctgggtatactgcgtgatttgggtaggggtgatcccatcacctgggtactgagcatagttcccaacagtttttcaactctgcctccctccctccccactctagcagtccccagtgtctactgttgccatctttatgtccatgaggacctgatatttagctccacttataagtgagaaaatgcagcatttggttttctgttcctgtgttaatgtgcttaggacaatattttctaaaagtctatgttgccagtttcctgaggaccagatcacgcaggagttgcacctgcagagacagaagtgggctggagagggaccagggctcctaagtctgctgctgaagctgactatagcgaaggcaaaggacaagtggcctgaaggccaacagagagcctggccaatgctctgcccagtgggtggagactgagccaaaggcccttgactcatagggcagtcccatacctgccctggcctctcagcatgactccttggtgacacaactcccacagcacccacacacctacacccacctaccccacacacacacccctgcctgggctgcccggtttgtccactgtgtaggtgctcaaggacgcagagctcctgcctctcaaggaacagcctcagggtgaggtccctgggagagaagagttcagctctgcccagagcagccctcagacaaacagccagctgctgctcaccagtcatccattccaatctgaagagtgactgtcctgggccagtcatgggaaaatcatcaagaacttcccacaatggtcatggtggccgccaaggtctttctctgggggttgggagctgtgctcccccacaaaacaaggggacccagctgccctgtgccttcctgtggcaactctctggaggatgcctggataccctccctacagacggccagggataggaggggcaggcactgcaggcatgtgggggcatagcagcaagaatctaggagggcaggcacagcaaggcctggcccagagggaaaccaggagctgccagagccaaagagagggtgacccaatcattggttgttatagagtttttaagacttggaagagaatgccctgagatgccagagagtgaaacattttcattctaaagctgggaaaccaaagtcggcaaaggcgaacagacgtgcccacagccacatgggacagcagtggcacagaagaaatgcacacctcgtcctctggtggccactgtgcactctcttaccacaccatgctactgctcaacctctccccctccctcacagtggtcaggtaagcaatgagggaaaatgatggaggtgagaaaggaagaacccgggctgatgtgggcccacaaaagaaagaagtctggaataacactggaaggggctgcctacgaggtggaaagcgccctgatcccaggggtcggggtcacgcagaggggcactggggctgttgagggaatgcaagccaggtgtcttcaaagccccacccacatctgagtttccgccactccaaacagggacagatgtttgagacaaagcaaaggacaactcatccagaggggacacagcatggaccacaagtggcagagggttgaaggcaagtgtcttagtctgctttctgcaactattctgttgaatatcacagactgggtaatttataaagaacaagtttatttggctcatggttctggatgatgagaaatccaagtgcatgacaccaccatctgacaagggtcatgccaaggtggaagacagaaggagaaaatgagtgattgaaatagagagtgtattagccaaactggccccttttataactaacctcccgtccccctaccccgtgatagtgacattaatctatttatgagggcagagctgacaatccattcatgaagcagagggattacgtttccaagatatgaacttttgggggacacattcaaaccttagcagcaagttatccagagcacagaaaatcaaaccagtctcatcatcttctactggaatcctgtcaatagcctcatgattagcatcattaacgataatagcagcgaccctgtaccaagcgcttaccacactggtggcccgtgctgagtgcttgccacacactatcccattaattcccaccattctaggaggtagcattgacgtcatacagagctgacaggtgaggatgcagaggcccagagtgacagacacggcacctacccaggtctgccaagcactgaatcatgtgctcttcaccaggggtgctcaaggagcagcccggaccagcggcactggcaccaccaccatccactggatcggatgctctggagttgcagcccagcaatctgtgtttaacaaccaccctctacctccatccccaggattgtgatgcatgctcatgtttgtgaaccaactgctctgaccatttcccaatgctgctaaggagaaaaatcaacatttctatgtctggtatcaaaatcttttagggtctttcccaggccaactggtcaattctcccaaccgaggagaggctgattccagttattgtgactagtctactaagttccagaagagacccaggttccactctgcactttgtcatttttttagggtctgaccttgaagtcacttccctccagaagacccctccaaccatctggtgcccccaaattactctgcactccagttatacctatgccaatccgactcatttggcacttactggcacacaatgcctttcaggtcacactcatagcacatctccccatttgaccaaaagttcctggaaggcaaagccagctccttacgcacctgtgcatcaagaacactgcatggcactgggcacaggagtcatcaggaaatgatgcttgggagagcgctaggagagcactctggttctcctcctgccttctcatctctaggccttaatttcctcatttgtgaaatgtgccattattctactcattcactgaacaaactcagaagagccatccaccaggcactcttctcccgctacagaaatacactcgagaggactaaggaggtccctgctcacccccttctattctaggaaaagagaaagacagtaaacaaataaacactaaaaataacaatttgccagacactaagttctatacatatgctttctcattcgcaaataagattctttcatagcatgatacacgtatgagaaaaataaaatagtaacgtgacagaaagtgaaaaaaggggctgctttgcataaaaagatcagggaaggcccctctgaggagctgacatttgagctgagacttgatcgataaggaaaaaccagccatgggaaaaacggggaaagatgtcctgggcagagggaacagcatgtatgaaagcctaaggatgagaacaagcttggcttgctggagggggaaaagcaggccagcatggtgtgaccaaatcacagcgggtacaggagtaaaacagtaaccagtgggttggagagagaggcagacaaacaacctcctacaacgctgcctctctcaaatcaggtcggcctgacccaaccaggacatccgggccccaagtcacaggcagcactgggggtaagggtatgactcagaccccacagcttcctggggccccgaaaaaactggtgggggtatccaggggcaggcatcaaccttcagcatgagtgccatgccatacccatggaacacccaaggctgggagacaaacgtggttacataagcgtgtagaacactgcacactcccagcggcagcttccagaggggcatgatcacgtgcttccatgaagtgccagtccctgatcacattattttcccgggacacagccaggacagcagccttggtcaggggaaagggaacagggtccaggattcaagcgttgctagtcttgggaaagccttaaccttctctgggcctcagtttcctcatctgaaaattaagagttgttagaaagattaagtgaggccgggcggggcggctcacacctgtgatcccagcactttaggaggctgagacgggcggatcacttgaggtcaggagtttgagaccagcctggccaacatggtgaaactgtctctactcaaaatacaaaaaaattagccggggatggtggcgagtgcctgtaatcccagctactcgggaggctgaggtaggagaatcgcttgaacctgggaggcaagttgccgtgagccgagatcgtgccactgcactccagcctgggtaacagagtgagactctgtctcaaaaaaaaaaaaaagattaaatgagatacggaatgtaagcactgtgcctggcacatagtaagctattagcattatcagttttttcactgcctcagtttcttctgttgcaaaacagagaccaccacggggatgctgagtttgtactaatattctaccctcctaatacaattctaccctcctttgtcaaggatttttttaaaacattctgagtccccttttctgacctctcatcagatgccgaattcccctctatcacaccccattgtttggaaaatgagtaagtgctgattaaatcccattttgaccgtactgtgagaaaaaaatgatgcattaggaatctacacatttccctgcactgtcattctgcaagggggtggggaaggacgttgctgattcttctgcatcatccacaaaagtccctccctccccctaccaaaacacaatctctcacccagtcgcacaaaattcccatctgctcctgtacgcacaatgaatgtacaatgcacacgtgcacacaaatgtcctacagtggaaagctcagccttcatactccatccccagaagcactcctggaaactcatccatcctgcacatgcacacaaatgcctccaacaatgtgcatacaaaatatgttcaacagaaatagtatagtaggaactctggagccaaatgcctgagttcatatctgactttgcaactcacagctgtgtgacctcaagctccaagtacctcggtttcctaaagtataaaatggagataataacaatattaatgtttaggatggaagtgacaattaaatgagtctaatacacgtacagcgttaagatcagcacttggaaagcgcccaataaaaattattattttcctcctcgtgacatatgtacactgcttccacaacttgatacgaaaactcctgacgccgcgtaggcaactcgtctccacaggatagacacccaaagggccgcagcgccgcccgcacccggagggtctgcgctctctacaaccgccccacgccgttcccaggcgtgctaccccgcgcagtgcgcacgcgcgccccccaccaggcccagcgccaagcagggagtagcggctcagcccggcttggccgctggcggagacgccccgggaccccgcgcgccgggcctgggtgcacaagccaccttccccagctcgctccccgccgccaccgaggctctggacgatctgggcctggcctcccttcctcccctccatccccgctccgggccggccggcttacccgaggacggggagcttggggacacagcgccccgcttgctgcgtccagccccgaatccagggacggggcagcggcccgggcaaggctccggccccccgtagcactcctagggctcctggacgggggcagggcacccgggccgaggacgaggaagtgccgggggcctggccgggccgccccacccctgggaaagtccccggagact

SEQ ID NO: 2820 - DNA, 51142 bp, Homo sapiens; identical to SEQ ID NO: 2819
  source 1..51142: mol_type = genomic DNA

SEQ ID NO: 2821 - DNA, 57718 bp, Homo sapiens
  source 1..57718: mol_type = genomic DNA
tgttgatcttcttcaacttggatttatgtccatgattcgtgcaaatagctatccagggatggacagccaccctaatctgggcttctggcaccacaggcctccagctatggggtccagggtctgaacctcagggcctggcagcttcaggctggcgcccctcggcggacgtggctggcatggccttctcccatctgtgatggcttcagcaaggctactgtgagtggtggtggagagggccccagagccagaatatccatcattctcttctgttctggagacaaacccacacttcccacagctcctcacagaggggtaggggtgtgcgtggggcaggtcctgctacagagcttgaagcaaaaattaaacacacacacaaattggtcatggcaactagagggcctgaaaccacttccgggaggttttgaaggaagggggtcttggctgcctcccactcttaggattgctgctcctggaggcttctgcaacggatggtgggtcaaagccggatgaggcctctctccactcagcagcagggaaggagtttttcccagtcactcccagcagagtacaaatgaaagccttctgggtggagcctccccagtcctgtaaacagctcagttcagggactggtgtacaagctggccacccatctcagcctctcatccagctgaggctctggccacaccgtgcaagtggcttctagtttcttggcaatctgagatcagctggctctgcaagatgaaggtggagccaaatgacacaatctggtctcactgaggcccctcacggtcattttttggagactctaaataaacaaaaattttgaggacttcatgattatgtggtagagcgagtttcaaagtctcttatggaatgcagtgcaggaacagtgaaaataacagctagggttactgggtgctaccaagtgccagggctaagtaccttaagtacgctggtcatgtaatcttcacccagccctatgaagaaggcaggttattatcccattgtaaaagagggaactgggacactaagaggttttaaatgacttgctcatagttccaggtccaggaaatagtggggctaggatttgaacccaatctcaaatcctggagcagttctggggagggagcccctcccattataccaatctctaccactcatcaaagcagcctccaaggggctccactgaacttgtagggttcttcagggaaaaacagaaaatgactgagcagcccaatcccttcttccaatcaccaaatcctccaaactgcaacccctccaaggtgtccgtcccatggcctctactcacacacctgcaaagggacactcgccacctcccagagctggctccatttctgcacaactgtgtcccttagaaagaaagttcctcttcatgttgcgatggacttggcctccctgtcattcccacccactagttataattctgttcccagaagtcccacaggcgaggtggtgccttgtgccccatgagagctctacagggagcaatggcagtcgctaaggtcccaatcttttcacgagtggacacagctccaggctcttcagcctttcatggtggacaccatggtcaggggagcttttcaaacagaaatatggtcatgccactctgctttaaaaatgtccagtgactacacattatgctgaggataagacccaggcctcccaccatgctccgcaggcctgcacggtcaggacccggctacgtcctgaaccctgcgttgcccctctctttccctaccttgttcttggctccagccacgctggtcttccctccgatcctcaaatcagctcccctacttcccctcctcccaccacggcctctgcatttgtcatgttctctgcaaaagcatcctccacccctacctctccacctagctagtgtcactcattctgagagtctcaactcaaatgctgcccccccggtctaggtcggcttcctctgctatctgctcccacagaaaccggctcttcttcctttagggcacttgagtgcagcctgtttgtgtggtgtttgtttattcatttctgcctccctcattagacattacgctgtataagggcaaggactgtatctgcttctgttctctaggcatccatagcacctagcacaatgcctggcattagataatgcactagaatgaatggtttcagcccccctcactctgtggttgccattactctccattcaacactgttttggaaagctgggcctctcctccaccaagagcagaaactaacgacatcacccccaaactcaggcaatgctggcagataagatattatctcccccagggaggaccaagactcagtattaggggctcacctggttctgtaggcctggctgtgggagggtccatcacttgggagctctgatttggatttcgaacccctccacagggtagacgccaggtgtattccggctgcgacaaaactggtgcttaataatcaataatcacacccaaaaattacaatagcacctactgtgccaggacaatactaaatctgtattagtcaagtataattgaatctttataacaacccaggctggcactcccatttcacaggtaaggaatctgaggctcagaggggataacttgctgaaggtcatctagcaaggagaatggctaagcttggatttgaatccaggtctttgtaaatccagagccaatctcttaagcgccatactatatactctggtgtttaaagatgtgtaccaagaagggtcatatgggagaagctgaaaaagaggccagccaggaggtttctgtaatggtccaggggagagctgggatgcctaaggtggggctgtggcagaggactggggaaaatgggacaagtgacagcagatctttggaagaagaatgataagaagggaaaagaggccaggcgcagtggctcacgcctgtaatcctagcactttgggaggccaaggcgggtggatcacctgaggtcaggagttcaagaccagcctggccaatatggagaaaccccgtctctaccaaaaatacaaaaaattaccgggcgtggtggtgcatgcctgtaatcccagctacttgggaggctaaggcaggagaatagcttgaacctgggaggcagaggttgcaatgagccgagatcgtatcactgcactccagcatgggcaaaaaagagtgaaattccatctcaaaaaaaaaaaaaaaaaaggaaaagaaaataaaaaaagagaggagagaagaagaggaggggaggggagaggagcggaggggaggggaggggagaggaaaggaaaggaaagagagagaaacatggtgaggctctggaacctagttacacgtggaagttataagaaaaagcaaacccaaactctgatacccatggcctggggcctggagggagtcctccttcccaccctgcactcttactcagccttctccgtcctagaccagtgaccctgaacagctgtggggcagccctgcgggactgtggccagatccctgcccctgggtagcagcccagagccaggccctggacacccacctgccaccacggtgctgtttagttcagaaggatgcagtttctgaacccctcacttaaccttcctctctggaaggtgtctggggcagcctctgtgtgtgccctggagcaagggagggacacagactcaccagatggaagaggcgcgagttggggagtgggggcgggtgctccatggccatggggggaggggggtagcggatctgggaccagtcctcgaagccatggtgtggcaccatggctggcatgggcgggtaggcgtaggggtaggccccgcagagatgttctgggtggggctccacatggtaacgctctcctgaggcctgcaagaaaggctgacgtctggctttggcctgcaacaggctgcaaaggacacccatctcatcaccctctaaatagaatgttagctctctgaaggctagcaggctgggtaccaaaggctggtatgtggtcatgaaaggctgctacatgggtacagaaatctggatacatgggcatagaaggctggatatatgagcatggaaggctgcatgggcatggaaggctgggtacacatgcatggaaggttgtgacatgggcacagaaggctggtacatgggcacggaaggctggtacatgggcatggaaggctagtacatgggcacggaaggctggtacatgggcacggaaggctggtacatgggcacagaaggctagtacatgggcatggaaagctggtacatgggcatggaaggctggtacatggacacggaaggctggtacatgggcacggaaagctagtacatgggcacagaaggctgctacatgggcagtgaaggctggtacatgggcacagaaggctaggtacatgggcagtgaaggctggtacatagacacggaaggctggtacatgggcacggaaggctagaacatgggcacagaaggctggtacatgggcacggaaggctgggtacatgggcacggaaggctgggcacatgggcatggaaggctgggcacatgggcacagaaggctcatacatgggcacggaaggctgggtaaatggacacagaaggctgggcacatgggcacggaaggctgatacatggaaacggaaggctgagcacatgggcatggaaggctggtacatggacacggaaggctggtacatgggcatggaaggctgggcatgggcacaaaaggctgggcatgggcacaaaaggctggtacatgggcacggagggctggaacatgggcatagaaagttggatacatgggcacggaaggctcatacacggccaaagaaggctagtcacatgggcacggaaggttgctacctggacacagaatgtcaacagtgatgacagctaatacattgtgggcactgcctctgtaccaatactgctctaaggcttttcctgtattactcatcagttagttagcagaggatgtccccacgcccgagcacacactgtgcatccatcaggctagctccatgaggaaggtaagaggatgtcagtgctgctacctccctcaagcctcctcacctttgctttcctcttctgctgtctgagggcttctcttgccttctcctcatctttgaatgcttttagctgagagaagaagggagggagaaaagactgtcggcacaggtggtttctggccaggcctggatccagggcctaaccagccacgaggactgaccggctgatgcttccctctgggccaccatgcgtgggccagccccgggaaagggccctgagggcggagcacagcccaggctgttgctgcaggccacctgcttgtcacagtggtctgtgcacaggtcaagagggttcacgtgaacctcgctgcttctctgctaacatcttttagttccactctgggagagtaaagcccagaactgactgtggaaagtcagaggtagagatatcttagagtaaaactcgtaattgtacaaagaaagagtcagagaggggaagggccttgccgagctcaaatatgattgcagagctggagagaagcagtgagggtcctgacatccagcctcaccagggccctccaatccatgccccctctccccacgaggacaggccagttgcccttcctgggtccagtcactcttacctgggcatttgacagggtgacctgggcctgcagcttctccacttgcttcttcagctcttccttctcctcattcatgcgctcacgatcactgcgctccctctggaagtcctcctcgaagatcttcacctggtgtggagggagggtgaagagagggagggggatggtcctgagtggggatttctcctcaggcccagactcccatgcctcctgctggggtcacagatggcagagctgggggtcgccatggggagtgggacagctacacctccagcctccaccttaacttcaaacagagtagttctgtgtccctctatcttacattctgggcttcaagctaggactttatttgaacaaaggatatatggttttaaaaaaacgttgaaagccatcaaccagtgcaatcctttcactccgctgagacccacaggggcagtgatcacagaaccagagtgtggtgtagaccagagtttggatctgctggttctgagggcagagaccctacaaactccgctagggctccagggtgccctggcagaggtgggttgggtggggcctgcctctgtctcttagcctgtagtttcacatccttagtgcagatcagctgagacactggctaggttcaaggcagtttaggaggattaaatagcacagagacaatgggagagccacaaccttttcgctttctttcaccccaatccttctgtgtccctcagggctagtaggtctttaataccattttagtacctgccaatctcctttaaataaaggagaaaagaactccagttcagagtcttcatttggcaagagtatccggctagagtttaataacattgttctgtttttattgtttattgcgtacagttactttctacttgtgacaaataataaatggttttttccaattacagcagtgatataaagctcccttttaaattcatttatttagaatttattttttaaatactaggtaaataatagcacgtgtggggcatagagatggctaaatcataaaggtggtagaggaacgacttaagctagggttatggtgctggaaaggataaacctagagccagtggggggccctggccaatggccagaaagtggattactaattacaggttccatgtgattccaagccgtctgggccctcaggaaagctccagctcccacagagcacctcccacctgatttcctcccggaagcctcacctgctgtttcagcaactcattctgcgtgaccagctcctgtttccttaggagggcccctgctccttctgggctcccaaatgctgttggtggagatgatggcggggtttggatgctcagtgcttcctccagggcctggaatcaggaaaagatgggaccatcagcaggaacccctggaaatcagggccctttggaggggtcatcctcagggaactccttcctaataataatcatactaataatagccaccactaccagtcctatttaataaatgctgccctatttatttgcattctacacatatcatttcattggatcttctgcacagtgccatgaagaaaagactatgatcatcatcctcattttacagatgtgaaaactgaggctcagagacctgaaggggcttgtccaaggtcaaggtcacacagctagtaagtggcagagcacagattcaagcccagcacatgctcctacccagcaggctaaactggggttgtcatgcagaaggggaaacctccccttccctgaacatgtgtggctcaattcttagcacccagacctagaaggaagattaagtcctccgggggaagcttcagtctccccaacaactgccctgccctgagattcttcactttcagcaacccattcccatccaaaccaccccttccatcctcaacacttatgtacatagagaagactggatttaatttctgcttagttaatattttccctttctaacactgaaaatgggctgaaatatcatcaaataacattttgaaaataaaaaaatactcttaatctatcatgttcacaatagattatataaacagtgtgcccacatcttcttaaaggtttcagttaaccgtgtttcccctttaactctgttaacatgttactcagaactctggaacatgtctcaagactgggcaccctggactttggccccaggacagcatcgcccatgggcctccctggaccgaggggagatagagacctggcccaacttggactcgggcttccacctggtctcctcagctcccctagacacgcaaagaaactgcaggaccgagagtaaattcaggatgctccgaggggaagttatggctccactttatcttcctactccaccccacttttaaatgaaaagactgaggtccagcgacagggagatgcctaggtcatgagcaaagaaggccacatgccctgcattactcatccacatggtgtctgtccctggctctgccaagaaaacctccaaggtcatctttatgatcagcaacatggacaattctctgcctggatttagagccccaagtcccccagctcaggacagatcgcgtttctttctctggaaacaggtcaagggccccagacttggcataatcagtgtttacaaaacaccaaaaccaaaaagaaagggtttccccagcaggcctaggaatgctcaactcatgccagagtccactgtcaccagggtcaggaggcagagggaaaggaaaaacaattagcacgaaacgaaaagctgagccatgaacttaactcctccaggccctcagagaatgtttcctttcaaagctccctcctgtcagcttgcatctttgaaatgtgctggaaagcaggcagaactagagccgttcccaccagggctcggatggcaaaactgaactggagaggctggagaggctaagctgggactagaccactccgcttggctcagaccagagggtttctggtttcctcagcctctaccctgggggccccatctccctggatcccactgcacaagggcgggcccctcagcccgtgctcctccactcccatcagtgtttgctgaacatgtgcttgatgccaggcgctgtacaaggcgcccagggtatacaccttggtgaaagtatgcacctcccaccaccagatgggaagacagaattaaataagtgatgacgagccatgagaaggagtgtcagagaagttgctggtacctcaggagcatagaccagggcaacctgaatgagattctgggaaggctttgctgagcaagtgagggtaaaacaaaccctgacaagcagggtgggcaggtgaggcacaaggggaagagtgcacctccagagggaagggtgacacaggctaattcaagggctgagtcactcccagtgtgggaggcaatggcagagcaggcgggaaacaggatgccagctcactgactgggggttacccttcctaagctgaatggttgggggtgccagtgatggggtgggcattgcagctggactcaagggagcccagccaagggacccgggccaaggcacccaccttgttgagccgctggatctccttttcctggtactcacgctgtcgggtgagtgggctcagctgatcctgcaggtacttgaccttttggcgcagctccttggcctctgctgtcagctgctccttgtcggtctgcagggaatacaaggttggtaagctggctaggatggcctctccaggaggcctcggattctctgtcctgcctggcccagcccttacgttctcccctggccatcacttcacaatgctcacatgcaaagcacctggggtcggtacagtaatgtccatccggtcctgccctcaattattatgtgtcaatttaaaataataattaaaaaaagaaaaagcagtagctcagttgagtaaaagaccctggattccgacaccagttcatccactaagcagctgagacccctggcactgccacagccctctcttgtctaagcttacctacctgtcacaggtacggggttcctaacgtgagtcacacagagacctcaggaggcctgtgagccccaaaactgaatgcgaaattttgttgtgtgtaatctgctagaaagaaaagccatagttctgaccagattcacatgggggtcttccgtgatccacagaaagcgataaactacggataatccctaacagacactgcagctcatacagccttggagcctagaggagagatgacacgcccagagagaactgtgacataaggcagagagtgctcctccagaaagaaacaaaatactgtggggctaaaagaaagatcaccacagctgagggaaggcttccaggaggcggttccataccctctacggaaccagcagggcttcgccacagccagccaagactgggatggcctttagacagcatcaagccccagccctgtaatacgatgggaaacaaatgtccagagaggggaagtgacgtacccaaggccacacagtgagctggggctagaacccaggtttcctattcccttgctctctctccttccatgtcaaaggaggtgttgaaactaggggatggcagcacagtgcagtggaaagaccaggcacatccccaaataaactatatattcctatgtgtacatatatgcgagaaaggtctggaaacagatgcaccaaaatggtaacagtggttccctctagggagggcctgggatcatggcagtgggaggtagtccagggaaactttcactttgtagcatgtggacatttcataactgtgtattcacagcatgtgattaagagaccagtcgcaggggttagttttcacccagccctgtgtgacctttagtcagtacggactgcagagggcaggcttggtcagacctccctgggaattgttctggactccccatcaagaggctcccggatgggcatgggctttaccgaaattcatccttatctacagggccacgccttgtcatgaaacgtcctaccttccctgtagctgacagggaagagccctcacattccagggatttgtctcacctaccactgtgagcaagggagaggggccaaagagccaggatgtctggctgcgagtcaccaggtatgactgtgcactcataaggaaagacagaagtgttctccctaccacacctccaaggtaagggggtgtcacagacgtaggctgactgctcaaataaggcccctggtgtcccatgctgacgggaggaactgtgaaaggcaatccaggttgaaaatgtccatttttaagctaggcaaaagaccatgcccagttcccatgaaggggaaaacatggtgacataaataaaatctcccaagagtctggcagtcaagtggcctttcctctttaagctgctccaaggtcctgatgggccttggctggtctcattcatacatatgactgggcagatactactacttcaggggacctgttgtttccccccaagaaagaatctggtctcacttatgcccactctctgatctctgtaacttcttcttcgtagtactttttttttttttttttgagacagggtctcattctgttgcccaagctggagtgtagtgacacaatctcagctcactgcaacctccgcctcccgggttcaagcgattctcgtgcctcagtctaccgagtagctgggactacagacatgcgccaccactcccagttaatatttgtatttttattagagacggggtttcaccatgttggccaggctggtctcaagctcctgatctcaagtgatccgcccaccttggcctcccaaaatgctgtgtttacaggcatgagccaccatgcctggccatacatttttcttttagagaaacagggtttcactctgttgtccagtctggagtgcagtggcacaatcacagctcactgaagcttccaactcctgggctcaagcaatcctcccacattagcctgagtagctaggtctacaggtgcacactgccacacccagtgaattttttaatttttgtagagacaaggtgtggctatgtcactgaggttggtctcaaactcctggcctcaagcaatcctcccacctcggcatcccaaagtgccaggatcataggcacaagccacccaacccggccttctctgcaacacttaacacacttttactttatttgcttctgtaattagttgtctggcacctctttcccagcgagggcagggttgagctgttcctgtggactctatgccaaagcacaatgcctgagacaggctctgaagacaaatgccgggatgaatggataaatgaagctctgtctcatgttgtagcccctccccaacaaatcaccatcactatgctgaacacttggcagcatcccaccccaccaagtgccatacagcaggcctgcttggatcttttttttttttttttttagcaagagtttcactcttgttccccaggctggagtgcgatggtgcaatcttgactcactgcaacctccgcctcccaggttcaagcaattctcctgcctcagctacctgagtagctggaattacaggtgcctgctgccacacctggctaagttttgtatttttagtagagatgggatttcatcatgttggccacgctgatcttgaactcctgacctcaggtaatccacccgtctcggcctccccagttgctaggattgtgagccatcgtgcccggccacctgcttagatcttttatatggtgtgcttccctgtacagttccccattccctacaattttaatggaacaaaaagttctgaataaaaacaagaaaatgtgaaaagctgtagttaatgtaactttctcaattttcagatgggaaactgcagtgcagggaaggaacgtgcctgtgtttttggtcacctagctctttcgcactagacccccgggtctcctgactcctgcccctggcttgtttgctccacagaactctccgctaatgtggaggggaactgactctgcagggaccagcagtcacacttgcctcctccatttcaatcttggacttggccaggaggagcttgcggtcaaagtcacgctgcttctgctcccgctcggcctccaggtcagtcacctgcttctgcaaatcagccagcttctgacgcagctcagtgatctgggttcagaggcagagaggagtgtgtgaggcaaggatgtagagcacttgcaggatgtgggcagggcctggctgcccctgggccctccaacactgcccccaacttctcctctgggccatactggggctcagcgtggccactccccaaggttcaaagctgctaaagaggcagcgagatgaagaccaggcatgccctgtgggcgtggccaggaaccccacattaccttctgctcatactgctgcttcatggaccggaaatgctggtcccactgcttgttcacttccagcagctgtggggagagactggagttagcaggagatgagcagagaaggaacaaggagagccatctcctgccccatgtacaccagcgtcccaaggtgtgctcggtgtgtgtgaatagtggctacagacactgtctccatccctcagctctcgaaaactcaatgttgctcaaagccatccaccttcatccactgctgcattttaccttgccaggaaagcaagattaacactaagacatggaaactacatagttttggtgaataattatggaacacacacacctctttggagggcagtctgggattatgtattgaaatttcacattttcatcaactttaacccaataattccactctgaagaatttaaccaatagaaacacttacacaagtgtgcaaatatatatacacaaggctaatcatctcagcaatacctgtattacaaaaaaatccagaggccaatctaagcacagaagataggttaaagaaacgatagtataaacagacaatgtgcagctgttaagaaaataagaaaataggccgccaggcacagtggctcatgcctataattccagcactctgggaggccaaggtgggccaattgcttgagttcaggagtttgagaccagcctggagaatatggcaaaaccccatctctacaaaaaatacaaaatttagccgggcatggtggcacgcatctatagtctcaactactcaggaggctgagatgggaggatcacctgaacttaggaggtggaggctgcagtaagccgagatcatggcactgcactctagcctgggcaaccaaagtgagaccctatcttaaaaaaaaaaaagaaaagaaaaaaagaaaacagaaaataaagcacctaacacacttcctcagtttgaagatgacactatccaccatactcttgatataacaattcctcagggaagaaaaacaaccctacatcatcaactaaataaaacaaaaggagtattggccctgccccttaagatatgtcataaggatccacaccaatttcaaaaacattgcatatgataaaaaaaattacaaagaattaaaggaatatagcatatgttatagatatgaatagatactctcaaaggcagttaattttttttttggaggcaggcctaggctggagtgcagtggtatgatcatggctcactgcagcctcctgagctcaagtgatcctcccacctcagctcccccaagtagccgagactacaggtgtgtactaccacacccagctaatttattttttgtagagacagggtcttgctatgttgcccaggctggtctcaaactcctggttgcaagtaatcttcctgcatcagcctcccaaagtgctgggattacaggtgtgagccaccacgcctgacccagttaattttttaaaaaagaaaagaaaaaataatctgtaaagcagtgtgtgtatatacatatatatacacacacgtatatgtataattttattctactttgaaaaaaactgagggatattcaacaaactgtaatcagttgtggttttctctaggaggtggtattcttgatctttttgtaatgagcattatatcacttttgaaatcagaaaaaaagacgcttataacaatacaaaaagaaatctaaaactaatatgcacatcaagaagctttcaaatgtgcgggaggacaaggggaggcaggctcagggttctagagaagcacctgggctgtgtggagaggggctagacggaacagacagaacaagtgtctaccaaaaaggagctgcacttcgacctcgggtctggaaagactggactagactgggggtgtgaggagggggaggaacacatgtgagatccatgggaagaggcggaatggactgcagcacagggactctgctgcgtggcttctctcttggcagcagagggaaactaagagcctcttacgaactggctcctgcaccttagtgggactgggggacatttaaactacctaaagacctggccatcgccttaatggagtttaggaatccactcagtattctgtggcaggcttcggctgctggctggtccttttcattcttgcctaagaaaattcttgaaatgggagtctcaaaatatctgcaaagtagctacaccaatagaggtaggtagctatttttttttttgagatggggtcttgctctgttgcccaggctggcacgcggtggcacggtctcggatcactgcaacctcagcctcccgggttcaagtaattctccctgcctcagtctgagtgggtgggattacaggcatgtgccaccatgcccgctaattttttgtatttttagtaggcacagggtttcgccatgttggccaggttggtcccgaacctctgacctcaggtgatccacccgcctcagcctcccaaagtgctgggattacaggcatgagccaccgcacccagccaaggtagcttttaacgttaaaaattttgacagtaaatttatggagcctccaggctagtgggaagcggccttaatcccttccttccatgatgggtcctccctaaagcatctctcaagggtccctccactcctcatcggtgatgctaaaacttgcctaacttatcacaacctctttccaccatccaaggtctaccataggagcctgcctaaactgtagccccaacaattttaggccatgccccacatgccacctcctcagagtgaccactgtaggcaaagggactgatcaagagaggacagtccagggcaaggagtcagacctcatccatgggcaggcaggtcagtggtcaccatgccaactcctcatggtgacctgggacctgccagagccaggaggccagggcaagcctttgtgctgctggtcccgggaggtaagagggatcctcccactactgccacctcggccacctacctcactgcgctgctgctccagcatcttcaccttcttctcggctgcgcccaaggccaccacctctgggaccttacctgccgtcacactagcctggggagaagcacagaggagccttcaccaaaacctcaatacaaattatctcacccagtctcggtgctcctctaagacccctcacccaagtggccccagccctctgtctccctattcctcccacccagcaggacaccactaaccatcccagtcatgactacgtccccttctagaagtctacaagatgatgattccccctccctgactcagggtggctgccaggccctctccccttcccttctcccctccctacggtcattctccctgtttaggtacaacctctaaggtactaccagccactctcctcactccctacacacatcagccaaaaaactctctggcctggaaggtaagacatttgagatgtagatacagacagatatagatatagatatactcattctataaaacatatatgttttataaaacttttacaaaagttgaagttatataaaatgtttatttaaaaacatttttagaaagatgcagaaataaagatctgtgtaatacacatagatgtttcccagctctgtcctctgtaaggggctaaagcagagacatccagcagcactgagcaaacctagtgctcagttggtttctaaataccattttctttttattaaaaagaaacagggctgctttgaggggctggagcagataaaatataaggtgagtttgatgcatcttatagtgatggaaagtaaggaagtgctcaaatgaataatactaataacaataataataaaagagcatgtcaaaagggcacaagagacaacctgaaaaaaacatctatggccaaaacgggaacactttgaacagcaaaatacatcacaatagtattggattataagtcacagtatgaaataaatactcttgagttcatactgatagaacaaaatagctgaatcaataaataaatgggggagaagggacagctcttccttacaaaagaattctgattaataagtgtaggaagaatgaggaaaatatgaaatcaccattccattactacagtaataactgctgcaggtggagatccaccaatggtcactaaaatcagtgagtgaaagtttaagaaaaaatagagtatttgcatagtctctaagtttctcctcaaaaataaacacttattaattacaaagggaaaattggtcacttgattgcagaaacttgaaagacagcacttggccaagtgatgaaggttaacagtagtaaaacactgacatcatgtacccctggtctgctggactgagaaatattctgcacactctgatgtacacagaacgtcacctccgtgagattcttgccaaaacacgtaacctcaatctcctcatgagatccaatcacttgtgaggcctcaatcgtgacagcaaataagtctatactgaaaaacattctacaaataactggccagtacaactcaaaagtttcaaggtcatgaaaagcaaggaacagctaggaactgtcacagactagaggaaaatgagggagaagagacaactgaatgcaatgtgggatcccagactccatgctggcacacgacaggacatgagtgcaaatctggtgaaatctgaataaagtctgtagtttactaagtagtacatgccattaattcctagttttgatcatttaacctgggttctataagatgttgccgttaggggaagtaaaggaaggggataggggaactctctagactatttttgcaactcttctgtaagtctagttataccaaaataaaaaggtttaaaggttaaaaaaaaaaatagcaagtgctggggtgaaacagcagacaaggccagtagtccggagggtgtgtgtcgactctatctccaagcccctctgtgatggacaccaagaccctcgtcttctctgggcttcaatgcgatgagaagctcaaacagaagaaggtctgcaggccccatccggacttctgacattgtctgccatcatcctggagtcagattctctctattctcagcgttctctttccagcgttctctttccctccacactgcacccccaagtggcttcaggtagggctgggtgcagagcttgccccctacaggctcaggcctgtaagcacaccatagcaccaaggagcaaggtgagggggagccctccaaggaaggtcaccccctttgagaaaggggacagacaggcctgcccacttgaaatctgcggcatcttggatgggagctgtgcttagcaaaaaggtcaacaagttaccggggaaggaggaagagggtggattccaggctctagggtggtgcaccctgaacctccgcgagggagagaggagtccacgtggagtcagcagagctggctgctggccccaaatctcccctaaagagcaacagctaacgttcactgtttacgacgctaaacctactttacaagcattgcatcactgaatcctcacaaccaccccttgaggcaggtgttactatcttcattttacagaggaaactgaggcctaggagtcttatgtgacttacccaaggttgcagtgctggtaaaaggtggagctagtattccacctgcatgcaattccaaggcacactcgtcgcccctctgtaacacatgcctctaatgagacaggtgaccctggggcacaagggcaagtcgctcccactctcaggaagggcaggaagagcatctggctcggggcattcaaggaagacgagtggagattaaagggcacaggaaaagtaaagagacctgtccagggaattccacacctgaggcagctcagagaacccaagggagaacagccgagtctacaagtcccttccacaagagggcagacaaggccggatctgatttggggaataaagggaagaaaagaggatctccatgggctgggattcggaacaccagggaagagcagactttcaccatttatcagcatgtttccctggccgtaccctacatctgcctgatagcaggtcacacagaaatcctgattatatgatgttacttgacctctccaaacctatggccatagctatagaatggaatactagtcccagccttgcctactctataggtagagatgaggcccaaataagaaaatagatttgcatgtcctgggtaaactctacattgtcacacagtaataaggaattaagccattacggtaattgctactattgcataggtgtagggtgggttaaagacattgagccctactgttcagctattaaaccccattaaagggtgaagtaaaaacacgttggtaaagagttgggactcagctctgcagcaaggggaatggtaacgactgggcaaggggtgcagagtctgctcctgcttgggacctggatgtggccagtgctgggactagaggataggggagtgggccagccctgcagcatcaccagaccacacagacactagccaacaccctcccctctccactttagaggctccagagacacaatcccaggagcttagcagaatccaagggagcttgctcaaccaacctaattctgccaggaatatcaaagatgttaaactgacttttgggaaccactctctaagacagaccttgacaaactggaatgtgtttacggaatgcacccagactgagcaaacgactcaacaccaccttctatgagcaatggctgaaggaactggagctatttagccaggagaagagaaggcttatgaggcccatgaagccacagtgactaccagcagcctctaagcatggaggtcaggccaagtaaagaaaaaaacacgtaacagctagaaccttctaccactggcactggctgcaggagggaggaggctcactgtcactggaggtggtaagcagaggctgagtacctgcaaccaaggatgctacagaaggaatttctgaccacatacctgctgctgtccagccactgccttcttgcctgtcccttccatcttcggtgagcctggccgcccagacgcaccctctttgttgccattgctcatcaacaacttcttgagctccaaattttcctccctgggatggaggtaaacagagaaatcacaatgctgaccctgagttaagaaacctacagggctccttaatgctcactatcgcatgagttgcagctgagccccagggagtactgcaggatcctgaaacctgccctcctggaaaaccaaaaagggcatcttcagctaccttgctctcaatctgtggaggtctctgattgtcaatggcagggtttccccagctgtggaatttctatgcacacaagaccttccggatatatccaaacactgcattaaataaccctggatcacattctagtgagaaagtgacaccctttccaattatcttcacatttcttgtgtagaccacggagacggtgcgagcttggtgctaacaggccctgggcacctctctagttactcgccagtttccctcgttaacacagaaggtgcaggctgcaggcccagagccttcaatgtgcaatgatccttagcctgaatttattaacatcctttcactttcattgtatttagagttatcttctatttatcacaggtaatgctgttttccatttactctagttaaagttgcctttataattttaagtaaaaagatgaatcaaattaaagtaaaattctaagtaactaataaggcaggtgatagaggagatcataaaattagtgatgtggattcaggtctgactaaaatgtttcttctttcttttttttgagatagggtctcgttctgtcacccaggctggagtacagtggcccaatctcggctcaccacagcctcgactgctcctactcaagtaatcctcccacctcagccacccccaacctcccccaccacacacccccaccctcttgagtagctgggactacaggcacaccaccacacccagctaatttttttggtattttttgttggggctgggggaggggtggtgatgtatttcaccaggctggtctcaaactcatggactcaaagcaatcctcccgccttaacgtcccaaagtgctgggattacaggtgtgagccacaacgcccaaccaccacttctttatgttctatttgccagctgagtttccgcttgaaaaaccaataagtaaaatgactttcccaaggtcatacagcagagacttgcattcttgccttctaatccgtgacttttttccccagcttcagtttctgaatccatggatggggtcactagggctataaaaaccccaaaagtgcatccttggccatccaaaagcaaataaattacacactgattcaaaatagccagtggctcagtagttaaacattacttctgtggccatacttacaaagtttatattccttctctttctgttgattctaataagaaacaggagaggagggaaaaacagagtggcaagtcctgtctgtgacacgggcctttcctatgtgcctgagcccagctggtacccaccagatgactcatcacccaaactgtccaggaccacagtgcaggcaggaattgtggccactcacaggatggagagcaaggaggcccaagttcctgttgtaagactccaatcaagtccctgcctctccctgggcctcagtttcccctctgcacagtgagaggtctgtctgcatgatctccaagggcttgtcaagctctgacagtcaagatcagtgtttcccaaggcgtgatcctgtgcctacctcgttcataatcacagagactcctggtgaaatgcaggctcctaggtcttgcctaagacctgtcaattcagaatcttgcaaaggaaggaagggaaggcgtataaacttgtaatgcctttccctgaccctcaaccctcagttaagtctaagccccctagtccagtgggggagctctcatgttctcaggaagacagagcaggttgggatggtgaccagcaggaggcagcaaagtcctgagtcctctggacagccagttcaccgttaacaggggagagaggcaagtgctggaggaggaaggaagtacaatctatgctgaccttcttctgaagctctcaaggcactctatacacctcccaaggtggcaaaagggccagagagaaaataccaaaagagccaaggagaaggatcaagagacgtaacctccaaatagggctctgggcacagggcctcagagccacggtcctcaacccagaaatcagtgctgcacaccagcccctcctcctgcagcccccactcctcaccccttctctgaggggcctgaacttaccgcagcctctcggcagcctgatcccgctgttccaggcccttatccaacttggccttcagagcctcgttctccttccgaagctgctcacacagggtctgtggggcaggggaacagacagggtgagggaaaggaggggcccctcccaggtgcaggctgagctagaggatggtggggggcctgtagccaccccagggcccaactccttatcccctttgcctggcctcaccccatccctctctaaggagctaagccacttggccacccacgtgtcctctcccttgggagccaactacggagaagcctgaccaagtatcagccatggggccttctgctcctccaagacagacagctccatcccttctccttcatccctgctcccactgccgggacccctattccccaccagcctcccccagctgacttctacccttctttgaagtcttagtttaaatcccatctcctcagagaagtcctccctgactccccgatccagctacattaggctaactccgttatccttgctcacagccccccgcttttacgcttctcagcacctgtggcagataaagctaaagaactgttcgtgctgctgttttcttaatatctacccccttacccctaattaattcctgagctcccggagggctgggacccctaaccatcctcttgttcactgccagatccccagcccccagctcaaagtttgtggaaggaacaacatgactgaacagccaaatgagcaaatggacaaatgagcaggcgagtcctaggggggctgaaaggcacaccaatttgcaggtgtgagaggtgcccagtgttgccaaggggaaaaccagaagacaaggcattcagtcgggacctcactatgccctcacgccctcacaatgtggctgtgacacttggttcctcctctacaaaagaaagacaactgtttctcttttttttttttttttttttttttttaagacagagtctcactctgttgcccaggctggactgcagtagcatgatctcagctcactgcaacctccacctcccaggttcaagagattctcctgcctcagcctcctgagtagctggaactacaggtgtgtgccaccatgcctggctaatttttgtattttcagtacagacggggtttcaccatgttggccaggctggtatcaaactcctgacctcaagtgatccacctgcctcagtctcccaaagtgctgggattacaggcatgagccaccacacctagcccagggacaactgtttcttctctgcctcctctatagggctgctgagagggacagatgagacagtgagagtggaagtgtccatgaaccatcagtcacttgcttatgtgcggggactcatattggaagctctgtgaactgggggcatggaagaggggtcgccagactcaggacctcacaggctggggggaagggaaggtgctgactagcaatgctagcatacagtgtcagcacagagttgttcaatctttccacagatcctcactgagcacctcacctgtgccaggtacattgctcggtgtttctccatatactgcctcactggtgcctcacaacttcctcaaagctaagtaactcatctctatgttaaaggtagggaaaccaggtaaaatgatacagtctaacaggtgcacagctgctaagactcatcactggcggggagtaaaactccaattggcagaccccacactggtgtctctttcccctgtgatgaaagatcagagaagggagagagatggtgcccaaaggaggggacagcctttgagctgggccaggaccagggccattcactaaacagccatctgctgccttccacctcccaggcctgttgcaggtggatgcaaccatgtgactagttctggccaacaaaagaggtgtagaagggacaagcatcactcctggactggcctacgcacaattctccagtctctttttcctggtagcaggggctgatgtggatgcctcgtattctaaagggcaccggaaagttgggcccctgtctccctgggactctaaggaactgtgtagagcagaaacaaacccctgccacacagaataggagggaaaacttttgttgtgtaacccagggagatttcagagttgtttcatttctgactcacaaaggagactcttgggaaggctgaatggaggacacagccttcaactggaggtggctggacaatgagggagatgaggcttagcaaacagagaaccagctgggcatggtggctcacaccagtaatcccagcactttgggaggctgaggcaggaggatcacttgagcccaggagttcaacaccagtctgggcaacatggcaaaaccctgtctctactaaaaataccaaaaaattggccaggcataagggcgcatgcatgtagtctcagctattcagggaactgaggtgggagaactgagcccaggaggtcaaggctgtagtgagctgtggtcgcaccactgcactccagcctgggtggcggagcaagaccctgtcccccaacaccccttaaaaaaaagaaatcaaaaaattattgttatgagtccattcaatgcctagcagagagccttatgctatacctgaccttgaatatgtttgtttagtgaaccaagaaacacatcagtgaatgaatgaggaggaactggatcaatacacctccacccaggcagtaaaaatacccaagatgccatgtctctgggcgaggcctccagggaacagaatggcctgctcctagtccctaagggaaggccaggacaaggcctcacttgctgtcctacccttgcagtctagagagctgtttccttggagtctctgggccaatgccctgggtgcaaaccggccaatggatagaatcatcagaggtcacaaagatcatcaccttccatccaaggtgctacgagagctatgagttcatttgatcatttattattttgtcctttcattcattcaccaagtgtgtatgaagtgccacgaactgggacgcaacagtgaatacaacagacatggtgcctgcccccctcaagcttaccttctagcagagagtataagaaaaaaaagagtataagaaaaaatgtattaaataaaattattacaaactatgataagagctaagaaggaaataaacaaggaggggactgaaataaaaaataacagaggttggcaggaccccttttaaggggcctaggatctatccccatctcaaagctgaaaagtggatgcgcaaagtgctctcaccccaggcaccttcctaccctgcccacagcctaggcactgtgccaggctcaccttgccagggttcagcctggataccttgaagcctcactgacatcttaaaggggttcccttctctcagcctggctctccaggcctctgcctctcgttcagcctcacctcccaacacacccctcccctccaggtgggatgggcatcctccgtgctcctctacccccacacctctcctcatactgcatctccaacctgattgcccttcatgccctcggcaaccaaggtcacgcaagggggactcccccttctgccatcagcggggcacttgagtgcctgctgacatgaatgagaccacagatcagagaatggcctgggaggagagtctgcagggagtaaggaggcttcaagtcatggctctgtcactaaggtggcgggcactcagatcacgagcagtccctcagaagcctccgttttgccatctttagaatggtcaccaattataactgaacacttccccgctgctaaagcccacaaggctaagaccccctgcccagtgtggatgcccgtcatgaactccgaatggggacctctcttccagcatggactaggttctggactgcactgggtgcttcatgtacatggcctcatttaatgcagcaatctaaccatggaggcacttctagctcatgttactgataggaacattgggggatagagaggataagtgacttgtccaaggtcatacagcaataaagggtcactactggaaccaaggaccatataactccaaggtctggcctggcctagcaaggaaatctgtccattccccacagcacagggaggctttcaaaaggaattcaataggggaggcaggttgggatggtggtcaagagtatgggctttggaatgcgagagatcgaggttccaatccctacttcaccatttaccagctgggtgaccttgggcaaaaaaagggctgcttccccacctgtgaagtggtgataatgagggtgcctaccctggggggaaagaggcattatgaaaggagttgacctttgttccctcccttcccatcccccaaccctgcacatgagaaataaaggcagggctgctgggggtatccccaaccatgacactcgcattgcccatcccgtatttccccatttccttcctcttcctcatccctccccacaacttccttatcctgttcatcaccctgaacaaaaagcccgaagtctgcccacaacacagccttcagaagtccccatggtaccagtggattcccaggagcaggaaggtgggaagagctcggggggaagcacgcctgcctgtctcgggctgccctccccacgcgcctcacctgcagaatggaggtgcgctgctcattcttgtgcaccttggatgccagtcggttgaactccagggccatgcggcccaggtgggtgaagagctggccgtggtccggctcctcggcacacacactcagcgtggtctccaggcgctgcaggtgcagcatcaggttgccgtcctcacggggcagggggcccagcgcctggagagggaaagggcacacggcccactcttcaccaaggcctgagtaggcgccgccagtccattctccctctgcttcctcatttctcatgactcagtttccccctgtgaccccagctcagccccgggaaattctccagttatgcaggttccctgtctggggctgactcacagggcagaacccaggactcacaggccactggtggctccacagcagcggggccaccatcctcccacacactgggccttgcagagtgcctgacagtaagtcacttgtctgctggacctcagcatcctcatctaccaaatgtccgcacaacccttccctcccttcaacctcacagggttcttaggaggatgaattgacccctgacagtaacaagcccagaaaagggacatcactgcacagtcagccctccatatccatgggttccgcatccatggattcaaccaactgcagatcaaaaatcttctaaaaaaacaaactggccgggcgcgatggctcacgcctgtaatcccaccactttgggaggctgagcgggcagatcacaaggtcaggagatcaagacggcctgagtggtgaaaccctgtctctactaaaaatacaaaaattagctgggcatggtggcacgtgcctgtaatcccagctacttgggaggctgaggcaggagaactatttgaaccagggagtcggaggttgcagtgagcagagatcgcaccacagcactccagcctgggcaacagagcaagattccgtcccaaaacaaacaaacaaaaaactgtattgaacatgtacagaatttttttcttgtcattattccctaaacaatacagtataccaaaatttagcatttacattgtattaggtatcgtaagtaatctagagatgatttaaagtatataggaggatgtgtataggttatagggaactactacgccattttacatcagggacttgagcatccatggattttgggtatcctcagggagttctggaaccactctcccatgtttaccaagggacatctgcatatacgtcctgcaacctccgcctcctgggttcaagcgattctcctgcctcaggctcctgaggagctgggattacaggtgtgcaccactacaccaagctaatttttgtatttttagttgagacggggtttcaccacaatggccaggctggtcttgaactcctgacctcaggtgatccacccacctcggcctcccaaagtactgagattacaggcgtaagccaccatgcctggcctacacatgtgtcttctggggaatggcccaagcattcatcagcttctgaggacccaagactcaaaacagtttaaggaaccacagctttagctatttcagaaagtcccaaactagtacagtatgtaagaaataaagcacaccgtgggccagatagttgactctttctctctagtctatctggaatactcctaccaaagacattgcctttgttacaccaattccactcccaaggacctgcagtgttaccctactgcagacggcactgggcccagctcccctgctgggcatctaaggccctacagccgcaggtcccatccacagcagcatccagttgggctccccactttaccctgcctgaacccacacacaccaggtctggtgtctctgcatgtgtcctctctgtgtcctctctgcctctgcaagttctgctcatccttcccaccctgtccacggctcagctcctccagcagcctcccggaaacagttatgggaatcacaggacagcagagctacagggagcctcagagatcaggccgggaaaccaagctatggggaggaggaacttgcccaaagttgccctgtaagtcagtggcagaggtataacgagaactgaggtttcctgactcgccatccagtgctctgctgcactgacctcccacttctctgaactctggaggaatggcaatgactataaccccaacttggcattccctgaacacctgtgtaatggcgtcagtgtgccgcattctaacaagaggaaatgctgctgtttcaactctgcatccattcccccactgcctctttccacaaaggagctgaggtggcagatgctgctctatttaaggctcatgcgatgcttcccatgcctgcgacttctccagactacaagcttcagagcacagggaggctgtgttgtcttggctcaagtggctcagcagagacaggcacactgtagagctaatgaggaacttactacgtcagttaaagttatcggtccaaagtcagagtgaaacactttctgagcaggggatcttgcctccatggccagcatctcagagccctcagggacagaacaggacaaggggacagaaggttccaggcgacagaacataaagagcctttccaatactcagagctgcctgaggcagtggtgagcctctcaacactgaaggcatgctagttagccagacagccacctgagggggccctgcactgggcactgacaggtacatggggcaaccagtgaacacaagcatatttgtcagccaaacctttgtgaagggaggcagcagggatcaatatatcagtgaagggctagagcacctattgctcgcataacaacaattaaagaaaaaaacttaaaagtgggaaggaagggagaatggagaaggtagaaatttaagtcgtttaaagaatcttccagacttttcacaatggttcttcaataagtctgccattttaagaaagaacagaaggagatatagttaggaaaaaggcagccagtgttgtaaggtgtggaatgaggatgctgggcagacgctccagagctgtacgagagacagagagagagagagagagagagagagagagagagagagagagagagagagtgtgtgtgtgtgtgtgtgtgtgtgtgtgtgtgtgtgtgcgcgcgcgcgcgcgcatgcgtgtaagtggaaagttgaacctccttcctgtgtgctccaagagtctgcacaaagagcaaatcacctgtcttacagggccctgggccttcctgacccttctttctcccccggggttggaagcccacagacccaaagggctgagtcatagtgtgcggaggtgcctggcccctggcagaaggcaacagggctggcaaagagcccaggctttcacaacggtcgggtgcccgtgtgctccaagtcggggaagtcactagcccaggaatttgcatatgtgagcgagaagcaccctttgctcctgcccctcgtgtatccccaagtgactccagggtacctaagggatctgaacaggttctgtgcctctcacatggtagcaagtgacaggacacaaagagggcagcaggtcaagcccggggtcctgcccgtccactcaccatcgcattggcatggctgctgctctctggtgaattctgctcctcaggagtgaccacttcaaattcagaggaggtgccctgtgcagaaaggaagttaggtgctgcccgagagaaaaacagctcacccctcctctgcggccctgtggctgagagcagcaagggggacaaaatctcttcccattttgagtacacagggaccgttacatatcatctcacatgagatcacaaagcaggattctcgacaagcctgtcatagccctctgcataatgtgaggtcatatcccctcgatggccaatcctcttttgtagaagggagatgtgggactagctgaccttgaaccagcagcactgtaggattgcattttttaaggccgtgtactttttaaatgctttcatgagctccattatttctcagggtgacccatggagtgggtcagaaggttatatcctctttggaaagatgaggaaactacagtatacagttggttaatgcaaaagcagggattgaacccaagactgcagatccagcattcctgccacggccccagagctgtctcttaggcccagacgtctctgatcggtttcccagaacacagatggcagctgttacggccaccaccaagcatgtcctgtgctggccttcccaagccagtcctggagatcccagaggagtgaactgatctgagaaaagtcccagagatgattcaccaaatttggagactatttcaggattcaaccaaatccacggtggccaagaaatcccagattttttcacatctttccgtcattcctagtagaattactggtcattcaaccaaccaagaagccaatggcccacctgaaccagccattagctctgggatctgggatttccatgtcccgttaaacctggtctgcagcctcccttcatcccagaaaggggcaggatagatgagaggagtcagtgctcagcttccagctgaccctcatggccaccaagaactcacctctggctcttggccctgccctagaaagtctccctcctccatctacattttccccattacccgtgtaacctcagaacaggtccttctttccctgcacctgatctgtaggataaggatgctgaactatgcaatcccttgtaggataccaagcaaaacttctccagccaaatctgtagatttttttttttttttatgagagggtctgactctgtcacccaggctggagtgtggtggcatcaacatggctcactgcagccttgacctcctgggctcaagcgacccttctgcctcagccagcctcccaagtagctggaaccacagacatacaccatcacacctgactactttttttcttagagagatggagtctcactatcctgcccaggctggtctcaaactcctgggttcaagcaatcctcctgcctcagcctccccaagtgctgggattataggcatgagccactgcgcccagcctgtagaagatagtttctgagccctctttgagaatgtgagctccatgtcacatctgtctgttttcctagcactgtgcacactcagtgatacttaacagtatacaacttagtaagtgagaagaattccttgtacataccagggtcttcctggtaagttttaactatgaccttcatttcaaaatggggaggctgaggccccagagagtttgcgatggacttgcccaatatcacccagcgagacggaacacagtttcttgacctcaaccctctttcttcatgttcttgtatctgtcagtaggacttgaggtccatccaggcaacctccacccatgactccaaataaaacttacactggatggaggcttctggactggtgctggcttgtcactggggcatgcaggggctgtgggagatgctgtgacatttgagtcctttcctggagaatcaagaaagcacagatgaactgactgggaaggggagaagcccaggtaccaccctctcaaggacagcccttgacaaaagggttctcagacaggattccccactcgagtgtgggagaatgggaggtggtctcatcagggccaggtagtctgagaaaatggcctgccctggagtgacggggcagagcctgagcagagagaccatgctccctgggcttactgggaaaatcccaagttggctgctgctccttgctgccctgaacaggcctcaatgataaagacaatgatttacaatttgaaaagtctttatgtatctattatcccagccattctcataaaagccccatatccccattttaaaggtcaggacactgaggcttgggaaggtcatcaacttgcccacagccacatagccagcaactgcaaactcaggactgagacttggccctccctccctgacttcctgcagtccttgctgcagggagctccttgaaggtagcttcatttctcactctgagagtggacctggcaccaatcaggaactcaggaacattgctgaatagacaagcagaggctggaaatgcccactgactgcagcacagtggactctgagaccatcactttcctccatttgtccattcagcaaatgcaaccaccagccaatagaaggctgtcacattggcctgggccagataccatacagtagagctgcagcaggaggcatctgagtccagctgaggtgcggatcatttccatcctggtcccagaccttaccctggacttggagacatgccagagtaatgcacactctgtacgcatggtgatgcctctaccatacatgggacttcaaccccgagccacagtcaccctgtcctttaatgggcagcacacgtaaccttacatctgaaatacgctgcagcaggctaacaggcaagcccagcttcttccctgggcctcagcttccctaattgtaaaatggacgcgcagggcacgaccagggagcttccaactcatatgccagctccaagtgacagggagtagctgcttggagtgcgatgcctggcacacagtagctgctcattaaatattaaatatgctgataaagaccccaaggccacaggactgcaatgtagtcaactgttgtatctattactcatgtctgctggggcctcaggagtgctgagtcactggctatttttaacaagattgttttgaagtcccttccaaatctgaccttctgggggatgtggcagccaaaacatgaatggaagggtagcctgtgacctaaggataaacgagagaatgtgggttttggcataagaagggagttcactgtgaaggatttgggcagtttggggtacagggagagtcagaggtacccagactcctcttatacctgtgagctcagccagggggtcgaaggagcccaaggagggagaaggtggtgggagcagctcgttgtccttcactagctcctctgccttctgccggagcctggtcgcttccatctgggactcttccaaaagctcccctagagttattggggaagaggaagcaaaagcatttactcggctcagtgtgctgcttctccccgtcccaggcccctaaccgtgctgccgcctggcttctgaggctccaggccctggacttcactcccaccgttgctctgtgggccaagtgggacaaactccatgctggtccaccataagaaacaggctagagcaaggacgagggcccagcaatcgggggacacaggagcggaaggaatctatgagaaactcctcggctcccccaacccccagcattctctttctgccccactcccttcacacccagccagggcactccacagaaagccaggggctcccccaccctacgggctacccacagcctgagccaccagggcaaagggctgcctgcagggcggagaccttggataattccaaccagccctctaggcctccattttccttctcctacaagtggagatggggaaaccactcctccctccccagtcggccatcccaagcaaggatctgccaagcaaggagaaagcattttaaaaatcagggggctatgctcccctctaaaacatgagactagagaagggcacggcaaggcaaaggaagagtttcaggagtgtggaagaaagagagccccctctggatggggaaatcaatgaaagccttgtctggaggagaagggggcacagcaactgggtgctgatgcacagggcccgtcggtcgtgtggagggaggtggggttgttctaaagtggggatggcttgagcaagagccaggagaagagaactgagggacctaccacctccttgcttcaagccaagctctgctccctgctccaacacctaggaacgcgtgccccagttgcctggtcatgctggctctccccatctctcgtgccccagaaagaggagaccactctagttccatggccattaactgggccttccagccccctttcccttagcccacgcctccctcttggacctgagtcctgtcatcctggtttccgggtgctgaggaatcagggttgggaatactgtcaccatgctacatggtgcatagagacagctgtgaggcaggagccagcgctgggccaggagggacaggggatgacttgggcagaggcatatgccagcttcattctccactgctagtagagggactggcatcacagtctgcagggaggggcgctcgcagggaggggacagggtctgctttacctaacatctttatcccttgcattttttccttcagccgggaattctccttcactaggcgctcaaaagctgcggatgcctctcctgagggcacgctgcccccagggtcgtagatccggtacggtcctctcccttccatgagggtagctcagcccctgccgtggtgcccgcctggctgtaaggacaacagcagcatatcagcaggctggccaggccatgggggcatcctttgcagagaagctctagtctgtcaatgccccagaaggcagtcccccactttaagctggtctgaccatattatagtaaagcaggacagtcacctccttttatctggacgctctgcctctattaatacaaccttagaatggcattagtttctcttagcagcctcaatgcactgttggcttgtttggaacaggagtccaaataaacagtagggtgcaatgtgggatacaagaaagaacctggacttggaaaaaaaaaaatctgagttcatgtcctgtctgtgaggtccagaagaacaggaatcccatatgttttacccatcattgcatcctcagagcctaccacagtattagctatgaattttgcccaataaacacttactcaattaatggtctaggcattaatttactatgggattatgggcagtcccttcccctctctgagggagggaaatgaaagtcttaagttaatttagtaatctttaaagtgaaatgcttgtaccctaagggataagcaagtcaacccagtccaaagttccatttatatgtgtatcatcttctttaaaaaaagaaaagaaaaaaacaccctgactaatatttaatacactgtcaccctcctccgtgagtctcatatcatatatggtctgtcccttgcagttctaaggaacagaagaatttttcatcaaaccactgtctatttgagcaccaaggtttttttttagtaatctgttcagtttcatctgctttatgtcactgaaaccagttggaaaggtgattttagaatcctaactctgtggcttagtagagaagctctctgtccattcactcatccattcaacaattacttattgagcatcgactccgtgctaggcaccagtctgggtgctgaggaattatcagcaaataaaacagacaaaaatccttcatggagcttatagtctaggggtgaaagcagaggaggatggtggggaacacaatatttcaggtaatcaaaaagtctatgcacaaaaggccccaagcataaggagctattttagccaagacctgaaagaggtgagggaactagccatgaagacatctgaaggaagaacattctttgcagagagaacagtaagggcagaggccctaaggctgaaacaccgagccagcctccagccctccaaatagctctccagcatgaaagggccaaggccttcactggggacctcagaagggtttgggggctcggcaccttcctcccaaggtcaccacccccaagacaaaaactgtttcatcaggaatcctcaaagaccctcccaagtccacacaccatgctccgtgggtccttggcgctgccaggtgactacgaccataccaccctgctcccagaatgtaaatgaaagatcagagtgagaaaggattaacagcaacaccaccatgcttgaatcgcctccttgtcaggcactgcattaaatgtttcagatatacaatcttggaggagctgcacagtaactctaacatgcatactaatctcatctgcattttacaagggagaaactgaggctcagggcggttaagtaactcagccacgatgacccggccgcaataagagccaagatgcaaagtcagccctgcctgctgtgactctgacccccaccatactcacacagccaggacacagagccagaggggcagacagggagttcaaatctctttgtagggcagcaccatgctatcaggtcacctctgggcagtttcccttgccctgcagcataagaaccaataaggacttgtccaagagcgtccataggatggaatgggccagaaagaaaaacaaagttctgatgagaaggaccccttctcccaaagactgacagatacaagatgaatacaccgtgtgggaggcacccacgccctgctgagcctgcgaggcaaaggacagctacccacactcccatcacaagtcatcacccggcttaggggtgacttgtttttaacctgaaaggtcagtgttctacagcatagcacaaagtgcagatgtttccaccgaactaagaaacagtgtgggggctgcacttagcactggaactggcacatagtaaagtactcaaaaatgttggcagacattgggggtccttcccctctgcttgcctctgtcctcacgaggcttgccacctggtacagcatgtgtctgactggtgcgggcattgcccatctggctgggaacttcctgaggcaggagcgtactttgcacatctttgtattcctgtcgggagcacaggagggtgggccttccttgagagctgcttggagttcaagaacagtgaaacagagggctacaaggggcctggagccaccttgcatgacaaaggcagcagtgtcctggttcttgtccaccattatgcattcaccctaaatggaactcacagtcaacaccacatgaaggcatggggaatttcttactcaatgtctgccttgtcctgtagattagaggctgcatgaggacagggagcaagtccatcctgtgtgccagggtatcttcagagtggcccagagtagggcctcggtaaaccttgaattcagagaagtcagactgaagggaacaagcccttgaccccgaccccgcctcctgcaaggccatgtccaacatcccagagaaagcctaaccctgacccactgaccagacgcacttggacgcccagacacttctagaatccaggctgggccagccatgctccctcagagaggcccagatgtaaggcgaagggacaaagcaggatgcaggatgtgggaactgaaacccaccccacgtcctccaaaacacgcaacactcagtttctcttggcgctggggagtcaacgggaaaggggttcatgggaaacaaaaagtgggcagacagagctatgctcccctactttagcctcagggggcagagcttggggagaaagaaaggcagtgggcagaggagacgcaggagaaatatcctattgtgggaaaaccctctctggagatcagaggagccacccctggagggcctggacttctggaggaaagaaagacaaagagggaaacagggaatttccaagttctgctgacctcatgcccagatggtcagcggcagtccctggatgaccactgggcagacgggaactctccctctgatcaatgaggtttttataacttctcccagagagaggactcattctcaggatgacagagctggaggggactctccaagggcaatgaggcgaatcctgcattatcaggtgggagagagatgcacccagaaacactcaatggatgaggggctgcattcgaacatgacgatggcatgcactcccctctgctgtccacaaaccacgaggatgttttcaaaggggaaaaggaagcactgaccactcccctccatgtggcagtatctggagttcagagcccaggagtcctcgggcatgagctcatctgattctcactcacggcacaggcagtgcagcaaggcaaggccctgagcagggaaggccaaggtcacaaaggagtcaggatggagctgggaccagaagatccctgctctccctccaggctgcccacagcccatcctccatttcccttcctgcccagcaatcccatggcacaccacaggcccccaccacatcttctcagagtctctttccacctggcctggttccacaaactacaaatcagcaggtgctccaccagcagtgggactccagccccgcttgcccaaaccagaaacagctggtggtatagaagcagccagcgcagactttcttccaaaacaagacctcagccagcggggcctccacagcctgccccagaggggccctggggctgcccgctggaaccagaaaggcccagtttgggggcagaaaggggcccagacagacggcaggtcaggcaacaaccacagaccgtgaagatggaagtgatgctgctgaaaccgaaggagccacccactagcaggcaagcacttgtgggtggcagggaggcagtagtccccagggctcaactctcagccttaccccagaaagagaggggtatgataaagactacattcagaattaaatttacattctagcttttgctctgaaatgctttggtctgtcagattatcttcccattagcagtgttctggtggctgggtaggggggtggtcccagaccccccaaatgatattcacttgcatagccactaacatttgcaaaatacttcatagtgtcccaagcattgtttttccatctgattatcacaacagccctgggaagaaggcagggctgatacctgcctgatggataaggaaactgaagtccagcttggggacttaatcagcccaatttaatgcctttggtcactggctgcatcctggggccagctatccctgcaaccctggagcaggtgatgccctccctggcccagagggaaaagtgtaagcaaatctctggtacagggaggtggaaggtcatcgaggccaacatctacctccccagcagaggtgagggctgccagggatgctggcaggtgggctggcagagggggtatagggaaggggtctccaggaaagacggcacagaacagaacgtcagagaggtctattctagtgtctactctgctgtgtatggaaccatgggctcattccctcacatgcaaggggaggagcatgggccacacagaaaccgggtgatggctaaagctggcctcaggatcaagaagacccaagtctcaggagctagcagcaagctgaggaaagagagagagccagcaccatggaaacatcgctgccttggaggcaggaagaaaggtccacacagggaaagtgctcaaggccaaccttgcgaacacgaggcctgagagggggcctcacctgcactagcctcagctctgtccaccctgtgggctgtgaaaccctggagcagccactcacctttcctgagcctcaggtgcctcatctgtaaagcaggagtaataatagaacctacctgatagaagatcaaagaaattaaatgaaacaatatgtgtatagttggaagggaattctcactttctactttaggcaatacttcctgattatctgatttaacaagaaacacatctttgttttataataagatttccaaaataataagagtatacagtaactagctcagcatttgacacacagcaggtgcttaataaaaggctgaggcaaccccacaactgtgcccagcttatctaagggccaaggctttccccatttgttctctcctttaatgggattttaggctcttccgtcagctcagtaagctaggttctggcctccacttattctctagtgacctgcatatcaccatttaactgtggttaagcagggtgcctggacacaccatagctagtgaacatgtagctataagaagcccttgaaccacgatgccacactcaccaacaactgggaatctgagcctcatttcctctgctgtaaagggcaatatcctgcaattccacccaaggatgaaaggaagtgagatgccatgatatcacattgcagacataaacaaaaaactgtccacatatttgtgttatgatgacctccagtcctccccaaccaatttccaggctggggaaactgcagcctcaggtccatccatcaaaggccgggttggatttttcaggcagtgaaactactctgttcaatactgtaatggtggacacctgccattccacatttgtccaaacccatagaacatacaccaccaagagggaacactgatgtaaaccatggactccgggtgacagtggtgtcaatgtagattcatcaactgtaaaaaatctaccactctggtggaggatgttgataatgggggaagctatgcctgttaggggtggggggggcgcagtatatgtaaaatctctgtaccttcttctcaattttgctgtgaacctaaaactgctctataaaaaataaggtctttaatttaaaagagaaaaggaccaggctgggctctcctgatggctgtcaggttcacacatgagtgaggacacagcacatacttgagacagtgtgtattcaaggaccgcaccctggcatcctcaccaacaaggagcccagacttaactcctccatccttgcaatcaactgagcaacaatgaggctgcagacacagagtctcatatagtaacagctggggcgccagaactgtgggatctagtcaaggtacactagggcgaacatcttaaccctcactaggcctcagttacctaaaaagagggagctgcaaaaatagtaataacatggggggttgtgcgggataatcattaaggccccttccagttctaacatttcaggatctgaaatttattagcactactttctttaaccttctaaccttaagaaggctccaatccccagctccaatcccttctaaggcccaggtggatttccctaacccatcagtcctcccataagagctttcataggtgctatcccctccccgagggcagtcagagaccctcagctgacatccgcagccctgtgccaggtcctcccctcctgcctaacttgtaccaggctctggccaagcctgatctgtgttcctcaacatggcacacatcttcccatgtccttcatcctcccctcccgagtcacccacaaagaaggccccactgtctccactcagcctccgaggcccagattacacaccacccgctaaacacctgagccagaattcacactgcaaaagaggactggagagcacctaactaagctggagagagggtgacagttcgttaggcgctaccgtatgccaggtgctgggccgcatcatgacgcacatgacctcattttcttcttgccacacagatatggaaattatcatccacactttccagcaaggaaaccagtcgacgcagctacatggatgaggaagcagactcagagaagttaagtcatttgcctgagaatacacagctggttagtggtagaacaaataatgcagcctcaatctgtcagattccaacatcagtgccctttccactgctctacactgcctggagaggcggcaggctgaagctcagaggtgggaaaccagacctactttccagttctccagaacgtgccccaagttcctagcccctgcctttatatgtctctagctttatatgcaaccaggtggcaatctgccccacatcacctgcagtcaacagggtttagaatctcaggctggaagggagctcagaggacattccatcctgtgcttacccagtcctctgaggagcccagggactccagctggccaactttagcaatccagatctcaccaacttcctccccaaaacaattcctggggcagccagcactggctacagttaggctgctcccagttctgtttccactggcccttctctcccctctgtggtcccctggaataaggaacaagatgcccatcttcagcatgacagccagccctgaggacatttggaacctgcagccttctctatactgttccacatagggactgccccccctccagtcccccaccaaccctctaccccacactatctctagttggttctagcactggacccaacattccaggcatggtttgcctgaccaaatgcaggctttcacctccacccttttaggtagtatattcctattgagggagcctgggtatacatttgcttttcttacagctgagtcacctactgaagaatgtcctttctcaatgacaacaacctgcatgtatgcctaactggtgagaacaaagttctcatgtagaaacgtgtgcttgagggctgggtgcggtggctcatgcctgtaattccagcactttgggaggccgaggtgggcggatcacctgaggtcaggagttcgagatcagcctggccaacatggcaaaacccagtctctactaaaaatacaaaaattagccaggtgtggtggcgggtgcctgtagtcccagctactggggaggctgaggtaggagaatcgcttgaacttgggaggtggagattgcagtaagccgagatcacgccacagcactccagcctgggagacagagtgggactccatctcaaaagaaaaaaaaaaaaaaaaaggggtgtttgaggaggtgtgagttacctaagggggcagaagtaactgattgattcagtaataccctatctaggaatctagagatctttgcatcagtacacagaagctggacaaaaatatgcactgccacatgctttgtaatagacatttttgctattcttgaatgtccatcaagaagggactggttaaacaaaccaccattcattcgatggaatactatacagccatcaaaaagaatggggtagattgcttggcaatgatacagaaagatgcccataaaatacaaagcaaagtgcagatttatatgtgtaacaggatgctatttttttcaaaaacacattgtgtgtgtgtgtgtatacatacggaatcttaaatgtgcatagaaaaaggcctggaagcccagtgctttgggaggccaaggtgggaggattgcttgaggccaggggttcaagaccagcctgggcaaaaagcaagaatagattctctattaaaaaaaaacttttttacattagcagagcatggtggcacatgcctggagtcccagctactcggaaagttgaggtgggaggatcacttgagcccagcagttcaggctacagtgagctatgatcatgccactgaactccagcctgagtgacagactaatactctgtctcttaaaaaaaagaaaagaagaaaagaaaaaagtctcaaaggatacataccaaactgctactagtagactgctctacagaaggacctcggtaaggaactaaaaccaaaagaaacttttattttacctatgctattttaactctttacatgggaaatctagtcctgttcttatacaattataaaattagtttttaaatacagtagggacagaggaaggggaaaggaaggagagagaagacaactgtcattttttacattatatcttttgtactgcttgagttttggggggtttttccccaataatcatgtgctatttggtaattttttttaaagggaaattttaaaatatttttctaaaaaatttaagtgagctgagtgcagtggtgcatgcctgtagtcccagctactccagagacagacgcaggaggatggcctgaaaccagagtttatctaaccctgtaactcccctgcctccaagaggtaagatgccaattttggggaattcctcttatacaaaatatggtggaaagagggtttcacagattcaaatcctggctatgatcccttctcgaatgaccctgggtaggcctcactttccttgtttctccctatggaaatgttatgaggaccaagtaggaaccatagagttctctgtaaaccttaaaatgctacccagacaggagcagtaatggctgccaaggagctaggaaggaaaaggggctggacaggggctgaggtactcagatgaaagccaaagatgccttgtgttaacaacaaaaagctgaaagctacctaaaatgaagagaaaaatgaataaatacattgtggcaatttcctatcaggaaatactatacagcagtgaaaaaagaatgagccacagctggagatacgaacatgaatgaatctgggtctcactctgttgcccaggctggagtgcagtggcatgatctcagttcactgcaacttccacctcccagcccaagtcatcctcccaccttagcctctcaagtagctggaactacaggcatgcgccaccacacccagctaatttttgtattgtttgcagagatgggttttggccatgttgcccaagctggtctcaaactcctgggctcaagagatccacctgcctgctctgcctcccaaagtgccagtaaggcatgagtcaccacgctcagcctaaataacatttttaaacataaaaaaatactatgtattatttagggatgcacacattaaaaaaaaaactttaaagaaatgcaagaaaaaaaccccactaaattcagaacacttgtttcttgttggtggctgatgaaggagaaatttcaactgattggaaatgtgttatttcttaaaccagatgagtgagcatgtaggtgcctgcgtgttaccctcggtatctgagagactccttcaatttttcttttttctttttactgtattgtttgctttttttctgcttcaacttttattttagattcggggggtacatgtgcaggtttgctacctgggtatactgcgtgatttgggtaggggtgatcccatcacctgggtactgagcatagttcccaacagtttttcaactctgcctccctccctccccactctagcagtccccagtgtctactgttgccatctttatgtccatgaggacctgatatttagctccacttataagtgagaaaatgcagcatttggttttctgttcctgtgttaatgtgcttaggacaatattttctaaaagtctatgttgccagtttcctgaggaccagatcacgcaggagttgcacctgcagagacagaagtgggctggagagggaccagggctcctaagtctgctgctgaagctgactatagcgaaggcaaaggacaagtggcctgaaggccaacagagagcctggccaatgctctgcccagtgggtggagactgagccaaaggcccttgactcatagggcagtcccatacctgccctggcctctcagcatgactccttggtgacacaactcccacagcacccacacacctacacccacctaccccacacacacacccctgcctgggctgcccggtttgtccactgtgtaggtgctcaaggacgcagagctcctgcctctcaaggaacagcctcagggtgaggtccctgggagagaagagttcagctctgcccagagcagccctcagacaaacagccagctgctgctcaccagtcatccattccaatctgaagagtgactgtcctgggccagtcatgggaaaatcatcaagaacttcccacaatggtcatggtggccgccaaggtctttctctgggggttgggagctgtgctcccccacaaaacaaggggacccagctgccctgtgccttcctgtggcaactctctggaggatgcctggataccctccctacagacggccagggataggaggggcaggcactgcaggcatgtgggggcatagcagcaagaatctaggagggcaggcacagcaaggcctggcccagagggaaaccaggagctgccagagccaaagagagggtgacccaatcattggttgttatagagtttttaagacttggaagagaatgccctgagatgccagagagtgaaacattttcattctaaagctgggaaaccaaagtcggcaaaggcgaacagacgtgcccacagccacatgggacagcagtggcacagaagaaatgcacacctcgtcctctggtggccactgtgcactctcttaccacaccatgctactgctcaacctctccccctccctcacagtggtcaggtaagcaatgagggaaaatgatggaggtgagaaaggaagaacccgggctgatgtgggcccacaaaagaaagaagtctggaataacactggaaggggctgcctacgaggtggaaagcgccctgatcccaggggtcggggtcacgcagaggggcactggggctgttgagggaatgcaagccaggtgtcttcaaagccccacccacatctgagtttccgccactccaaacagggacagatgtttgagacaaagcaaaggacaactcatccagaggggacacagcatggaccacaagtggcagagggttgaaggcaagtgtcttagtctgctttctgcaactattctgttgaatatcacagactgggtaatttataaagaacaagtttatttggctcatggttctggatgatgagaaatccaagtgcatgacaccaccatctgacaagggtcatgccaaggtggaagacagaaggagaaaatgagtgattgaaatagagagtgtattagccaaactggccccttttataactaacctcccgtccccctaccccgtgatagtgacattaatctatttatgagggcagagctgacaatccattcatgaagcagagggattacgtttccaagatatgaacttttgggggacacattcaaaccttagcagcaagttatccagagcacagaaaatcaaaccagtctcatcatcttctactggaatcctgtcaatagcctcatgattagcatcattaacgataatagcagcgaccctgtaccaagcgcttaccacactggtggcccgtgctgagtgcttgccacacactatcccattaattcccaccattctaggaggtagcattgacgtcatacagagctgacaggtgaggatgcagaggcccagagtgacagacacggcacctacccaggtctgccaagcactgaatcatgtgctcttcaccaggggtgctcaaggagcagcccggaccagcggcactggcaccaccaccatccactggatcggatgctctggagttgcagcccagcaatctgtgtttaacaaccaccctctacctccatccccaggattgtgatgcatgctcatgtttgtgaaccaactgctctgaccatttcccaatgctgctaaggagaaaaatcaacatttctatgtctggtatcaaaatcttttagggtctttcccaggccaactggtcaattctcccaaccgaggagaggctgattccagttattgtgactagtctactaagttccagaagagacccaggttccactctgcactttgtcatttttttagggtctgaccttgaagtcacttccctccagaagacccctccaaccatctggtgcccccaaattactctgcactccagttatacctatgccaatccgactcatttggcacttactggcacacaatgcctttcaggtcacactcatagcacatctccccatttgaccaaaagttcctggaaggcaaagccagctccttacgcacctgtgcatcaagaacactgcatggcactgggcacaggagtcatcaggaaatgatgcttgggagagcgctaggagagcactctggttctcctcctgccttctcatctctaggccttaatttcctcatttgtgaaatgtgccattattctactcattcactgaacaaactcagaagagccatccaccaggcactcttctcccgctacagaaatacactcgagaggactaaggaggtccctgctcacccccttctattctaggaaaagagaaagacagtaaacaaataaacactaaaaataacaatttgccagacactaagttctatacatatgctttctcattcgcaaataagattctttcatagcatgatacacgtatgagaaaaataaaatagtaacgtgacagaaagtgaaaaaaggggctgctttgcataaaaagatcagggaaggcccctctgaggagctgacatttgagctgagacttgatcgataaggaaaaaccagccatgggaaaaacggggaaagatgtcctgggcagagggaacagcatgtatgaaagcctaaggatgagaacaagcttggcttgctggagggggaaaagcaggccagcatggtgtgaccaaatcacagcgggtacaggagtaaaacagtaaccagtgggttggagagagaggcagacaaacaacctcctacaacgctgcctctctcaaatcaggtcggcctgacccaaccaggacatccgggccccaagtcacaggcagcactgggggtaagggtatgactcagaccccacagcttcctggggccccgaaaaaactggtgggggtatccaggggcaggcatcaaccttcagcatgagtgccatgccatacccatggaacacccaaggctgggagacaaacgtggttacataagcgtgtagaacactgcacactcccagcggcagcttccagaggggcatgatcacgtgcttccatgaagtgccagtccctgatcacattattttcccgggacacagccaggacagcagccttggtcaggggaaagggaacagggtccaggattcaagcgttgctagtcttgggaaagccttaaccttctctgggcctcagtttcctcatctgaaaattaagagttgttagaaagattaagtgaggccgggcggggcggctcacacctgtgatcccagcactttaggaggctgagacgggcggatcacttgaggtcaggagtttgagaccagcctggccaacatggtgaaactgtctctactcaaaatacaaaaaaattagccggggatggtggcgagtgcctgtaatcccagctactcgggaggctgaggtaggagaatcgcttgaacctgggaggcaagttgccgtgagccgagatcgtgccactgcactccagcctgggtaacagagtgagactctgtctcaaaaaaaaaaaaaagattaaatgagatacggaatgtaagcactgtgcctggcacatagtaagctattagcattatcagttttttcactgcctcagtttcttctgttgcaaaacagagaccaccacggggatgctgagtttgtactaatattctaccctcctaatacaattctaccctcctttgtcaaggatttttttaaaacattctgagtccccttttctgacctctcatcagatgccgaattcccctctatcacaccccattgtttggaaaatgagtaagtgctgattaaatcccattttgaccgtactgtgagaaaaaaatgatgcattaggaatctacacatttccctgcactgtcattctgcaagggggtggggaaggacgttgctgattcttctgcatcatccacaaaagtccctccctccccctaccaaaacacaatctctcacccagtcgcacaaaattcccatctgctcctgtacgcacaatgaatgtacaatgcacacgtgcacacaaatgtcctacagtggaaagctcagccttcatactccatccccagaagcactcctggaaactcatccatcctgcacatgcacacaaatgcctccaacaatgtgcatacaaaatatgttcaacagaaatagtatagtaggaactctggagccaaatgcctgagttcatatctgactttgcaactcacagctgtgtgacctcaagctccaagtacctcggtttcctaaagtataaaatggagataataacaatattaatgtttaggatggaagtgacaattaaatgagtctaatacacgtacagcgttaagatcagcacttggaaagcgcccaataaaaattattattttcctcctcgtgacatatgtacactgcttccacaacttgatacgaaaactcctgacgccgcgtaggcaactcgtctccacaggatagacacccaaagggccgcagcgccgcccgcacccggagggtctgcgctctctacaaccgccccacgccgttcccaggcgtgctaccccgcgcagtgcgcacgcgcgccccccaccaggcccagcgccaagcagggagtagcggctcagcccggcttggccgctggcggagacgccccgggaccccgcgcgccgggcctgggtgcacaagccaccttccccagctcgctccccgccgccaccgaggctctggacgatctgggcctggcctcccttcctcccctccatccccgctccgggccggccggcttacccgaggacggggagcttggggacacagcgccccgcttgctgcgtccagccccgaatccagggacggggcagcggcccgggcaaggctccggccccccgtagcactcctagggctcctggacgggggcagggcacccgggccgaggacgaggaagtgccgggggcctggccgggccgccccacccctgggaaagtccccggagactggcaggccactcgcccaatcgcgccgcgcgctccgggcgggcccgcggccgcctggggtgggaccgagcgaggtaaacaccggctgcctgcggttccgggggcccgcggtgtctctcgtcccttcggcggccttcccctctaggagcgacttccctggggccaccgtcccgggcctgcgcggcgccttgccgcactcccagcgccggaagcccctgtcgaaggcctggggccaccttgaaagccggaatttcagagcggaggcgagccacagagaccacccagccccttccttgtgccgaggggaacacaggccagaacagggaggggacctgccaaaaggcacgtaagcatttggccctaagccagagctggagctcaggcccccagagttccgtccagggcactccaggactcttcttaacaaagctatagaaattccgagctgaaaagacccataaagactctaccgcgaacattttttgctccagacattgtaaaggattcccagacatcgtaaacgctttgctccagacattgtagatgctttgcgtgcattattttcttcgcacaatcacgctagggaggtgggttttactaccttttcttaaataatatttgagtcacaaaaaggttagatgacctcagtaaggggctgaatcaagattcaaacccgggtgggcaaatccagaggccgccttccaccctacctacttatatgtgggctagataatcccaacagactgggatttcctagaccggtaaggaacataaacttgctttaagggtaggaaagctttttaaaagcttatccttttatttttaaaaagaaagaaagctaaattttaattccaaaaagtggaaggtctaaccttggaataaagaacagctctttaaactaaatatagctttatgaaaaacctattgcaaaagacccatttcactggtactgttgaaaacttagtcattgacaggccctcatcctcaaaaagaattaggggaaaggatttggggaactgtttaatacacaccctcattttacagaagagagacccatcaatcaactgtgacttcgcaataatacacacacagatacttgcccaaattatatacctaatctggggattctcctataaggctttgtaacctcctagggttccttcagttaattcaacggtgttatcagatcttcaaaacgatattcattctagtttaattatgaaaagaattacacttatgccttgattcagaagggagggagggaggaagcgatgcaaactccaaagcaccactgagtctcaccactgggggatcctacagagaaactgggaatcctggccctggtttacatagcagctcccaggcatcgtctccacccatcaggtccgcacctgccagttttcttcctgctctttgtgcctgtacttcccaattctcttcctgcagggctctcttcctattcccaacccacatcttctccacccccaccctctacccactgaaaactaaaatctacctaaaaatggctggtctctaattacttgcattttgtttccacactatttcagctgtttttatagcatgtctggccttagccgggcagacagtttcatttctcaaagtgtccgctgggaattctcaagcttgacataaaaaaatggcactcagtcatctttttgtctgatttcctagttctggatcctttttcttaacagttccaatttgtgagaaaactcatttatttataaagtcgtgactgcccccacctcttccattctttgaagtcttggtttgtcttcaggacattccaccctgttagagaccatggagcccatagataacaaacccctatttgacagataggtaaactgagtcctctgtctagaaaaggacttactctaggccacacacattgagtgacacaaccagggccttggaatccagggccttggctcccagtcctgtgtgcttggtccactgtaccaagttgtctttacaatgacatgatttttctcactgccttgcagaaaacaccactgtcataaacacaggctatgaattgagctaatgggattccaatccctgctcagccacttactacctgggtggcccctctaagcctcaggcttctgtctggaaaatgggggataatatacctattcctcatgtgaatcatgaggataaattggacaatgcaaataaagcccaaggctcagcacacagtaggcattcaagaaatgatagtggtgtctagatgtgggctgcatgcattgggtagaacttggctcttaaactcagcaatgcaacctcaccaggcgccatcccaccatacacatcctctgtgagaccctagcctctaggagcatggcaggaatgggagacaggccccctagcctggcactgcctgctaccctgtggtctggaaggggatttccaagtcaagaagctgggcctgacgctgggagctgagtgactcaggcaggtgcaacctcttgttcttccagagtaatgacaagcactcgcacaaagccacacccagaaggagaatcaaactgcctttgttttgttttgttttatttggttttgttttaaagcacgcaacttctcgatctcctttctgctactccctcctccaccacccctactgaggtagctacagagtcagacccaaatacacatttgaaggtaataaaaaacatatgaaaaatccatctataaccaacttaactctagagcaagttccagaagaggggtggaggctgcataataaaagcattaaaaggtaacatgtatggagtatttgctgtgtgctatctccgcgcttttattcataatttgcctcccaaccagcttatgaggtcggcaccattatcatccacatttcacagatgaaactgaagctttgaggtattagatgacttgcccaaggtcttacagcacagcaagtaaccggagcttgaagatccaggctcttaaacgcttaacactcttaagcatcatgctccaaagtcttgccagctagcaagacatagaactcagagtgccaggcttgaagggtctttagaaatgatcaacccaggcagggcatgccgtggctcacgcctgtaatcccaacactctgggaggctgaggcgggtggatcacctgaggtcaggagttcaagaccagcctggccaacatggtgaaaccccgtctctactaaaaatacaaatattagccaggtgtggtggtgggcgcctgtaatcccagctactcaggaggctgaggcaggagaatcacttgaacccaggaggtggaggttgcaatgagccaagatcgcgccattgcactccagcctggggacaagagcaagacttcgtctcaaaaaaaaaaaaaaagaaagaaagaaatgatcaacccagtcttttcattgtagggctggagccacaccaagggccagagagcggcagggacttgcgggaggtcttacgttgagtttgtgattcatacataggacagaacccaagtatccttctcccagcacagtgctgtttccacataccccactgataggaaatggagcatctaaatcaaacaagaacattcctcattgcattaggagaatgagtgaatcagggccttggctaggggagaatggaactcgggagcagctaatgaactaggaaaagagcagccctgggtcccttccttagatccataacctgaggcaatctcaggagtgtaagaccctccagtggattctaggtactttttggtgctgggtgtatgtgtatgttaaagagagattttggtgatagttaaatgagaatgcatatcaagcacatgatattgactaaaattgttctaggcaattgtggcagtttttggtaaaaagtaaataaatgagcagggtccatggtcccagcttctctcctcagcctaagaagacatttttaattctctctatccagctcccaaatacctgcatgaggaggtagttgtatcttcagaggttttcacagtcattcagcaccttaaggtgaatgaaaccatttcatacccacaacttgcccatttcccaagagaccgtcacgcagaggataaggtgtgggttctggcctctgggcttaaatcacagccctgccacttacaactctgtgccttggtttctttatcaatgacatgaaggctgtaactgtgcccaattcagagggtggtgacaatcaaatgccacaaggcttggcctcagtgaaaggtagcgatgatcattatgatcatcaattctatgaggcagcagggattgcttctctcctttttccaggaggaccccaaggcctggagctggggagcagcttgccctagacatcagactgtcttctgaggagctgggcctggaaggcattgctgctgacttttctccaggctctttccccttttcttccttctctatcccaactattttccctgtgtccctgggctggcctgttacacttcagtttctagggcaccactggaggagaggaaagggcaaagtgacactgggggaaattcccagcctcgtcacatacgtggcctagccaggcccctcccacagttcctaggagccctgggtctccccactccagcgtctctccccctggcctctccgtctccaggtcagggtgtcaagctggatctgggcttgcatccagggttgccccttgtcatcctcctggaagtgggaacaggtcagccaggcccagcccggcccagcctctcaggaagttagacccacaaaaccggagcatttcctaatcccgggaagccctaacagggccctgagagcaatcctctttcagtcccacccaccttcctccctgtcctctcccacaccctcttcttctatggcccctccccgctctccctccattcctctgtagcctagaagccaccgtcagacttggcctctgttccttgcctcttctagccagggacttccctaggctgtgaaaagatgcctggggaggggatgaagagggccgtttggatgaactggcctttcttcatcattcctggttccagagtttcctcattcttatggtaacatttatggaccactgaggatacaggagtggaccaatcagacccgcttcctgctctctcagagctcacagactctcaggagccatatggggctatttaaataagtagaattaaactaaaattaaatagaattttagtccagattttctaagtgatcaaagaggaagctgcgtcagctgtgtctgcctgcccttggcccactccctgtgccctgggctctctgttacaggttccaccacaaaagagtccagcggccctagaagcagagcaggcaggagagaagcaagagatccttttgctccagtgttaaggagggtctcagcctccactatgttcccctggaggcagcgccgattcttggcctcttcctatctagctgtagacttctaaagtgcccaacacacacttgtaccctctccatcaaaaattcactgtacacacagatacacacacaaatacacacagtcaccaacttacacccacacagaaagacacatacacgcttcagggatctgacacaacacaggcacacattctcacacacacaaacacccacatccatattcacacttgcatacctcccttttcttgagggaataagacaaaaataggctttgcttttccctttggaaaagctagtaacaactagagagaaaaagactggccaagaaggcaaggccagaagaagaggggcaggaagaaggaacgagatgggggagagaagacagtggagaaggaggctgggtgaggagcaggggctgggagcccaagacctgggtgggaagagcaagctaggctgagagcagcagaccctggctggcaggacatgggaggccaggtggctcttggcacagagctgagggtgtctgcttgccccagcacccttgtgcggtgggtcctttcccctgtcctggcccaccggcccccatctagtcactcacctggggaagggcaggagaatacgagggtgtgtgcaccaggggcggctgtccctatgaaggctcctcggctcactgtgcttctgcaggaaggagggctgggctgagctgactattaggcaggaggggaattccccgagatggaggagccgccaccaggcagccccgcaaggcccagctgaggccccatcctgcccgctggcagagcagagggcccttatttgtcagcctccacctgtcacttcccagactggctgtcccgtgctgtgaattccagggagttggggttgggggggatctggggagaagagttggaagcctgatgcttcctcagctgggctgggaaaaggcacccgagaatgggctggggcaacctggcctggcctccctagattgtcctgaagacctccatttcctccttcgcctaaggtgggggattccagtgctcagggccctgaggaaactgccagatgcccagcccacatcctcccaccccgttcctatcctacctgttgccacttactctctgaggcttctccatccatagtgaagaaggggcccactccttccttggtgcat

SEQ ID NO: 2822 - DNA, 57244 bp, Homo sapiens
  source 1..57244: mol_type = genomic DNA
tgttgatcttcttcaacttggatttatgtccatgattcgtgcaaatagctatccagggatggacagccaccctaatctgggcttctggcaccacaggcctccagctatggggtccagggtctgaacctcagggcctggcagcttcaggctggcgcccctcggcggacgtggctggcatggccttctcccatctgtgatggcttcagcaaggctactgtgagtggtggtggagagggccccagagccagaatatccatcattctcttctgttctggagacaaacccacacttcccacagctcctcacagaggggtaggggtgtgcgtggggcaggtcctgctacagagcttgaagcaaaaattaaacacacacacaaattggtcatggcaactagagggcctgaaaccacttccgggaggttttgaaggaagggggtcttggctgcctcccactcttaggattgctgctcctggaggcttctgcaacggatggtgggtcaaagccggatgaggcctctctccactcagcagcagggaaggagtttttcccagtcactcccagcagagtacaaatgaaagccttctgggtggagcctccccagtcctgtaaacagctcagttcagggactggtgtacaagctggccacccatctcagcctctcatccagctgaggctctggccacaccgtgcaagtggcttctagtttcttggcaatctgagatcagctggctctgcaagatgaaggtggagccaaatgacacaatctggtctcactgaggcccctcacggtcattttttggagactctaaataaacaaaaattttgaggacttcatgattatgtggtagagcgagtttcaaagtctcttatggaatgcagtgcaggaacagtgaaaataacagctagggttactgggtgctaccaagtgccagggctaagtaccttaagtacgctggtcatgtaatcttcacccagccctatgaagaaggcaggttattatcccattgtaaaagagggaactgggacactaagaggttttaaatgacttgctcatagttccaggtccaggaaatagtggggctaggatttgaacccaatctcaaatcctggagcagttctggggagggagcccctcccattataccaatctctaccactcatcaaagcagcctccaaggggctccactgaacttgtagggttcttcagggaaaaacagaaaatgactgagcagcccaatcccttcttccaatcaccaaatcctccaaactgcaacccctccaaggtgtccgtcccatggcctctactcacacacctgcaaagggacactcgccacctcccagagctggctccatttctgcacaactgtgtcccttagaaagaaagttcctcttcatgttgcgatggacttggcctccctgtcattcccacccactagttataattctgttcccagaagtcccacaggcgaggtggtgccttgtgccccatgagagctctacagggagcaatggcagtcgctaaggtcccaatcttttcacgagtggacacagctccaggctcttcagcctttcatggtggacaccatggtcaggggagcttttcaaacagaaatatggtcatgccactctgctttaaaaatgtccagtgactacacattatgctgaggataagacccaggcctcccaccatgctccgcaggcctgcacggtcaggacccggctacgtcctgaaccctgcgttgcccctctctttccctaccttgttcttggctccagccacgctggtcttccctccgatcctcaaatcagctcccctacttcccctcctcccaccacggcctctgcatttgtcatgttctctgcaaaagcatcctccacccctacctctccacctagctagtgtcactcattctgagagtctcaactcaaatgctgcccccccggtctaggtcggcttcctctgctatctgctcccacagaaaccggctcttcttcctttagggcacttgagtgcagcctgtttgtgtggtgtttgtttattcatttctgcctccctcattagacattacgctgtataagggcaaggactgtatctgcttctgttctctaggcatccatagcacctagcacaatgcctggcattagataatgcactagaatgaatggtttcagcccccctcactctgtggttgccattactctccattcaacactgttttggaaagctgggcctctcctccaccaagagcagaaactaacgacatcacccccaaactcaggcaatgctggcagataagatattatctcccccagggaggaccaagactcagtattaggggctcacctggttctgtaggcctggctgtgggagggtccatcacttgggagctctgatttggatttcgaacccctccacagggtagacgccaggtgtattccggctgcgacaaaactggtgcttaataatcaataatcacacccaaaaattacaatagcacctactgtgccaggacaatactaaatctgtattagtcaagtataattgaatctttataacaacccaggctggcactcccatttcacaggtaaggaatctgaggctcagaggggataacttgctgaaggtcatctagcaaggagaatggctaagcttggatttgaatccaggtctttgtaaatccagagccaatctcttaagcgccatactatatactctggtgtttaaagatgtgtaccaagaagggtcatatgggagaagctgaaaaagaggccagccaggaggtttctgtaatggtccaggggagagctgggatgcctaaggtggggctgtggcagaggactggggaaaatgggacaagtgacagcagatctttggaagaagaatgataagaagggaaaagaggccaggcgcagtggctcacgcctgtaatcctagcactttgggaggccaaggcgggtggatcacctgaggtcaggagttcaagaccagcctggccaatatggagaaaccccgtctctaccaaaaatacaaaaaattaccgggcgtggtggtgcatgcctgtaatcccagctacttgggaggctaaggcaggagaatagcttgaacctgggaggcagaggttgcaatgagccgagatcgtatcactgcactccagcatgggcaaaaaagagtgaaattccatctcaaaaaaaaaaaaaaaaaaggaaaagaaaataaaaaaagagaggagagaagaagaggaggggaggggagaggagcggaggggaggggaggggagaggaaaggaaaggaaagagagagaaacatggtgaggctctggaacctagttacacgtggaagttataagaaaaagcaaacccaaactctgatacccatggcctggggcctggagggagtcctccttcccaccctgcactcttactcagccttctccgtcctagaccagtgaccctgaacagctgtggggcagccctgcgggactgtggccagatccctgcccctgggtagcagcccagagccaggccctggacacccacctgccaccacggtgctgtttagttcagaaggatgcagtttctgaacccctcacttaaccttcctctctggaaggtgtctggggcagcctctgtgtgtgccctggagcaagggagggacacagactcaccagatggaagaggcgcgagttggggagtgggggcgggtgctccatggccatggggggaggggggtagcggatctgggaccagtcctcgaagccatggtgtggcaccatggctggcatgggcgggtaggcgtaggggtaggccccgcagagatgttctgggtggggctccacatggtaacgctctcctgaggcctgcaagaaaggctgacgtctggctttggcctgcaacaggctgcaaaggacacccatctcatcaccctctaaatagaatgttagctctctgaaggctagcaggctgggtaccaaaggctggtatgtggtcatgaaaggctgctacatgggtacagaaatctggatacatgggcatagaaggctggatatatgagcatggaaggctgcatgggcatggaaggctgggtacacatgcatggaaggttgtgacatgggcacagaaggctggtacatgggcacggaaggctggtacatgggcatggaaggctagtacatgggcacggaaggctggtacatgggcacggaaggctggtacatgggcacagaaggctagtacatgggcatggaaagctggtacatgggcatggaaggctggtacatggacacggaaggctggtacatgggcacggaaagctagtacatgggcacagaaggctgctacatgggcagtgaaggctggtacatgggcacagaaggctaggtacatgggcagtgaaggctggtacatagacacggaaggctggtacatgggcacggaaggctagaacatgggcacagaaggctggtacatgggcacggaaggctgggtacatgggcacggaaggctgggcacatgggcatggaaggctgggcacatgggcacagaaggctcatacatgggcacggaaggctgggtaaatggacacagaaggctgggcacatgggcacggaaggctgatacatggaaacggaaggctgagcacatgggcatggaaggctggtacatggacacggaaggctggtacatgggcatggaaggctgggcatgggcacaaaaggctgggcatgggcacaaaaggctggtacatgggcacggagggctggaacatgggcatagaaagttggatacatgggcacggaaggctcatacacggccaaagaaggctagtcacatgggcacggaaggttgctacctggacacagaatgtcaacagtgatgacagctaatacattgtgggcactgcctctgtaccaatactgctctaaggcttttcctgtattactcatcagttagttagcagaggatgtccccacgcccgagcacacactgtgcatccatcaggctagctccatgaggaaggtaagaggatgtcagtgctgctacctccctcaagcctcctcacctttgctttcctcttctgctgtctgagggcttctcttgccttctcctcatctttgaatgcttttagctgagagaagaagggagggagaaaagactgtcggcacaggtggtttctggccaggcctggatccagggcctaaccagccacgaggactgaccggctgatgcttccctctgggccaccatgcgtgggccagccccgggaaagggccctgagggcggagcacagcccaggctgttgctgcaggccacctgcttgtcacagtggtctgtgcacaggtcaagagggttcacgtgaacctcgctgcttctctgctaacatcttttagttccactctgggagagtaaagcccagaactgactgtggaaagtcagaggtagagatatcttagagtaaaactcgtaattgtacaaagaaagagtcagagaggggaagggccttgccgagctcaaatatgattgcagagctggagagaagcagtgagggtcctgacatccagcctcaccagggccctccaatccatgccccctctccccacgaggacaggccagttgcccttcctgggtccagtcactcttacctgggcatttgacagggtgacctgggcctgcagcttctccacttgcttcttcagctcttccttctcctcattcatgcgctcacgatcactgcgctccctctggaagtcctcctcgaagatcttcacctggtgtggagggagggtgaagagagggagggggatggtcctgagtggggatttctcctcaggcccagactcccatgcctcctgctggggtcacagatggcagagctgggggtcgccatggggagtgggacagctacacctccagcctccaccttaacttcaaacagagtagttctgtgtccctctatcttacattctgggcttcaagctaggactttatttgaacaaaggatatatggttttaaaaaaacgttgaaagccatcaaccagtgcaatcctttcactccgctgagacccacaggggcagtgatcacagaaccagagtgtggtgtagaccagagtttggatctgctggttctgagggcagagaccctacaaactccgctagggctccagggtgccctggcagaggtgggttgggtggggcctgcctctgtctcttagcctgtagtttcacatccttagtgcagatcagctgagacactggctaggttcaaggcagtttaggaggattaaatagcacagagacaatgggagagccacaaccttttcgctttctttcaccccaatccttctgtgtccctcagggctagtaggtctttaataccattttagtacctgccaatctcctttaaataaaggagaaaagaactccagttcagagtcttcatttggcaagagtatccggctagagtttaataacattgttctgtttttattgtttattgcgtacagttactttctacttgtgacaaataataaatggttttttccaattacagcagtgatataaagctcccttttaaattcatttatttagaatttattttttaaatactaggtaaataatagcacgtgtggggcatagagatggctaaatcataaaggtggtagaggaacgacttaagctagggttatggtgctggaaaggataaacctagagccagtggggggccctggccaatggccagaaagtggattactaattacaggttccatgtgattccaagccgtctgggccctcaggaaagctccagctcccacagagcacctcccacctgatttcctcccggaagcctcacctgctgtttcagcaactcattctgcgtgaccagctcctgtttccttaggagggcccctgctccttctgggctcccaaatgctgttggtggagatgatggcggggtttggatgctcagtgcttcctccagggcctggaatcaggaaaagatgggaccatcagcaggaacccctggaaatcagggccctttggaggggtcatcctcagggaactccttcctaataataatcatactaataatagccaccactaccagtcctatttaataaatgctgccctatttatttgcattctacacatatcatttcattggatcttctgcacagtgccatgaagaaaagactatgatcatcatcctcattttacagatgtgaaaactgaggctcagagacctgaaggggcttgtccaaggtcaaggtcacacagctagtaagtggcagagcacagattcaagcccagcacatgctcctacccagcaggctaaactggggttgtcatgcagaaggggaaacctccccttccctgaacatgtgtggctcaattcttagcacccagacctagaaggaagattaagtcctccgggggaagcttcagtctccccaacaactgccctgccctgagattcttcactttcagcaacccattcccatccaaaccaccccttccatcctcaacacttatgtacatagagaagactggatttaatttctgcttagttaatattttccctttctaacactgaaaatgggctgaaatatcatcaaataacattttgaaaataaaaaaatactcttaatctatcatgttcacaatagattatataaacagtgtgcccacatcttcttaaaggtttcagttaaccgtgtttcccctttaactctgttaacatgttactcagaactctggaacatgtctcaagactgggcaccctggactttggccccaggacagcatcgcccatgggcctccctggaccgaggggagatagagacctggcccaacttggactcgggcttccacctggtctcctcagctcccctagacacgcaaagaaactgcaggaccgagagtaaattcaggatgctccgaggggaagttatggctccactttatcttcctactccaccccacttttaaatgaaaagactgaggtccagcgacagggagatgcctaggtcatgagcaaagaaggccacatgccctgcattactcatccacatggtgtctgtccctggctctgccaagaaaacctccaaggtcatctttatgatcagcaacatggacaattctctgcctggatttagagccccaagtcccccagctcaggacagatcgcgtttctttctctggaaacaggtcaagggccccagacttggcataatcagtgtttacaaaacaccaaaaccaaaaagaaagggtttccccagcaggcctaggaatgctcaactcatgccagagtccactgtcaccagggtcaggaggcagagggaaaggaaaaacaattagcacgaaacgaaaagctgagccatgaacttaactcctccaggccctcagagaatgtttcctttcaaagctccctcctgtcagcttgcatctttgaaatgtgctggaaagcaggcagaactagagccgttcccaccagggctcggatggcaaaactgaactggagaggctggagaggctaagctgggactagaccactccgcttggctcagaccagagggtttctggtttcctcagcctctaccctgggggccccatctccctggatcccactgcacaagggcgggcccctcagcccgtgctcctccactcccatcagtgtttgctgaacatgtgcttgatgccaggcgctgtacaaggcgcccagggtatacaccttggtgaaagtatgcacctcccaccaccagatgggaagacagaattaaataagtgatgacgagccatgagaaggagtgtcagagaagttgctggtacctcaggagcatagaccagggcaacctgaatgagattctgggaaggctttgctgagcaagtgagggtaaaacaaaccctgacaagcagggtgggcaggtgaggcacaaggggaagagtgcacctccagagggaagggtgacacaggctaattcaagggctgagtcactcccagtgtgggaggcaatggcagagcaggcgggaaacaggatgccagctcactgactgggggttacccttcctaagctgaatggttgggggtgccagtgatggggtgggcattgcagctggactcaagggagcccagccaagggacccgggccaaggcacccaccttgttgagccgctggatctccttttcctggtactcacgctgtcgggtgagtgggctcagctgatcctgcaggtacttgaccttttggcgcagctccttggcctctgctgtcagctgctccttgtcggtctgcagggaatacaaggttggtaagctggctaggatggcctctccaggaggcctcggattctctgtcctgcctggcccagcccttacgttctcccctggccatcacttcacaatgctcacatgcaaagcacctggggtcggtacagtaatgtccatccggtcctgccctcaattattatgtgtcaatttaaaataataattaaaaaaagaaaaagcagtagctcagttgagtaaaagaccctggattccgacaccagttcatccactaagcagctgagacccctggcactgccacagccctctcttgtctaagcttacctacctgtcacaggtacggggttcctaacgtgagtcacacagagacctcaggaggcctgtgagccccaaaactgaatgcgaaattttgttgtgtgtaatctgctagaaagaaaagccatagttctgaccagattcacatgggggtcttccgtgatccacagaaagcgataaactacggataatccctaacagacactgcagctcatacagccttggagcctagaggagagatgacacgcccagagagaactgtgacataaggcagagagtgctcctccagaaagaaacaaaatactgtggggctaaaagaaagatcaccacagctgagggaaggcttccaggaggcggttccataccctctacggaaccagcagggcttcgccacagccagccaagactgggatggcctttagacagcatcaagccccagccctgtaatacgatgggaaacaaatgtccagagaggggaagtgacgtacccaaggccacacagtgagctggggctagaacccaggtttcctattcccttgctctctctccttccatgtcaaaggaggtgttgaaactaggggatggcagcacagtgcagtggaaagaccaggcacatccccaaataaactatatattcctatgtgtacatatatgcgagaaaggtctggaaacagatgcaccaaaatggtaacagtggttccctctagggagggcctgggatcatggcagtgggaggtagtccagggaaactttcactttgtagcatgtggacatttcataactgtgtattcacagcatgtgattaagagaccagtcgcaggggttagttttcacccagccctgtgtgacctttagtcagtacggactgcagagggcaggcttggtcagacctccctgggaattgttctggactccccatcaagaggctcccggatgggcatgggctttaccgaaattcatccttatctacagggccacgccttgtcatgaaacgtcctaccttccctgtagctgacagggaagagccctcacattccagggatttgtctcacctaccactgtgagcaagggagaggggccaaagagccaggatgtctggctgcgagtcaccaggtatgactgtgcactcataaggaaagacagaagtgttctccctaccacacctccaaggtaagggggtgtcacagacgtaggctgactgctcaaataaggcccctggtgtcccatgctgacgggaggaactgtgaaaggcaatccaggttgaaaatgtccatttttaagctaggcaaaagaccatgcccagttcccatgaaggggaaaacatggtgacataaataaaatctcccaagagtctggcagtcaagtggcctttcctctttaagctgctccaaggtcctgatgggccttggctggtctcattcatacatatgactgggcagatactactacttcaggggacctgttgtttccccccaagaaagaatctggtctcacttatgcccactctctgatctctgtaacttcttcttcgtagtactttttttttttttttttgagacagggtctcattctgttgcccaagctggagtgtagtgacacaatctcagctcactgcaacctccgcctcccgggttcaagcgattctcgtgcctcagtctaccgagtagctgggactacagacatgcgccaccactcccagttaatatttgtatttttattagagacggggtttcaccatgttggccaggctggtctcaagctcctgatctcaagtgatccgcccaccttggcctcccaaaatgctgtgtttacaggcatgagccaccatgcctggccatacatttttcttttagagaaacagggtttcactctgttgtccagtctggagtgcagtggcacaatcacagctcactgaagcttccaactcctgggctcaagcaatcctcccacattagcctgagtagctaggtctacaggtgcacactgccacacccagtgaattttttaatttttgtagagacaaggtgtggctatgtcactgaggttggtctcaaactcctggcctcaagcaatcctcccacctcggcatcccaaagtgccaggatcataggcacaagccacccaacccggccttctctgcaacacttaacacacttttactttatttgcttctgtaattagttgtctggcacctctttcccagcgagggcagggttgagctgttcctgtggactctatgccaaagcacaatgcctgagacaggctctgaagacaaatgccgggatgaatggataaatgaagctctgtctcatgttgtagcccctccccaacaaatcaccatcactatgctgaacacttggcagcatcccaccccaccaagtgccatacagcaggcctgcttggatcttttttttttttttttttagcaagagtttcactcttgttccccaggctggagtgcgatggtgcaatcttgactcactgcaacctccgcctcccaggttcaagcaattctcctgcctcagctacctgagtagctggaattacaggtgcctgctgccacacctggctaagttttgtatttttagtagagatgggatttcatcatgttggccacgctgatcttgaactcctgacctcaggtaatccacccgtctcggcctccccagttgctaggattgtgagccatcgtgcccggccacctgcttagatcttttatatggtgtgcttccctgtacagttccccattccctacaattttaatggaacaaaaagttctgaataaaaacaagaaaatgtgaaaagctgtagttaatgtaactttctcaattttcagatgggaaactgcagtgcagggaaggaacgtgcctgtgtttttggtcacctagctctttcgcactagacccccgggtctcctgactcctgcccctggcttgtttgctccacagaactctccgctaatgtggaggggaactgactctgcagggaccagcagtcacacttgcctcctccatttcaatcttggacttggccaggaggagcttgcggtcaaagtcacgctgcttctgctcccgctcggcctccaggtcagtcacctgcttctgcaaatcagccagcttctgacgcagctcagtgatctgggttcagaggcagagaggagtgtgtgaggcaaggatgtagagcacttgcaggatgtgggcagggcctggctgcccctgggccctccaacactgcccccaacttctcctctgggccatactggggctcagcgtggccactccccaaggttcaaagctgctaaagaggcagcgagatgaagaccaggcatgccctgtgggcgtggccaggaaccccacattaccttctgctcatactgctgcttcatggaccggaaatgctggtcccactgcttgttcacttccagcagctgtggggagagactggagttagcaggagatgagcagagaaggaacaaggagagccatctcctgccccatgtacaccagcgtcccaaggtgtgctcggtgtgtgtgaatagtggctacagacactgtctccatccctcagctctcgaaaactcaatgttgctcaaagccatccaccttcatccactgctgcattttaccttgccaggaaagcaagattaacactaagacatggaaactacatagttttggtgaataattatggaacacacacacctctttggagggcagtctgggattatgtattgaaatttcacattttcatcaactttaacccaataattccactctgaagaatttaaccaatagaaacacttacacaagtgtgcaaatatatatacacaaggctaatcatctcagcaatacctgtattacaaaaaaatccagaggccaatctaagcacagaagataggttaaagaaacgatagtataaacagacaatgtgcagctgttaagaaaataagaaaataggccgccaggcacagtggctcatgcctataattccagcactctgggaggccaaggtgggccaattgcttgagttcaggagtttgagaccagcctggagaatatggcaaaaccccatctctacaaaaaatacaaaatttagccgggcatggtggcacgcatctatagtctcaactactcaggaggctgagatgggaggatcacctgaacttaggaggtggaggctgcagtaagccgagatcatggcactgcactctagcctgggcaaccaaagtgagaccctatcttaaaaaaaaaaaagaaaagaaaaaaagaaaacagaaaataaagcacctaacacacttcctcagtttgaagatgacactatccaccatactcttgatataacaattcctcagggaagaaaaacaaccctacatcatcaactaaataaaacaaaaggagtattggccctgccccttaagatatgtcataaggatccacaccaatttcaaaaacattgcatatgataaaaaaaattacaaagaattaaaggaatatagcatatgttatagatatgaatagatactctcaaaggcagttaattttttttttggaggcaggcctaggctggagtgcagtggtatgatcatggctcactgcagcctcctgagctcaagtgatcctcccacctcagctcccccaagtagccgagactacaggtgtgtactaccacacccagctaatttattttttgtagagacagggtcttgctatgttgcccaggctggtctcaaactcctggttgcaagtaatcttcctgcatcagcctcccaaagtgctgggattacaggtgtgagccaccacgcctgacccagttaattttttaaaaaagaaaagaaaaaataatctgtaaagcagtgtgtgtatatacatatatatacacacacgtatatgtataattttattctactttgaaaaaaactgagggatattcaacaaactgtaatcagttgtggttttctctaggaggtggtattcttgatctttttgtaatgagcattatatcacttttgaaatcagaaaaaaagacgcttataacaatacaaaaagaaatctaaaactaatatgcacatcaagaagctttcaaatgtgcgggaggacaaggggaggcaggctcagggttctagagaagcacctgggctgtgtggagaggggctagacggaacagacagaacaagtgtctaccaaaaaggagctgcacttcgacctcgggtctggaaagactggactagactgggggtgtgaggagggggaggaacacatgtgagatccatgggaagaggcggaatggactgcagcacagggactctgctgcgtggcttctctcttggcagcagagggaaactaagagcctcttacgaactggctcctgcaccttagtgggactgggggacatttaaactacctaaagacctggccatcgccttaatggagtttaggaatccactcagtattctgtggcaggcttcggctgctggctggtccttttcattcttgcctaagaaaattcttgaaatgggagtctcaaaatatctgcaaagtagctacaccaatagaggtaggtagctatttttttttttgagatggggtcttgctctgttgcccaggctggcacgcggtggcacggtctcggatcactgcaacctcagcctcccgggttcaagtaattctccctgcctcagtctgagtgggtgggattacaggcatgtgccaccatgcccgctaattttttgtatttttagtaggcacagggtttcgccatgttggccaggttggtcccgaacctctgacctcaggtgatccacccgcctcagcctcccaaagtgctgggattacaggcatgagccaccgcacccagccaaggtagcttttaacgttaaaaattttgacagtaaatttatggagcctccaggctagtgggaagcggccttaatcccttccttccatgatgggtcctccctaaagcatctctcaagggtccctccactcctcatcggtgatgctaaaacttgcctaacttatcacaacctctttccaccatccaaggtctaccataggagcctgcctaaactgtagccccaacaattttaggccatgccccacatgccacctcctcagagtgaccactgtaggcaaagggactgatcaagagaggacagtccagggcaaggagtcagacctcatccatgggcaggcaggtcagtggtcaccatgccaactcctcatggtgacctgggacctgccagagccaggaggccagggcaagcctttgtgctgctggtcccgggaggtaagagggatcctcccactactgccacctcggccacctacctcactgcgctgctgctccagcatcttcaccttcttctcggctgcgcccaaggccaccacctctgggaccttacctgccgtcacactagcctggggagaagcacagaggagccttcaccaaaacctcaatacaaattatctcacccagtctcggtgctcctctaagacccctcacccaagtggccccagccctctgtctccctattcctcccacccagcaggacaccactaaccatcccagtcatgactacgtccccttctagaagtctacaagatgatgattccccctccctgactcagggtggctgccaggccctctccccttcccttctcccctccctacggtcattctccctgtttaggtacaacctctaaggtactaccagccactctcctcactccctacacacatcagccaaaaaactctctggcctggaaggtaagacatttgagatgtagatacagacagatatagatatagatatactcattctataaaacatatatgttttataaaacttttacaaaagttgaagttatataaaatgtttatttaaaaacatttttagaaagatgcagaaataaagatctgtgtaatacacatagatgtttcccagctctgtcctctgtaaggggctaaagcagagacatccagcagcactgagcaaacctagtgctcagttggtttctaaataccattttctttttattaaaaagaaacagggctgctttgaggggctggagcagataaaatataaggtgagtttgatgcatcttatagtgatggaaagtaaggaagtgctcaaatgaataatactaataacaataataataaaagagcatgtcaaaagggcacaagagacaacctgaaaaaaacatctatggccaaaacgggaacactttgaacagcaaaatacatcacaatagtattggattataagtcacagtatgaaataaatactcttgagttcatactgatagaacaaaatagctgaatcaataaataaatgggggagaagggacagctcttccttacaaaagaattctgattaataagtgtaggaagaatgaggaaaatatgaaatcaccattccattactacagtaataactgctgcaggtggagatccaccaatggtcactaaaatcagtgagtgaaagtttaagaaaaaatagagtatttgcatagtctctaagtttctcctcaaaaataaacacttattaattacaaagggaaaattggtcacttgattgcagaaacttgaaagacagcacttggccaagtgatgaaggttaacagtagtaaaacactgacatcatgtacccctggtctgctggactgagaaatattctgcacactctgatgtacacagaacgtcacctccgtgagattcttgccaaaacacgtaacctcaatctcctcatgagatccaatcacttgtgaggcctcaatcgtgacagcaaataagtctatactgaaaaacattctacaaataactggccagtacaactcaaaagtttcaaggtcatgaaaagcaaggaacagctaggaactgtcacagactagaggaaaatgagggagaagagacaactgaatgcaatgtgggatcccagactccatgctggcacacgacaggacatgagtgcaaatctggtgaaatctgaataaagtctgtagtttactaagtagtacatgccattaattcctagttttgatcatttaacctgggttctataagatgttgccgttaggggaagtaaaggaaggggataggggaactctctagactatttttgcaactcttctgtaagtctagttataccaaaataaaaaggtttaaaggttaaaaaaaaaaatagcaagtgctggggtgaaacagcagacaaggccagtagtccggagggtgtgtgtcgactctatctccaagcccctctgtgatggacaccaagaccctcgtcttctctgggcttcaatgcgatgagaagctcaaacagaagaaggtctgcaggccccatccggacttctgacattgtctgccatcatcctggagtcagattctctctattctcagcgttctctttccagcgttctctttccctccacactgcacccccaagtggcttcaggtagggctgggtgcagagcttgccccctacaggctcaggcctgtaagcacaccatagcaccaaggagcaaggtgagggggagccctccaaggaaggtcaccccctttgagaaaggggacagacaggcctgcccacttgaaatctgcggcatcttggatgggagctgtgcttagcaaaaaggtcaacaagttaccggggaaggaggaagagggtggattccaggctctagggtggtgcaccctgaacctccgcgagggagagaggagtccacgtggagtcagcagagctggctgctggccccaaatctcccctaaagagcaacagctaacgttcactgtttacgacgctaaacctactttacaagcattgcatcactgaatcctcacaaccaccccttgaggcaggtgttactatcttcattttacagaggaaactgaggcctaggagtcttatgtgacttacccaaggttgcagtgctggtaaaaggtggagctagtattccacctgcatgcaattccaaggcacactcgtcgcccctctgtaacacatgcctctaatgagacaggtgaccctggggcacaagggcaagtcgctcccactctcaggaagggcaggaagagcatctggctcggggcattcaaggaagacgagtggagattaaagggcacaggaaaagtaaagagacctgtccagggaattccacacctgaggcagctcagagaacccaagggagaacagccgagtctacaagtcccttccacaagagggcagacaaggccggatctgatttggggaataaagggaagaaaagaggatctccatgggctgggattcggaacaccagggaagagcagactttcaccatttatcagcatgtttccctggccgtaccctacatctgcctgatagcaggtcacacagaaatcctgattatatgatgttacttgacctctccaaacctatggccatagctatagaatggaatactagtcccagccttgcctactctataggtagagatgaggcccaaataagaaaatagatttgcatgtcctgggtaaactctacattgtcacacagtaataaggaattaagccattacggtaattgctactattgcataggtgtagggtgggttaaagacattgagccctactgttcagctattaaaccccattaaagggtgaagtaaaaacacgttggtaaagagttgggactcagctctgcagcaaggggaatggtaacgactgggcaaggggtgcagagtctgctcctgcttgggacctggatgtggccagtgctgggactagaggataggggagtgggccagccctgcagcatcaccagaccacacagacactagccaacaccctcccctctccactttagaggctccagagacacaatcccaggagcttagcagaatccaagggagcttgctcaaccaacctaattctgccaggaatatcaaagatgttaaactgacttttgggaaccactctctaagacagaccttgacaaactggaatgtgtttacggaatgcacccagactgagcaaacgactcaacaccaccttctatgagcaatggctgaaggaactggagctatttagccaggagaagagaaggcttatgaggcccatgaagccacagtgactaccagcagcctctaagcatggaggtcaggccaagtaaagaaaaaaacacgtaacagctagaaccttctaccactggcactggctgcaggagggaggaggctcactgtcactggaggtggtaagcagaggctgagtacctgcaaccaaggatgctacagaaggaatttctgaccacatacctgctgctgtccagccactgccttcttgcctgtcccttccatcttcggtgagcctggccgcccagacgcaccctctttgttgccattgctcatcaacaacttcttgagctccaaattttcctccctgggatggaggtaaacagagaaatcacaatgctgaccctgagttaagaaacctacagggctccttaatgctcactatcgcatgagttgcagctgagccccagggagtactgcaggatcctgaaacctgccctcctggaaaaccaaaaagggcatcttcagctaccttgctctcaatctgtggaggtctctgattgtcaatggcagggtttccccagctgtggaatttctatgcacacaagaccttccggatatatccaaacactgcattaaataaccctggatcacattctagtgagaaagtgacaccctttccaattatcttcacatttcttgtgtagaccacggagacggtgcgagcttggtgctaacaggccctgggcacctctctagttactcgccagtttccctcgttaacacagaaggtgcaggctgcaggcccagagccttcaatgtgcaatgatccttagcctgaatttattaacatcctttcactttcattgtatttagagttatcttctatttatcacaggtaatgctgttttccatttactctagttaaagttgcctttataattttaagtaaaaagatgaatcaaattaaagtaaaattctaagtaactaataaggcaggtgatagaggagatcataaaattagtgatgtggattcaggtctgactaaaatgtttcttctttcttttttttgagatagggtctcgttctgtcacccaggctggagtacagtggcccaatctcggctcaccacagcctcgactgctcctactcaagtaatcctcccacctcagccacccccaacctcccccaccacacacccccaccctcttgagtagctgggactacaggcacaccaccacacccagctaatttttttggtattttttgttggggctgggggaggggtggtgatgtatttcaccaggctggtctcaaactcatggactcaaagcaatcctcccgccttaacgtcccaaagtgctgggattacaggtgtgagccacaacgcccaaccaccacttctttatgttctatttgccagctgagtttccgcttgaaaaaccaataagtaaaatgactttcccaaggtcatacagcagagacttgcattcttgccttctaatccgtgacttttttccccagcttcagtttctgaatccatggatggggtcactagggctataaaaaccccaaaagtgcatccttggccatccaaaagcaaataaattacacactgattcaaaatagccagtggctcagtagttaaacattacttctgtggccatacttacaaagtttatattccttctctttctgttgattctaataagaaacaggagaggagggaaaaacagagtggcaagtcctgtctgtgacacgggcctttcctatgtgcctgagcccagctggtacccaccagatgactcatcacccaaactgtccaggaccacagtgcaggcaggaattgtggccactcacaggatggagagcaaggaggcccaagttcctgttgtaagactccaatcaagtccctgcctctccctgggcctcagtttcccctctgcacagtgagaggtctgtctgcatgatctccaagggcttgtcaagctctgacagtcaagatcagtgtttcccaaggcgtgatcctgtgcctacctcgttcataatcacagagactcctggtgaaatgcaggctcctaggtcttgcctaagacctgtcaattcagaatcttgcaaaggaaggaagggaaggcgtataaacttgtaatgcctttccctgaccctcaaccctcagttaagtctaagccccctagtccagtgggggagctctcatgttctcaggaagacagagcaggttgggatggtgaccagcaggaggcagcaaagtcctgagtcctctggacagccagttcaccgttaacaggggagagaggcaagtgctggaggaggaaggaagtacaatctatgctgaccttcttctgaagctctcaaggcactctatacacctcccaaggtggcaaaagggccagagagaaaataccaaaagagccaaggagaaggatcaagagacgtaacctccaaatagggctctgggcacagggcctcagagccacggtcctcaacccagaaatcagtgctgcacaccagcccctcctcctgcagcccccactcctcaccccttctctgaggggcctgaacttaccgcagcctctcggcagcctgatcccgctgttccaggcccttatccaacttggccttcagagcctcgttctccttccgaagctgctcacacagggtctgtggggcaggggaacagacagggtgagggaaaggaggggcccctcccaggtgcaggctgagctagaggatggtggggggcctgtagccaccccagggcccaactccttatcccctttgcctggcctcaccccatccctctctaaggagctaagccacttggccacccacgtgtcctctcccttgggagccaactacggagaagcctgaccaagtatcagccatggggccttctgctcctccaagacagacagctccatcccttctccttcatccctgctcccactgccgggacccctattccccaccagcctcccccagctgacttctacccttctttgaagtcttagtttaaatcccatctcctcagagaagtcctccctgactccccgatccagctacattaggctaactccgttatccttgctcacagccccccgcttttacgcttctcagcacctgtggcagataaagctaaagaactgttcgtgctgctgttttcttaatatctacccccttacccctaattaattcctgagctcccggagggctgggacccctaaccatcctcttgttcactgccagatccccagcccccagctcaaagtttgtggaaggaacaacatgactgaacagccaaatgagcaaatggacaaatgagcaggcgagtcctaggggggctgaaaggcacaccaatttgcaggtgtgagaggtgcccagtgttgccaaggggaaaaccagaagacaaggcattcagtcgggacctcactatgccctcacgccctcacaatgtggctgtgacacttggttcctcctctacaaaagaaagacaactgtttctcttttttttttttttttttttttttttaagacagagtctcactctgttgcccaggctggactgcagtagcatgatctcagctcactgcaacctccacctcccaggttcaagagattctcctgcctcagcctcctgagtagctggaactacaggtgtgtgccaccatgcctggctaatttttgtattttcagtacagacggggtttcaccatgttggccaggctggtatcaaactcctgacctcaagtgatccacctgcctcagtctcccaaagtgctgggattacaggcatgagccaccacacctagcccagggacaactgtttcttctctgcctcctctatagggctgctgagagggacagatgagacagtgagagtggaagtgtccatgaaccatcagtcacttgcttatgtgcggggactcatattggaagctctgtgaactgggggcatggaagaggggtcgccagactcaggacctcacaggctggggggaagggaaggtgctgactagcaatgctagcatacagtgtcagcacagagttgttcaatctttccacagatcctcactgagcacctcacctgtgccaggtacattgctcggtgtttctccatatactgcctcactggtgcctcacaacttcctcaaagctaagtaactcatctctatgttaaaggtagggaaaccaggtaaaatgatacagtctaacaggtgcacagctgctaagactcatcactggcggggagtaaaactccaattggcagaccccacactggtgtctctttcccctgtgatgaaagatcagagaagggagagagatggtgcccaaaggaggggacagcctttgagctgggccaggaccagggccattcactaaacagccatctgctgccttccacctcccaggcctgttgcaggtggatgcaaccatgtgactagttctggccaacaaaagaggtgtagaagggacaagcatcactcctggactggcctacgcacaattctccagtctctttttcctggtagcaggggctgatgtggatgcctcgtattctaaagggcaccggaaagttgggcccctgtctccctgggactctaaggaactgtgtagagcagaaacaaacccctgccacacagaataggagggaaaacttttgttgtgtaacccagggagatttcagagttgtttcatttctgactcacaaaggagactcttgggaaggctgaatggaggacacagccttcaactggaggtggctggacaatgagggagatgaggcttagcaaacagagaaccagctgggcatggtggctcacaccagtaatcccagcactttgggaggctgaggcaggaggatcacttgagcccaggagttcaacaccagtctgggcaacatggcaaaaccctgtctctactaaaaataccaaaaaattggccaggcataagggcgcatgcatgtagtctcagctattcagggaactgaggtgggagaactgagcccaggaggtcaaggctgtagtgagctgtggtcgcaccactgcactccagcctgggtggcggagcaagaccctgtcccccaacaccccttaaaaaaaagaaatcaaaaaattattgttatgagtccattcaatgcctagcagagagccttatgctatacctgaccttgaatatgtttgtttagtgaaccaagaaacacatcagtgaatgaatgaggaggaactggatcaatacacctccacccaggcagtaaaaatacccaagatgccatgtctctgggcgaggcctccagggaacagaatggcctgctcctagtccctaagggaaggccaggacaaggcctcacttgctgtcctacccttgcagtctagagagctgtttccttggagtctctgggccaatgccctgggtgcaaaccggccaatggatagaatcatcagaggtcacaaagatcatcaccttccatccaaggtgctacgagagctatgagttcatttgatcatttattattttgtcctttcattcattcaccaagtgtgtatgaagtgccacgaactgggacgcaacagtgaatacaacagacatggtgcctgcccccctcaagcttaccttctagcagagagtataagaaaaaaaagagtataagaaaaaatgtattaaataaaattattacaaactatgataagagctaagaaggaaataaacaaggaggggactgaaataaaaaataacagaggttggcaggaccccttttaaggggcctaggatctatccccatctcaaagctgaaaagtggatgcgcaaagtgctctcaccccaggcaccttcctaccctgcccacagcctaggcactgtgccaggctcaccttgccagggttcagcctggataccttgaagcctcactgacatcttaaaggggttcccttctctcagcctggctctccaggcctctgcctctcgttcagcctcacctcccaacacacccctcccctccaggtgggatgggcatcctccgtgctcctctacccccacacctctcctcatactgcatctccaacctgattgcccttcatgccctcggcaaccaaggtcacgcaagggggactcccccttctgccatcagcggggcacttgagtgcctgctgacatgaatgagaccacagatcagagaatggcctgggaggagagtctgcagggagtaaggaggcttcaagtcatggctctgtcactaaggtggcgggcactcagatcacgagcagtccctcagaagcctccgttttgccatctttagaatggtcaccaattataactgaacacttccccgctgctaaagcccacaaggctaagaccccctgcccagtgtggatgcccgtcatgaactccgaatggggacctctcttccagcatggactaggttctggactgcactgggtgcttcatgtacatggcctcatttaatgcagcaatctaaccatggaggcacttctagctcatgttactgataggaacattgggggatagagaggataagtgacttgtccaaggtcatacagcaataaagggtcactactggaaccaaggaccatataactccaaggtctggcctggcctagcaaggaaatctgtccattccccacagcacagggaggctttcaaaaggaattcaataggggaggcaggttgggatggtggtcaagagtatgggctttggaatgcgagagatcgaggttccaatccctacttcaccatttaccagctgggtgaccttgggcaaaaaaagggctgcttccccacctgtgaagtggtgataatgagggtgcctaccctggggggaaagaggcattatgaaaggagttgacctttgttccctcccttcccatcccccaaccctgcacatgagaaataaaggcagggctgctgggggtatccccaaccatgacactcgcattgcccatcccgtatttccccatttccttcctcttcctcatccctccccacaacttccttatcctgttcatcaccctgaacaaaaagcccgaagtctgcccacaacacagccttcagaagtccccatggtaccagtggattcccaggagcaggaaggtgggaagagctcggggggaagcacgcctgcctgtctcgggctgccctccccacgcgcctcacctgcagaatggaggtgcgctgctcattcttgtgcaccttggatgccagtcggttgaactccagggccatgcggcccaggtgggtgaagagctggccgtggtccggctcctcggcacacacactcagcgtggtctccaggcgctgcaggtgcagcatcaggttgccgtcctcacggggcagggggcccagcgcctggagagggaaagggcacacggcccactcttcaccaaggcctgagtaggcgccgccagtccattctccctctgcttcctcatttctcatgactcagtttccccctgtgaccccagctcagccccgggaaattctccagttatgcaggttccctgtctggggctgactcacagggcagaacccaggactcacaggccactggtggctccacagcagcggggccaccatcctcccacacactgggccttgcagagtgcctgacagtaagtcacttgtctgctggacctcagcatcctcatctaccaaatgtccgcacaacccttccctcccttcaacctcacagggttcttaggaggatgaattgacccctgacagtaacaagcccagaaaagggacatcactgcacagtcagccctccatatccatgggttccgcatccatggattcaaccaactgcagatcaaaaatcttctaaaaaaacaaactggccgggcgcgatggctcacgcctgtaatcccaccactttgggaggctgagcgggcagatcacaaggtcaggagatcaagacggcctgagtggtgaaaccctgtctctactaaaaatacaaaaattagctgggcatggtggcacgtgcctgtaatcccagctacttgggaggctgaggcaggagaactatttgaaccagggagtcggaggttgcagtgagcagagatcgcaccacagcactccagcctgggcaacagagcaagattccgtcccaaaacaaacaaacaaaaaactgtattgaacatgtacagaatttttttcttgtcattattccctaaacaatacagtataccaaaatttagcatttacattgtattaggtatcgtaagtaatctagagatgatttaaagtatataggaggatgtgtataggttatagggaactactacgccattttacatcagggacttgagcatccatggattttgggtatcctcagggagttctggaaccactctcccatgtttaccaagggacatctgcatatacgtcctgcaacctccgcctcctgggttcaagcgattctcctgcctcaggctcctgaggagctgggattacaggtgtgcaccactacaccaagctaatttttgtatttttagttgagacggggtttcaccacaatggccaggctggtcttgaactcctgacctcaggtgatccacccacctcggcctcccaaagtactgagattacaggcgtaagccaccatgcctggcctacacatgtgtcttctggggaatggcccaagcattcatcagcttctgaggacccaagactcaaaacagtttaaggaaccacagctttagctatttcagaaagtcccaaactagtacagtatgtaagaaataaagcacaccgtgggccagatagttgactctttctctctagtctatctggaatactcctaccaaagacattgcctttgttacaccaattccactcccaaggacctgcagtgttaccctactgcagacggcactgggcccagctcccctgctgggcatctaaggccctacagccgcaggtcccatccacagcagcatccagttgggctccccactttaccctgcctgaacccacacacaccaggtctggtgtctctgcatgtgtcctctctgtgtcctctctgcctctgcaagttctgctcatccttcccaccctgtccacggctcagctcctccagcagcctcccggaaacagttatgggaatcacaggacagcagagctacagggagcctcagagatcaggccgggaaaccaagctatggggaggaggaacttgcccaaagttgccctgtaagtcagtggcagaggtataacgagaactgaggtttcctgactcgccatccagtgctctgctgcactgacctcccacttctctgaactctggaggaatggcaatgactataaccccaacttggcattccctgaacacctgtgtaatggcgtcagtgtgccgcattctaacaagaggaaatgctgctgtttcaactctgcatccattcccccactgcctctttccacaaaggagctgaggtggcagatgctgctctatttaaggctcatgcgatgcttcccatgcctgcgacttctccagactacaagcttcagagcacagggaggctgtgttgtcttggctcaagtggctcagcagagacaggcacactgtagagctaatgaggaacttactacgtcagttaaagttatcggtccaaagtcagagtgaaacactttctgagcaggggatcttgcctccatggccagcatctcagagccctcagggacagaacaggacaaggggacagaaggttccaggcgacagaacataaagagcctttccaatactcagagctgcctgaggcagtggtgagcctctcaacactgaaggcatgctagttagccagacagccacctgagggggccctgcactgggcactgacaggtacatggggcaaccagtgaacacaagcatatttgtcagccaaacctttgtgaagggaggcagcagggatcaatatatcagtgaagggctagagcacctattgctcgcataacaacaattaaagaaaaaaacttaaaagtgggaaggaagggagaatggagaaggtagaaatttaagtcgtttaaagaatcttccagacttttcacaatggttcttcaataagtctgccattttaagaaagaacagaaggagatatagttaggaaaaaggcagccagtgttgtaaggtgtggaatgaggatgctgggcagacgctccagagctgtacgagagacagagagagagagagagagagagagagagagagagagagagagagagagagtgtgtgtgtgtgtgtgtgtgtgtgtgtgtgtgtgtgtgcgcgcgcgcgcgcgcatgcgtgtaagtggaaagttgaacctccttcctgtgtgctccaagagtctgcacaaagagcaaatcacctgtcttacagggccctgggccttcctgacccttctttctcccccggggttggaagcccacagacccaaagggctgagtcatagtgtgcggaggtgcctggcccctggcagaaggcaacagggctggcaaagagcccaggctttcacaacggtcgggtgcccgtgtgctccaagtcggggaagtcactagcccaggaatttgcatatgtgagcgagaagcaccctttgctcctgcccctcgtgtatccccaagtgactccagggtacctaagggatctgaacaggttctgtgcctctcacatggtagcaagtgacaggacacaaagagggcagcaggtcaagcccggggtcctgcccgtccactcaccatcgcattggcatggctgctgctctctggtgaattctgctcctcaggagtgaccacttcaaattcagaggaggtgccctgtgcagaaaggaagttaggtgctgcccgagagaaaaacagctcacccctcctctgcggccctgtggctgagagcagcaagggggacaaaatctcttcccattttgagtacacagggaccgttacatatcatctcacatgagatcacaaagcaggattctcgacaagcctgtcatagccctctgcataatgtgaggtcatatcccctcgatggccaatcctcttttgtagaagggagatgtgggactagctgaccttgaaccagcagcactgtaggattgcattttttaaggccgtgtactttttaaatgctttcatgagctccattatttctcagggtgacccatggagtgggtcagaaggttatatcctctttggaaagatgaggaaactacagtatacagttggttaatgcaaaagcagggattgaacccaagactgcagatccagcattcctgccacggccccagagctgtctcttaggcccagacgtctctgatcggtttcccagaacacagatggcagctgttacggccaccaccaagcatgtcctgtgctggccttcccaagccagtcctggagatcccagaggagtgaactgatctgagaaaagtcccagagatgattcaccaaatttggagactatttcaggattcaaccaaatccacggtggccaagaaatcccagattttttcacatctttccgtcattcctagtagaattactggtcattcaaccaaccaagaagccaatggcccacctgaaccagccattagctctgggatctgggatttccatgtcccgttaaacctggtctgcagcctcccttcatcccagaaaggggcaggatagatgagaggagtcagtgctcagcttccagctgaccctcatggccaccaagaactcacctctggctcttggccctgccctagaaagtctccctcctccatctacattttccccattacccgtgtaacctcagaacaggtccttctttccctgcacctgatctgtaggataaggatgctgaactatgcaatcccttgtaggataccaagcaaaacttctccagccaaatctgtagatttttttttttttttatgagagggtctgactctgtcacccaggctggagtgtggtggcatcaacatggctcactgcagccttgacctcctgggctcaagcgacccttctgcctcagccagcctcccaagtagctggaaccacagacatacaccatcacacctgactactttttttcttagagagatggagtctcactatcctgcccaggctggtctcaaactcctgggttcaagcaatcctcctgcctcagcctccccaagtgctgggattataggcatgagccactgcgcccagcctgtagaagatagtttctgagccctctttgagaatgtgagctccatgtcacatctgtctgttttcctagcactgtgcacactcagtgatacttaacagtatacaacttagtaagtgagaagaattccttgtacataccagggtcttcctggtaagttttaactatgaccttcatttcaaaatggggaggctgaggccccagagagtttgcgatggacttgcccaatatcacccagcgagacggaacacagtttcttgacctcaaccctctttcttcatgttcttgtatctgtcagtaggacttgaggtccatccaggcaacctccacccatgactccaaataaaacttacactggatggaggcttctggactggtgctggcttgtcactggggcatgcaggggctgtgggagatgctgtgacatttgagtcctttcctggagaatcaagaaagcacagatgaactgactgggaaggggagaagcccaggtaccaccctctcaaggacagcccttgacaaaagggttctcagacaggattccccactcgagtgtgggagaatgggaggtggtctcatcagggccaggtagtctgagaaaatggcctgccctggagtgacggggcagagcctgagcagagagaccatgctccctgggcttactgggaaaatcccaagttggctgctgctccttgctgccctgaacaggcctcaatgataaagacaatgatttacaatttgaaaagtctttatgtatctattatcccagccattctcataaaagccccatatccccattttaaaggtcaggacactgaggcttgggaaggtcatcaacttgcccacagccacatagccagcaactgcaaactcaggactgagacttggccctccctccctgacttcctgcagtccttgctgcagggagctccttgaaggtagcttcatttctcactctgagagtggacctggcaccaatcaggaactcaggaacattgctgaatagacaagcagaggctggaaatgcccactgactgcagcacagtggactctgagaccatcactttcctccatttgtccattcagcaaatgcaaccaccagccaatagaaggctgtcacattggcctgggccagataccatacagtagagctgcagcaggaggcatctgagtccagctgaggtgcggatcatttccatcctggtcccagaccttaccctggacttggagacatgccagagtaatgcacactctgtacgcatggtgatgcctctaccatacatgggacttcaaccccgagccacagtcaccctgtcctttaatgggcagcacacgtaaccttacatctgaaatacgctgcagcaggctaacaggcaagcccagcttcttccctgggcctcagcttccctaattgtaaaatggacgcgcagggcacgaccagggagcttccaactcatatgccagctccaagtgacagggagtagctgcttggagtgcgatgcctggcacacagtagctgctcattaaatattaaatatgctgataaagaccccaaggccacaggactgcaatgtagtcaactgttgtatctattactcatgtctgctggggcctcaggagtgctgagtcactggctatttttaacaagattgttttgaagtcccttccaaatctgaccttctgggggatgtggcagccaaaacatgaatggaagggtagcctgtgacctaaggataaacgagagaatgtgggttttggcataagaagggagttcactgtgaaggatttgggcagtttggggtacagggagagtcagaggtacccagactcctcttatacctgtgagctcagccagggggtcgaaggagcccaaggagggagaaggtggtgggagcagctcgttgtccttcactagctcctctgccttctgccggagcctggtcgcttccatctgggactcttccaaaagctcccctagagttattggggaagaggaagcaaaagcatttactcggctcagtgtgctgcttctccccgtcccaggcccctaaccgtgctgccgcctggcttctgaggctccaggccctggacttcactcccaccgttgctctgtgggccaagtgggacaaactccatgctggtccaccataagaaacaggctagagcaaggacgagggcccagcaatcgggggacacaggagcggaaggaatctatgagaaactcctcggctcccccaacccccagcattctctttctgccccactcccttcacacccagccagggcactccacagaaagccaggggctcccccaccctacgggctacccacagcctgagccaccagggcaaagggctgcctgcagggcggagaccttggataattccaaccagccctctaggcctccattttccttctcctacaagtggagatggggaaaccactcctccctccccagtcggccatcccaagcaaggatctgccaagcaaggagaaagcattttaaaaatcagggggctatgctcccctctaaaacatgagactagagaagggcacggcaaggcaaaggaagagtttcaggagtgtggaagaaagagagccccctctggatggggaaatcaatgaaagccttgtctggaggagaagggggcacagcaactgggtgctgatgcacagggcccgtcggtcgtgtggagggaggtggggttgttctaaagtggggatggcttgagcaagagccaggagaagagaactgagggacctaccacctccttgcttcaagccaagctctgctccctgctccaacacctaggaacgcgtgccccagttgcctggtcatgctggctctccccatctctcgtgccccagaaagaggagaccactctagttccatggccattaactgggccttccagccccctttcccttagcccacgcctccctcttggacctgagtcctgtcatcctggtttccgggtgctgaggaatcagggttgggaatactgtcaccatgctacatggtgcatagagacagctgtgaggcaggagccagcgctgggccaggagggacaggggatgacttgggcagaggcatatgccagcttcattctccactgctagtagagggactggcatcacagtctgcagggaggggcgctcgcagggaggggacagggtctgctttacctaacatctttatcccttgcattttttccttcagccgggaattctccttcactaggcgctcaaaagctgcggatgcctctcctgagggcacgctgcccccagggtcgtagatccggtacggtcctctcccttccatgagggtagctcagcccctgccgtggtgcccgcctggctgtaaggacaacagcagcatatcagcaggctggccaggccatgggggcatcctttgcagagaagctctagtctgtcaatgccccagaaggcagtcccccactttaagctggtctgaccatattatagtaaagcaggacagtcacctccttttatctggacgctctgcctctattaatacaaccttagaatggcattagtttctcttagcagcctcaatgcactgttggcttgtttggaacaggagtccaaataaacagtagggtgcaatgtgggatacaagaaagaacctggacttggaaaaaaaaaaatctgagttcatgtcctgtctgtgaggtccagaagaacaggaatcccatatgttttacccatcattgcatcctcagagcctaccacagtattagctatgaattttgcccaataaacacttactcaattaatggtctaggcattaatttactatgggattatgggcagtcccttcccctctctgagggagggaaatgaaagtcttaagttaatttagtaatctttaaagtgaaatgcttgtaccctaagggataagcaagtcaacccagtccaaagttccatttatatgtgtatcatcttctttaaaaaaagaaaagaaaaaaacaccctgactaatatttaatacactgtcaccctcctccgtgagtctcatatcatatatggtctgtcccttgcagttctaaggaacagaagaatttttcatcaaaccactgtctatttgagcaccaaggtttttttttagtaatctgttcagtttcatctgctttatgtcactgaaaccagttggaaaggtgattttagaatcctaactctgtggcttagtagagaagctctctgtccattcactcatccattcaacaattacttattgagcatcgactccgtgctaggcaccagtctgggtgctgaggaattatcagcaaataaaacagacaaaaatccttcatggagcttatagtctaggggtgaaagcagaggaggatggtggggaacacaatatttcaggtaatcaaaaagtctatgcacaaaaggccccaagcataaggagctattttagccaagacctgaaagaggtgagggaactagccatgaagacatctgaaggaagaacattctttgcagagagaacagtaagggcagaggccctaaggctgaaacaccgagccagcctccagccctccaaatagctctccagcatgaaagggccaaggccttcactggggacctcagaagggtttgggggctcggcaccttcctcccaaggtcaccacccccaagacaaaaactgtttcatcaggaatcctcaaagaccctcccaagtccacacaccatgctccgtgggtccttggcgctgccaggtgactacgaccataccaccctgctcccagaatgtaaatgaaagatcagagtgagaaaggattaacagcaacaccaccatgcttgaatcgcctccttgtcaggcactgcattaaatgtttcagatatacaatcttggaggagctgcacagtaactctaacatgcatactaatctcatctgcattttacaagggagaaactgaggctcagggcggttaagtaactcagccacgatgacccggccgcaataagagccaagatgcaaagtcagccctgcctgctgtgactctgacccccaccatactcacacagccaggacacagagccagaggggcagacagggagttcaaatctctttgtagggcagcaccatgctatcaggtcacctctgggcagtttcccttgccctgcagcataagaaccaataaggacttgtccaagagcgtccataggatggaatgggccagaaagaaaaacaaagttctgatgagaaggaccccttctcccaaagactgacagatacaagatgaatacaccgtgtgggaggcacccacgccctgctgagcctgcgaggcaaaggacagctacccacactcccatcacaagtcatcacccggcttaggggtgacttgtttttaacctgaaaggtcagtgttctacagcatagcacaaagtgcagatgtttccaccgaactaagaaacagtgtgggggctgcacttagcactggaactggcacatagtaaagtactcaaaaatgttggcagacattgggggtccttcccctctgcttgcctctgtcctcacgaggcttgccacctggtacagcatgtgtctgactggtgcgggcattgcccatctggctgggaacttcctgaggcaggagcgtactttgcacatctttgtattcctgtcgggagcacaggagggtgggccttccttgagagctgcttggagttcaagaacagtgaaacagagggctacaaggggcctggagccaccttgcatgacaaaggcagcagtgtcctggttcttgtccaccattatgcattcaccctaaatggaactcacagtcaacaccacatgaaggcatggggaatttcttactcaatgtctgccttgtcctgtagattagaggctgcatgaggacagggagcaagtccatcctgtgtgccagggtatcttcagagtggcccagagtagggcctcggtaaaccttgaattcagagaagtcagactgaagggaacaagcccttgaccccgaccccgcctcctgcaaggccatgtccaacatcccagagaaagcctaaccctgacccactgaccagacgcacttggacgcccagacacttctagaatccaggctgggccagccatgctccctcagagaggcccagatgtaaggcgaagggacaaagcaggatgcaggatgtgggaactgaaacccaccccacgtcctccaaaacacgcaacactcagtttctcttggcgctggggagtcaacgggaaaggggttcatgggaaacaaaaagtgggcagacagagctatgctcccctactttagcctcagggggcagagcttggggagaaagaaaggcagtgggcagaggagacgcaggagaaatatcctattgtgggaaaaccctctctggagatcagaggagccacccctggagggcctggacttctggaggaaagaaagacaaagagggaaacagggaatttccaagttctgctgacctcatgcccagatggtcagcggcagtccctggatgaccactgggcagacgggaactctccctctgatcaatgaggtttttataacttctcccagagagaggactcattctcaggatgacagagctggaggggactctccaagggcaatgaggcgaatcctgcattatcaggtgggagagagatgcacccagaaacactcaatggatgaggggctgcattcgaacatgacgatggcatgcactcccctctgctgtccacaaaccacgaggatgttttcaaaggggaaaaggaagcactgaccactcccctccatgtggcagtatctggagttcagagcccaggagtcctcgggcatgagctcatctgattctcactcacggcacaggcagtgcagcaaggcaaggccctgagcagggaaggccaaggtcacaaaggagtcaggatggagctgggaccagaagatccctgctctccctccaggctgcccacagcccatcctccatttcccttcctgcccagcaatcccatggcacaccacaggcccccaccacatcttctcagagtctctttccacctggcctggttccacaaactacaaatcagcaggtgctccaccagcagtgggactccagccccgcttgcccaaaccagaaacagctggtggtatagaagcagccagcgcagactttcttccaaaacaagacctcagccagcggggcctccacagcctgccccagaggggccctggggctgcccgctggaaccagaaaggcccagtttgggggcagaaaggggcccagacagacggcaggtcaggcaacaaccacagaccgtgaagatggaagtgatgctgctgaaaccgaaggagccacccactagcaggcaagcacttgtgggtggcagggaggcagtagtccccagggctcaactctcagccttaccccagaaagagaggggtatgataaagactacattcagaattaaatttacattctagcttttgctctgaaatgctttggtctgtcagattatcttcccattagcagtgttctggtggctgggtaggggggtggtcccagaccccccaaatgatattcacttgcatagccactaacatttgcaaaatacttcatagtgtcccaagcattgtttttccatctgattatcacaacagccctgggaagaaggcagggctgatacctgcctgatggataaggaaactgaagtccagcttggggacttaatcagcccaatttaatgcctttggtcactggctgcatcctggggccagctatccctgcaaccctggagcaggtgatgccctccctggcccagagggaaaagtgtaagcaaatctctggtacagggaggtggaaggtcatcgaggccaacatctacctccccagcagaggtgagggctgccagggatgctggcaggtgggctggcagagggggtatagggaaggggtctccaggaaagacggcacagaacagaacgtcagagaggtctattctagtgtctactctgctgtgtatggaaccatgggctcattccctcacatgcaaggggaggagcatgggccacacagaaaccgggtgatggctaaagctggcctcaggatcaagaagacccaagtctcaggagctagcagcaagctgaggaaagagagagagccagcaccatggaaacatcgctgccttggaggcaggaagaaaggtccacacagggaaagtgctcaaggccaaccttgcgaacacgaggcctgagagggggcctcacctgcactagcctcagctctgtccaccctgtgggctgtgaaaccctggagcagccactcacctttcctgagcctcaggtgcctcatctgtaaagcaggagtaataatagaacctacctgatagaagatcaaagaaattaaatgaaacaatatgtgtatagttggaagggaattctcactttctactttaggcaatacttcctgattatctgatttaacaagaaacacatctttgttttataataagatttccaaaataataagagtatacagtaactagctcagcatttgacacacagcaggtgcttaataaaaggctgaggcaaccccacaactgtgcccagcttatctaagggccaaggctttccccatttgttctctcctttaatgggattttaggctcttccgtcagctcagtaagctaggttctggcctccacttattctctagtgacctgcatatcaccatttaactgtggttaagcagggtgcctggacacaccatagctagtgaacatgtagctataagaagcccttgaaccacgatgccacactcaccaacaactgggaatctgagcctcatttcctctgctgtaaagggcaatatcctgcaattccacccaaggatgaaaggaagtgagatgccatgatatcacattgcagacataaacaaaaaactgtccacatatttgtgttatgatgacctccagtcctccccaaccaatttccaggctggggaaactgcagcctcaggtccatccatcaaaggccgggttggatttttcaggcagtgaaactactctgttcaatactgtaatggtggacacctgccattccacatttgtccaaacccatagaacatacaccaccaagagggaacactgatgtaaaccatggactccgggtgacagtggtgtcaatgtagattcatcaactgtaaaaaatctaccactctggtggaggatgttgataatgggggaagctatgcctgttaggggtggggggggcgcagtatatgtaaaatctctgtaccttcttctcaattttgctgtgaacctaaaactgctctataaaaaataaggtctttaatttaaaagagaaaaggaccaggctgggctctcctgatggctgtcaggttcacacatgagtgaggacacagcacatacttgagacagtgtgtattcaaggaccgcaccctggcatcctcaccaacaaggagcccagacttaactcctccatccttgcaatcaactgagcaacaatgaggctgcagacacagagtctcatatagtaacagctggggcgccagaactgtgggatctagtcaaggtacactagggcgaacatcttaaccctcactaggcctcagttacctaaaaagagggagctgcaaaaatagtaataacatggggggttgtgcgggataatcattaaggccccttccagttctaacatttcaggatctgaaatttattagcactactttctttaaccttctaaccttaagaaggctccaatccccagctccaatcccttctaaggcccaggtggatttccctaacccatcagtcctcccataagagctttcataggtgctatcccctccccgagggcagtcagagaccctcagctgacatccgcagccctgtgccaggtcctcccctcctgcctaacttgtaccaggctctggccaagcctgatctgtgttcctcaacatggcacacatcttcccatgtccttcatcctcccctcccgagtcacccacaaagaaggccccactgtctccactcagcctccgaggcccagattacacaccacccgctaaacacctgagccagaattcacactgcaaaagaggactggagagcacctaactaagctggagagagggtgacagttcgttaggcgctaccgtatgccaggtgctgggccgcatcatgacgcacatgacctcattttcttcttgccacacagatatggaaattatcatccacactttccagcaaggaaaccagtcgacgcagctacatggatgaggaagcagactcagagaagttaagtcatttgcctgagaatacacagctggttagtggtagaacaaataatgcagcctcaatctgtcagattccaacatcagtgccctttccactgctctacactgcctggagaggcggcaggctgaagctcagaggtgggaaaccagacctactttccagttctccagaacgtgccccaagttcctagcccctgcctttatatgtctctagctttatatgcaaccaggtggcaatctgccccacatcacctgcagtcaacagggtttagaatctcaggctggaagggagctcagaggacattccatcctgtgcttacccagtcctctgaggagcccagggactccagctggccaactttagcaatccagatctcaccaacttcctccccaaaacaattcctggggcagccagcactggctacagttaggctgctcccagttctgtttccactggcccttctctcccctctgtggtcccctggaataaggaacaagatgcccatcttcagcatgacagccagccctgaggacatttggaacctgcagccttctctatactgttccacatagggactgccccccctccagtcccccaccaaccctctaccccacactatctctagttggttctagcactggacccaacattccaggcatggtttgcctgaccaaatgcaggctttcacctccacccttttaggtagtatattcctattgagggagcctgggtatacatttgcttttcttacagctgagtcacctactgaagaatgtcctttctcaatgacaacaacctgcatgtatgcctaactggtgagaacaaagttctcatgtagaaacgtgtgcttgagggctgggtgcggtggctcatgcctgtaattccagcactttgggaggccgaggtgggcggatcacctgaggtcaggagttcgagatcagcctggccaacatggcaaaacccagtctctactaaaaatacaaaaattagccaggtgtggtggcgggtgcctgtagtcccagctactggggaggctgaggtaggagaatcgcttgaacttgggaggtggagattgcagtaagccgagatcacgccacagcactccagcctgggagacagagtgggactccatctcaaaagaaaaaaaaaaaaaaaaaggggtgtttgaggaggtgtgagttacctaagggggcagaagtaactgattgattcagtaataccctatctaggaatctagagatctttgcatcagtacacagaagctggacaaaaatatgcactgccacatgctttgtaatagacatttttgctattcttgaatgtccatcaagaagggactggttaaacaaaccaccattcattcgatggaatactatacagccatcaaaaagaatggggtagattgcttggcaatgatacagaaagatgcccataaaatacaaagcaaagtgcagatttatatgtgtaacaggatgctatttttttcaaaaacacattgtgtgtgtgtgtgtatacatacggaatcttaaatgtgcatagaaaaaggcctggaagcccagtgctttgggaggccaaggtgggaggattgcttgaggccaggggttcaagaccagcctgggcaaaaagcaagaatagattctctattaaaaaaaaacttttttacattagcagagcatggtggcacatgcctggagtcccagctactcggaaagttgaggtgggaggatcacttgagcccagcagttcaggctacagtgagctatgatcatgccactgaactccagcctgagtgacagactaatactctgtctcttaaaaaaaagaaaagaagaaaagaaaaaagtctcaaaggatacataccaaactgctactagtagactgctctacagaaggacctcggtaaggaactaaaaccaaaagaaacttttattttacctatgctattttaactctttacatgggaaatctagtcctgttcttatacaattataaaattagtttttaaatacagtagggacagaggaaggggaaaggaaggagagagaagacaactgtcattttttacattatatcttttgtactgcttgagttttggggggtttttccccaataatcatgtgctatttggtaattttttttaaagggaaattttaaaatatttttctaaaaaatttaagtgagctgagtgcagtggtgcatgcctgtagtcccagctactccagagacagacgcaggaggatggcctgaaaccagagtttatctaaccctgtaactcccctgcctccaagaggtaagatgccaattttggggaattcctcttatacaaaatatggtggaaagagggtttcacagattcaaatcctggctatgatcccttctcgaatgaccctgggtaggcctcactttccttgtttctccctatggaaatgttatgaggaccaagtaggaaccatagagttctctgtaaaccttaaaatgctacccagacaggagcagtaatggctgccaaggagctaggaaggaaaaggggctggacaggggctgaggtactcagatgaaagccaaagatgccttgtgttaacaacaaaaagctgaaagctacctaaaatgaagagaaaaatgaataaatacattgtggcaatttcctatcaggaaatactatacagcagtgaaaaaagaatgagccacagctggagatacgaacatgaatgaatctgggtctcactctgttgcccaggctggagtgcagtggcatgatctcagttcactgcaacttccacctcccagcccaagtcatcctcccaccttagcctctcaagtagctggaactacaggcatgcgccaccacacccagctaatttttgtattgtttgcagagatgggttttggccatgttgcccaagctggtctcaaactcctgggctcaagagatccacctgcctgctctgcctcccaaagtgccagtaaggcatgagtcaccacgctcagcctaaataacatttttaaacataaaaaaatactatgtattatttagggatgcacacattaaaaaaaaaactttaaagaaatgcaagaaaaaaaccccactaaattcagaacacttgtttcttgttggtggctgatgaaggagaaatttcaactgattggaaatgtgttatttcttaaaccagatgagtgagcatgtaggtgcctgcgtgttaccctcggtatctgagagactccttcaatttttcttttttctttttactgtattgtttgctttttttctgcttcaacttttattttagattcggggggtacatgtgcaggtttgctacctgggtatactgcgtgatttgggtaggggtgatcccatcacctgggtactgagcatagttcccaacagtttttcaactctgcctccctccctccccactctagcagtccccagtgtctactgttgccatctttatgtccatgaggacctgatatttagctccacttataagtgagaaaatgcagcatttggttttctgttcctgtgttaatgtgcttaggacaatattttctaaaagtctatgttgccagtttcctgaggaccagatcacgcaggagttgcacctgcagagacagaagtgggctggagagggaccagggctcctaagtctgctgctgaagctgactatagcgaaggcaaaggacaagtggcctgaaggccaacagagagcctggccaatgctctgcccagtgggtggagactgagccaaaggcccttgactcatagggcagtcccatacctgccctggcctctcagcatgactccttggtgacacaactcccacagcacccacacacctacacccacctaccccacacacacacccctgcctgggctgcccggtttgtccactgtgtaggtgctcaaggacgcagagctcctgcctctcaaggaacagcctcagggtgaggtccctgggagagaagagttcagctctgcccagagcagccctcagacaaacagccagctgctgctcaccagtcatccattccaatctgaagagtgactgtcctgggccagtcatgggaaaatcatcaagaacttcccacaatggtcatggtggccgccaaggtctttctctgggggttgggagctgtgctcccccacaaaacaaggggacccagctgccctgtgccttcctgtggcaactctctggaggatgcctggataccctccctacagacggccagggataggaggggcaggcactgcaggcatgtgggggcatagcagcaagaatctaggagggcaggcacagcaaggcctggcccagagggaaaccaggagctgccagagccaaagagagggtgacccaatcattggttgttatagagtttttaagacttggaagagaatgccctgagatgccagagagtgaaacattttcattctaaagctgggaaaccaaagtcggcaaaggcgaacagacgtgcccacagccacatgggacagcagtggcacagaagaaatgcacacctcgtcctctggtggccactgtgcactctcttaccacaccatgctactgctcaacctctccccctccctcacagtggtcaggtaagcaatgagggaaaatgatggaggtgagaaaggaagaacccgggctgatgtgggcccacaaaagaaagaagtctggaataacactggaaggggctgcctacgaggtggaaagcgccctgatcccaggggtcggggtcacgcagaggggcactggggctgttgagggaatgcaagccaggtgtcttcaaagccccacccacatctgagtttccgccactccaaacagggacagatgtttgagacaaagcaaaggacaactcatccagaggggacacagcatggaccacaagtggcagagggttgaaggcaagtgtcttagtctgctttctgcaactattctgttgaatatcacagactgggtaatttataaagaacaagtttatttggctcatggttctggatgatgagaaatccaagtgcatgacaccaccatctgacaagggtcatgccaaggtggaagacagaaggagaaaatgagtgattgaaatagagagtgtattagccaaactggccccttttataactaacctcccgtccccctaccccgtgatagtgacattaatctatttatgagggcagagctgacaatccattcatgaagcagagggattacgtttccaagatatgaacttttgggggacacattcaaaccttagcagcaagttatccagagcacagaaaatcaaaccagtctcatcatcttctactggaatcctgtcaatagcctcatgattagcatcattaacgataatagcagcgaccctgtaccaagcgcttaccacactggtggcccgtgctgagtgcttgccacacactatcccattaattcccaccattctaggaggtagcattgacgtcatacagagctgacaggtgaggatgcagaggcccagagtgacagacacggcacctacccaggtctgccaagcactgaatcatgtgctcttcaccaggggtgctcaaggagcagcccggaccagcggcactggcaccaccaccatccactggatcggatgctctggagttgcagcccagcaatctgtgtttaacaaccaccctctacctccatccccaggattgtgatgcatgctcatgtttgtgaaccaactgctctgaccatttcccaatgctgctaaggagaaaaatcaacatttctatgtctggtatcaaaatcttttagggtctttcccaggccaactggtcaattctcccaaccgaggagaggctgattccagttattgtgactagtctactaagttccagaagagacccaggttccactctgcactttgtcatttttttagggtctgaccttgaagtcacttccctccagaagacccctccaaccatctggtgcccccaaattactctgcactccagttatacctatgccaatccgactcatttggcacttactggcacacaatgcctttcaggtcacactcatagcacatctccccatttgaccaaaagttcctggaaggcaaagccagctccttacgcacctgtgcatcaagaacactgcatggcactgggcacaggagtcatcaggaaatgatgcttgggagagcgctaggagagcactctggttctcctcctgccttctcatctctaggccttaatttcctcatttgtgaaatgtgccattattctactcattcactgaacaaactcagaagagccatccaccaggcactcttctcccgctacagaaatacactcgagaggactaaggaggtccctgctcacccccttctattctaggaaaagagaaagacagtaaacaaataaacactaaaaataacaatttgccagacactaagttctatacatatgctttctcattcgcaaataagattctttcatagcatgatacacgtatgagaaaaataaaatagtaacgtgacagaaagtgaaaaaaggggctgctttgcataaaaagatcagggaaggcccctctgaggagctgacatttgagctgagacttgatcgataaggaaaaaccagccatgggaaaaacggggaaagatgtcctgggcagagggaacagcatgtatgaaagcctaaggatgagaacaagcttggcttgctggagggggaaaagcaggccagcatggtgtgaccaaatcacagcgggtacaggagtaaaacagtaaccagtgggttggagagagaggcagacaaacaacctcctacaacgctgcctctctcaaatcaggtcggcctgacccaaccaggacatccgggccccaagtcacaggcagcactgggggtaagggtatgactcagaccccacagcttcctggggccccgaaaaaactggtgggggtatccaggggcaggcatcaaccttcagcatgagtgccatgccatacccatggaacacccaaggctgggagacaaacgtggttacataagcgtgtagaacactgcacactcccagcggcagcttccagaggggcatgatcacgtgcttccatgaagtgccagtccctgatcacattattttcccgggacacagccaggacagcagccttggtcaggggaaagggaacagggtccaggattcaagcgttgctagtcttgggaaagccttaaccttctctgggcctcagtttcctcatctgaaaattaagagttgttagaaagattaagtgaggccgggcggggcggctcacacctgtgatcccagcactttaggaggctgagacgggcggatcacttgaggtcaggagtttgagaccagcctggccaacatggtgaaactgtctctactcaaaatacaaaaaaattagccggggatggtggcgagtgcctgtaatcccagctactcgggaggctgaggtaggagaatcgcttgaacctgggaggcaagttgccgtgagccgagatcgtgccactgcactccagcctgggtaacagagtgagactctgtctcaaaaaaaaaaaaaagattaaatgagatacggaatgtaagcactgtgcctggcacatagtaagctattagcattatcagttttttcactgcctcagtttcttctgttgcaaaacagagaccaccacggggatgctgagtttgtactaatattctaccctcctaatacaattctaccctcctttgtcaaggatttttttaaaacattctgagtccccttttctgacctctcatcagatgccgaattcccctctatcacaccccattgtttggaaaatgagtaagtgctgattaaatcccattttgaccgtactgtgagaaaaaaatgatgcattaggaatctacacatttccctgcactgtcattctgcaagggggtggggaaggacgttgctgattcttctgcatcatccacaaaagtccctccctccccctaccaaaacacaatctctcacccagtcgcacaaaattcccatctgctcctgtacgcacaatgaatgtacaatgcacacgtgcacacaaatgtcctacagtggaaagctcagccttcatactccatccccagaagcactcctggaaactcatccatcctgcacatgcacacaaatgcctccaacaatgtgcatacaaaatatgttcaacagaaatagtatagtaggaactctggagccaaatgcctgagttcatatctgactttgcaactcacagctgtgtgacctcaagctccaagtacctcggtttcctaaagtataaaatggagataataacaatattaatgtttaggatggaagtgacaattaaatgagtctaatacacgtacagcgttaagatcagcacttggaaagcgcccaataaaaattattattttcctcctcgtgacatatgtacactgcttccacaacttgatacgaaaactcctgacgccgcgtaggcaactcgtctccacaggatagacacccaaagggccgcagcgccgcccgcacccggagggtctgcgctctctacaaccgccccacgccgttcccaggcgtgctaccccgcgcagtgcgcacgcgcgccccccaccaggcccagcgccaagcagggagtagcggctcagcccggcttggccgctggcggagacgccccgggaccccgcgcgccgggcctgggtgcacaagccaccttccccagctcgctccccgccgccaccgaggctctggacgatctgggcctggcctcccttcctcccctccatccccgctccgggccggccggcttacccgaggacggggagcttggggacacagcgccccgcttgctgcgtccagccccgaatccagggacggggcagcggcccgggcaaggctccggccccccgtagcactcctagggctcctggacgggggcagggcacccgggccgaggacgaggaagtgccgggggcctggccgggccgccccacccctgggaaagtccccggagactggcaggccactcgcccaatcgcgccgcgcgctccgggcgggcccgcggccgcctggggtgggaccgagcgaggtaaacaccggctgcctgcggttccgggggcccgcggtgtctctcgtcccttcggcggccttcccctctaggagcgacttccctggggccaccgtcccgggcctgcgcggcgccttgccgcactcccagcgccggaagcccctgtcgaaggcctggggccaccttgaaagccggaatttcagagcggaggcgagccacagagaccacccagccccttccttgtgccgaggggaacacaggccagaacagggaggggacctgccaaaaggcacgtaagcatttggccctaagccagagctggagctcaggcccccagagttccgtccagggcactccaggactcttcttaacaaagctatagaaattccgagctgaaaagacccataaagactctaccgcgaacattttttgctccagacattgtaaaggattcccagacatcgtaaacgctttgctccagacattgtagatgctttgcgtgcattattttcttcgcacaatcacgctagggaggtgggttttactaccttttcttaaataatatttgagtcacaaaaaggttagatgacctcagtaaggggctgaatcaagattcaaacccgggtgggcaaatccagaggccgccttccaccctacctacttatatgtgggctagataatcccaacagactgggatttcctagaccggtaaggaacataaacttgctttaagggtaggaaagctttttaaaagcttatccttttatttttaaaaagaaagaaagctaaattttaattccaaaaagtggaaggtctaaccttggaataaagaacagctctttaaactaaatatagctttatgaaaaacctattgcaaaagacccatttcactggtactgttgaaaacttagtcattgacaggccctcatcctcaaaaagaattaggggaaaggatttggggaactgtttaatacacaccctcattttacagaagagagacccatcaatcaactgtgacttcgcaataatacacacacagatacttgcccaaattatatacctaatctggggattctcctataaggctttgtaacctcctagggttccttcagttaattcaacggtgttatcagatcttcaaaacgatattcattctagtttaattatgaaaagaattacacttatgccttgattcagaagggagggagggaggaagcgatgcaaactccaaagcaccactgagtctcaccactgggggatcctacagagaaactgggaatcctggccctggtttacatagcagctcccaggcatcgtctccacccatcaggtccgcacctgccagttttcttcctgctctttgtgcctgtacttcccaattctcttcctgcagggctctcttcctattcccaacccacatcttctccacccccaccctctacccactgaaaactaaaatctacctaaaaatggctggtctctaattacttgcattttgtttccacactatttcagctgtttttatagcatgtctggccttagccgggcagacagtttcatttctcaaagtgtccgctgggaattctcaagcttgacataaaaaaatggcactcagtcatctttttgtctgatttcctagttctggatcctttttcttaacagttccaatttgtgagaaaactcatttatttataaagtcgtgactgcccccacctcttccattctttgaagtcttggtttgtcttcaggacattccaccctgttagagaccatggagcccatagataacaaacccctatttgacagataggtaaactgagtcctctgtctagaaaaggacttactctaggccacacacattgagtgacacaaccagggccttggaatccagggccttggctcccagtcctgtgtgcttggtccactgtaccaagttgtctttacaatgacatgatttttctcactgccttgcagaaaacaccactgtcataaacacaggctatgaattgagctaatgggattccaatccctgctcagccacttactacctgggtggcccctctaagcctcaggcttctgtctggaaaatgggggataatatacctattcctcatgtgaatcatgaggataaattggacaatgcaaataaagcccaaggctcagcacacagtaggcattcaagaaatgatagtggtgtctagatgtgggctgcatgcattgggtagaacttggctcttaaactcagcaatgcaacctcaccaggcgccatcccaccatacacatcctctgtgagaccctagcctctaggagcatggcaggaatgggagacaggccccctagcctggcactgcctgctaccctgtggtctggaaggggatttccaagtcaagaagctgggcctgacgctgggagctgagtgactcaggcaggtgcaacctcttgttcttccagagtaatgacaagcactcgcacaaagccacacccagaaggagaatcaaactgcctttgttttgttttgttttatttggttttgttttaaagcacgcaacttctcgatctcctttctgctactccctcctccaccacccctactgaggtagctacagagtcagacccaaatacacatttgaaggtaataaaaaacatatgaaaaatccatctataaccaacttaactctagagcaagttccagaagaggggtggaggctgcataataaaagcattaaaaggtaacatgtatggagtatttgctgtgtgctatctccgcgcttttattcataatttgcctcccaaccagcttatgaggtcggcaccattatcatccacatttcacagatgaaactgaagctttgaggtattagatgacttgcccaaggtcttacagcacagcaagtaaccggagcttgaagatccaggctcttaaacgcttaacactcttaagcatcatgctccaaagtcttgccagctagcaagacatagaactcagagtgccaggcttgaagggtctttagaaatgatcaacccaggcagggcatgccgtggctcacgcctgtaatcccaacactctgggaggctgaggcgggtggatcacctgaggtcaggagttcaagaccagcctggccaacatggtgaaaccccgtctctactaaaaatacaaatattagccaggtgtggtggtgggcgcctgtaatcccagctactcaggaggctgaggcaggagaatcacttgaacccaggaggtggaggttgcaatgagccaagatcgcgccattgcactccagcctggggacaagagcaagacttcgtctcaaaaaaaaaaaaaaagaaagaaagaaatgatcaacccagtcttttcattgtagggctggagccacaccaagggccagagagcggcagggacttgcgggaggtcttacgttgagtttgtgattcatacataggacagaacccaagtatccttctcccagcacagtgctgtttccacataccccactgataggaaatggagcatctaaatcaaacaagaacattcctcattgcattaggagaatgagtgaatcagggccttggctaggggagaatggaactcgggagcagctaatgaactaggaaaagagcagccctgggtcccttccttagatccataacctgaggcaatctcaggagtgtaagaccctccagtggattctaggtactttttggtgctgggtgtatgtgtatgttaaagagagattttggtgatagttaaatgagaatgcatatcaagcacatgatattgactaaaattgttctaggcaattgtggcagtttttggtaaaaagtaaataaatgagcagggtccatggtcccagcttctctcctcagcctaagaagacatttttaattctctctatccagctcccaaatacctgcatgaggaggtagttgtatcttcagaggttttcacagtcattcagcaccttaaggtgaatgaaaccatttcatacccacaacttgcccatttcccaagagaccgtcacgcagaggataaggtgtgggttctggcctctgggcttaaatcacagccctgccacttacaactctgtgccttggtttctttatcaatgacatgaaggctgtaactgtgcccaattcagagggtggtgacaatcaaatgccacaaggcttggcctcagtgaaaggtagcgatgatcattatgatcatcaattctatgaggcagcagggattgcttctctcctttttccaggaggaccccaaggcctggagctggggagcagcttgccctagacatcagactgtcttctgaggagctgggcctggaaggcattgctgctgacttttctccaggctctttccccttttcttccttctctatcccaactattttccctgtgtccctgggctggcctgttacacttcagtttctagggcaccactggaggagaggaaagggcaaagtgacactgggggaaattcccagcctcgtcacatacgtggcctagccaggcccctcccacagttcctaggagccctgggtctccccactccagcgtctctccccctggcctctccgtctccaggtcagggtgtcaagctggatctgggcttgcatccagggttgccccttgtcatcctcctggaagtgggaacaggtcagccaggcccagcccggcccagcctctcaggaagttagacccacaaaaccggagcatttcctaatcccgggaagccctaacagggccctgagagcaatcctctttcagtcccacccaccttcctccctgtcctctcccacaccctcttcttctatggcccctccccgctctccctccattcctctgtagcctagaagccaccgtcagacttggcctctgttccttgcctcttctagccagggacttccctaggctgtgaaaagatgcctggggaggggatgaagagggccgtttggatgaactggcctttcttcatcattcctggttccagagtttcctcattcttatggtaacatttatggaccactgaggatacaggagtggaccaatcagacccgcttcctgctctctcagagctcacagactctcaggagccatatggggctatttaaataagtagaattaaactaaaattaaatagaattttagtccagattttctaagtgatcaaagaggaagctgcgtcagctgtgtctgcctgcccttggcccactccctgtgccctgggctctctgttacaggttccaccacaaaagagtccagcggccctagaagcagagcaggcaggagagaagcaagagatccttttgctccagtgttaaggagggtctcagcctccactatgttcccctggaggcagcgccgattcttggcctcttcctatctagctgtagacttctaaagtgcccaacacacacttgtaccctctccatcaaaaattcactgtacacacagatacacacacaaatacacacagtcaccaacttacacccacacagaaagacacatacacgcttcagggatctgacacaacacaggcacacattctcacacacacaaacacccacatccatattcacacttgcatacctcccttttcttgagggaataagacaaaaataggctttgcttttccctttggaaaagctagtaacaactagagagaaaaagactggccaagaaggcaaggccagaagaagaggggcaggaagaaggaacgagatgggggagagaagacagtggagaaggaggctgggtgaggagcaggggctgggagcccaagacctgggtgggaagagcaagctaggctgagagcagcagaccctggctggcaggacatgggaggccaggtggctcttggcacagagctgagggtgtctgcttgccccagcacccttgtgcggtgggtcctttcccctgtcctggcccaccggcccccatctagtcactcacctggggaagggcaggagaatacgagggtgtgtgcaccaggggcggctgtccctatgaaggctcctcggctcactgtgcttctgcaggaaggagggctgggct

SEQ ID NO: 2823 - DNA, 57244 bp, Homo sapiens; identical to SEQ ID NO: 2822
  source 1..57244: mol_type = genomic DNA

SEQ ID NO: 2824 - DNA, 51142 bp, Homo sapiens; identical to SEQ ID NO: 2819
  source 1..51142: mol_type = genomic DNA

SEQ ID NO: 2825 - DNA, 51146 bp, Homo sapiens
  source 1..51146: mol_type = genomic DNA
tgttgatcttcttcaacttggatttatgtccatgattcgtgcaaatagctatccagggatggacagccaccctaatctgggcttctggcaccacaggcctccagctatggggtccagggtctgaacctcagggcctggcagcttcaggctggcgcccctcggcggacgtggctggcatggccttctcccatctgtgatggcttcagcaaggctactgtgagtggtggtggagagggccccagagccagaatatccatcattctcttctgttctggagacaaacccacacttcccacagctcctcacagaggggtaggggtgtgcgtggggcaggtcctgctacagagcttgaagcaaaaattaaacacacacacaaattggtcatggcaactagagggcctgaaaccacttccgggaggttttgaaggaagggggtcttggctgcctcccactcttaggattgctgctcctggaggcttctgcaacggatggtgggtcaaagccggatgaggcctctctccactcagcagcagggaaggagtttttcccagtcactcccagcagagtacaaatgaaagccttctgggtggagcctccccagtcctgtaaacagctcagttcagggactggtgtacaagctggccacccatctcagcctctcatccagctgaggctctggccacaccgtgcaagtggcttctagtttcttggcaatctgagatcagctggctctgcaagatgaaggtggagccaaatgacacaatctggtctcactgaggcccctcacggtcattttttggagactctaaataaacaaaaattttgaggacttcatgattatgtggtagagcgagtttcaaagtctcttatggaatgcagtgcaggaacagtgaaaataacagctagggttactgggtgctaccaagtgccagggctaagtaccttaagtacgctggtcatgtaatcttcacccagccctatgaagaaggcaggttattatcccattgtaaaagagggaactgggacactaagaggttttaaatgacttgctcatagttccaggtccaggaaatagtggggctaggatttgaacccaatctcaaatcctggagcagttctggggagggagcccctcccattataccaatctctaccactcatcaaagcagcctccaaggggctccactgaacttgtagggttcttcagggaaaaacagaaaatgactgagcagcccaatcccttcttccaatcaccaaatcctccaaactgcaacccctccaaggtgtccgtcccatggcctctactcacacacctgcaaagggacactcgccacctcccagagctggctccatttctgcacaactgtgtcccttagaaagaaagttcctcttcatgttgcgatggacttggcctccctgtcattcccacccactagttataattctgttcccagaagtcccacaggcgaggtggtgccttgtgccccatgagagctctacagggagcaatggcagtcgctaaggtcccaatcttttcacgagtggacacagctccaggctcttcagcctttcatggtggacaccatggtcaggggagcttttcaaacagaaatatggtcatgccactctgctttaaaaatgtccagtgactacacattatgctgaggataagacccaggcctcccaccatgctccgcaggcctgcacggtcaggacccggctacgtcctgaaccctgcgttgcccctctctttccctaccttgttcttggctccagccacgctggtcttccctccgatcctcaaatcagctcccctacttcccctcctcccaccacggcctctgcatttgtcatgttctctgcaaaagcatcctccacccctacctctccacctagctagtgtcactcattctgagagtctcaactcaaatgctgcccccccggtctaggtcggcttcctctgctatctgctcccacagaaaccggctcttcttcctttagggcacttgagtgcagcctgtttgtgtggtgtttgtttattcatttctgcctccctcattagacattacgctgtataagggcaaggactgtatctgcttctgttctctaggcatccatagcacctagcacaatgcctggcattagataatgcactagaatgaatggtttcagcccccctcactctgtggttgccattactctccattcaacactgttttggaaagctgggcctctcctccaccaagagcagaaactaacgacatcacccccaaactcaggcaatgctggcagataagatattatctcccccagggaggaccaagactcagtattaggggctcacctggttctgtaggcctggctgtgggagggtccatcacttgggagctctgatttggatttcgaacccctccacagggtagacgccaggtgtattccggctgcgacaaaactggtgcttaataatcaataatcacacccaaaaattacaatagcacctactgtgccaggacaatactaaatctgtattagtcaagtataattgaatctttataacaacccaggctggcactcccatttcacaggtaaggaatctgaggctcagaggggataacttgctgaaggtcatctagcaaggagaatggctaagcttggatttgaatccaggtctttgtaaatccagagccaatctcttaagcgccatactatatactctggtgtttaaagatgtgtaccaagaagggtcatatgggagaagctgaaaaagaggccagccaggaggtttctgtaatggtccaggggagagctgggatgcctaaggtggggctgtggcagaggactggggaaaatgggacaagtgacagcagatctttggaagaagaatgataagaagggaaaagaggccaggcgcagtggctcacgcctgtaatcctagcactttgggaggccaaggcgggtggatcacctgaggtcaggagttcaagaccagcctggccaatatggagaaaccccgtctctaccaaaaatacaaaaaattaccgggcgtggtggtgcatgcctgtaatcccagctacttgggaggctaaggcaggagaatagcttgaacctgggaggcagaggttgcaatgagccgagatcgtatcactgcactccagcatgggcaaaaaagagtgaaattccatctcaaaaaaaaaaaaaaaaaaggaaaagaaaataaaaaaagagaggagagaagaagaggaggggaggggagaggagcggaggggaggggaggggagaggaaaggaaaggaaagagagagaaacatggtgaggctctggaacctagttacacgtggaagttataagaaaaagcaaacccaaactctgatacccatggcctggggcctggagggagtcctccttcccaccctgcactcttactcagccttctccgtcctagaccagtgaccctgaacagctgtggggcagccctgcgggactgtggccagatccctgcccctgggtagcagcccagagccaggccctggacacccacctgccaccacggtgctgtttagttcagaaggatgcagtttctgaacccctcacttaaccttcctctctggaaggtgtctggggcagcctctgtgtgtgccctggagcaagggagggacacagactcaccagatggaagaggcgcgagttggggagtgggggcgggtgctccatggccatggggggaggggggtagcggatctgggaccagtcctcgaagccatggtgtggcaccatggctggcatgggcgggtaggcgtaggggtaggccccgcagagatgttctgggtggggctccacatggtaacgctctcctgaggcctgcaagaaaggctgacgtctggctttggcctgcaacaggctgcaaaggacacccatctcatcaccctctaaatagaatgttagctctctgaaggctagcaggctgggtaccaaaggctggtatgtggtcatgaaaggctgctacatgggtacagaaatctggatacatgggcatagaaggctggatatatgagcatggaaggctgcatgggcatggaaggctgggtacacatgcatggaaggttgtgacatgggcacagaaggctggtacatgggcacggaaggctggtacatgggcatggaaggctagtacatgggcacggaaggctggtacatgggcacggaaggctggtacatgggcacagaaggctagtacatgggcatggaaagctggtacatgggcatggaaggctggtacatggacacggaaggctggtacatgggcacggaaagctagtacatgggcacagaaggctgctacatgggcagtgaaggctggtacatgggcacagaaggctaggtacatgggcagtgaaggctggtacatagacacggaaggctggtacatgggcacggaaggctagaacatgggcacagaaggctggtacatgggcacggaaggctgggtacatgggcacggaaggctgggcacatgggcatggaaggctgggcacatgggcacagaaggctcatacatgggcacggaaggctgggtaaatggacacagaaggctgggcacatgggcacggaaggctgatacatggaaacggaaggctgagcacatgggcatggaaggctggtacatggacacggaaggctggtacatgggcatggaaggctgggcatgggcacaaaaggctgggcatgggcacaaaaggctggtacatgggcacggagggctggaacatgggcatagaaagttggatacatgggcacggaaggctcatacacggccaaagaaggctagtcacatgggcacggaaggttgctacctggacacagaatgtcaacagtgatgacagctaatacattgtgggcactgcctctgtaccaatactgctctaaggcttttcctgtattactcatcagttagttagcagaggatgtccccacgcccgagcacacactgtgcatccatcaggctagctccatgaggaaggtaagaggatgtcagtgctgctacctccctcaagcctcctcacctttgctttcctcttctgctgtctgagggcttctcttgccttctcctcatctttgaatgcttttagctgagagaagaagggagggagaaaagactgtcggcacaggtggtttctggccaggcctggatccagggcctaaccagccacgaggactgaccggctgatgcttccctctgggccaccatgcgtgggccagccccgggaaagggccctgagggcggagcacagcccaggctgttgctgcaggccacctgcttgtcacagtggtctgtgcacaggtcaagagggttcacgtgaacctcgctgcttctctgctaacatcttttagttccactctgggagagtaaagcccagaactgactgtggaaagtcagaggtagagatatcttagagtaaaactcgtaattgtacaaagaaagagtcagagaggggaagggccttgccgagctcaaatatgattgcagagctggagagaagcagtgagggtcctgacatccagcctcaccagggccctccaatccatgccccctctccccacgaggacaggccagttgcccttcctgggtccagtcactcttacctgggcatttgacagggtgacctgggcctgcagcttctccacttgcttcttcagctcttccttctcctcattcatgcgctcacgatcactgcgctccctctggaagtcctcctcgaagatcttcacctggtgtggagggagggtgaagagagggagggggatggtcctgagtggggatttctcctcaggcccagactcccatgcctcctgctggggtcacagatggcagagctgggggtcgccatggggagtgggacagctacacctccagcctccaccttaacttcaaacagagtagttctgtgtccctctatcttacattctgggcttcaagctaggactttatttgaacaaaggatatatggttttaaaaaaacgttgaaagccatcaaccagtgcaatcctttcactccgctgagacccacaggggcagtgatcacagaaccagagtgtggtgtagaccagagtttggatctgctggttctgagggcagagaccctacaaactccgctagggctccagggtgccctggcagaggtgggttgggtggggcctgcctctgtctcttagcctgtagtttcacatccttagtgcagatcagctgagacactggctaggttcaaggcagtttaggaggattaaatagcacagagacaatgggagagccacaaccttttcgctttctttcaccccaatccttctgtgtccctcagggctagtaggtctttaataccattttagtacctgccaatctcctttaaataaaggagaaaagaactccagttcagagtcttcatttggcaagagtatccggctagagtttaataacattgttctgtttttattgtttattgcgtacagttactttctacttgtgacaaataataaatggttttttccaattacagcagtgatataaagctcccttttaaattcatttatttagaatttattttttaaatactaggtaaataatagcacgtgtggggcatagagatggctaaatcataaaggtggtagaggaacgacttaagctagggttatggtgctggaaaggataaacctagagccagtggggggccctggccaatggccagaaagtggattactaattacaggttccatgtgattccaagccgtctgggccctcaggaaagctccagctcccacagagcacctcccacctgatttcctcccggaagcctcacctgctgtttcagcaactcattctgcgtgaccagctcctgtttccttaggagggcccctgctccttctgggctcccaaatgctgttggtggagatgatggcggggtttggatgctcagtgcttcctccagggcctggaatcaggaaaagatgggaccatcagcaggaacccctggaaatcagggccctttggaggggtcatcctcagggaactccttcctaataataatcatactaataatagccaccactaccagtcctatttaataaatgctgccctatttatttgcattctacacatatcatttcattggatcttctgcacagtgccatgaagaaaagactatgatcatcatcctcattttacagatgtgaaaactgaggctcagagacctgaaggggcttgtccaaggtcaaggtcacacagctagtaagtggcagagcacagattcaagcccagcacatgctcctacccagcaggctaaactggggttgtcatgcagaaggggaaacctccccttccctgaacatgtgtggctcaattcttagcacccagacctagaaggaagattaagtcctccgggggaagcttcagtctccccaacaactgccctgccctgagattcttcactttcagcaacccattcccatccaaaccaccccttccatcctcaacacttatgtacatagagaagactggatttaatttctgcttagttaatattttccctttctaacactgaaaatgggctgaaatatcatcaaataacattttgaaaataaaaaaatactcttaatctatcatgttcacaatagattatataaacagtgtgcccacatcttcttaaaggtttcagttaaccgtgtttcccctttaactctgttaacatgttactcagaactctggaacatgtctcaagactgggcaccctggactttggccccaggacagcatcgcccatgggcctccctggaccgaggggagatagagacctggcccaacttggactcgggcttccacctggtctcctcagctcccctagacacgcaaagaaactgcaggaccgagagtaaattcaggatgctccgaggggaagttatggctccactttatcttcctactccaccccacttttaaatgaaaagactgaggtccagcgacagggagatgcctaggtcatgagcaaagaaggccacatgccctgcattactcatccacatggtgtctgtccctggctctgccaagaaaacctccaaggtcatctttatgatcagcaacatggacaattctctgcctggatttagagccccaagtcccccagctcaggacagatcgcgtttctttctctggaaacaggtcaagggccccagacttggcataatcagtgtttacaaaacaccaaaaccaaaaagaaagggtttccccagcaggcctaggaatgctcaactcatgccagagtccactgtcaccagggtcaggaggcagagggaaaggaaaaacaattagcacgaaacgaaaagctgagccatgaacttaactcctccaggccctcagagaatgtttcctttcaaagctccctcctgtcagcttgcatctttgaaatgtgctggaaagcaggcagaactagagccgttcccaccagggctcggatggcaaaactgaactggagaggctggagaggctaagctgggactagaccactccgcttggctcagaccagagggtttctggtttcctcagcctctaccctgggggccccatctccctggatcccactgcacaagggcgggcccctcagcccgtgctcctccactcccatcagtgtttgctgaacatgtgcttgatgccaggcgctgtacaaggcgcccagggtatacaccttggtgaaagtatgcacctcccaccaccagatgggaagacagaattaaataagtgatgacgagccatgagaaggagtgtcagagaagttgctggtacctcaggagcatagaccagggcaacctgaatgagattctgggaaggctttgctgagcaagtgagggtaaaacaaaccctgacaagcagggtgggcaggtgaggcacaaggggaagagtgcacctccagagggaagggtgacacaggctaattcaagggctgagtcactcccagtgtgggaggcaatggcagagcaggcgggaaacaggatgccagctcactgactgggggttacccttcctaagctgaatggttgggggtgccagtgatggggtgggcattgcagctggactcaagggagcccagccaagggacccgggccaaggcacccaccttgttgagccgctggatctccttttcctggtactcacgctgtcgggtgagtgggctcagctgatcctgcaggtacttgaccttttggcgcagctccttggcctctgctgtcagctgctccttgtcggtctgcagggaatacaaggttggtaagctggctaggatggcctctccaggaggcctcggattctctgtcctgcctggcccagcccttacgttctcccctggccatcacttcacaatgctcacatgcaaagcacctggggtcggtacagtaatgtccatccggtcctgccctcaattattatgtgtcaatttaaaataataattaaaaaaagaaaaagcagtagctcagttgagtaaaagaccctggattccgacaccagttcatccactaagcagctgagacccctggcactgccacagccctctcttgtctaagcttacctacctgtcacaggtacggggttcctaacgtgagtcacacagagacctcaggaggcctgtgagccccaaaactgaatgcgaaattttgttgtgtgtaatctgctagaaagaaaagccatagttctgaccagattcacatgggggtcttccgtgatccacagaaagcgataaactacggataatccctaacagacactgcagctcatacagccttggagcctagaggagagatgacacgcccagagagaactgtgacataaggcagagagtgctcctccagaaagaaacaaaatactgtggggctaaaagaaagatcaccacagctgagggaaggcttccaggaggcggttccataccctctacggaaccagcagggcttcgccacagccagccaagactgggatggcctttagacagcatcaagccccagccctgtaatacgatgggaaacaaatgtccagagaggggaagtgacgtacccaaggccacacagtgagctggggctagaacccaggtttcctattcccttgctctctctccttccatgtcaaaggaggtgttgaaactaggggatggcagcacagtgcagtggaaagaccaggcacatccccaaataaactatatattcctatgtgtacatatatgcgagaaaggtctggaaacagatgcaccaaaatggtaacagtggttccctctagggagggcctgggatcatggcagtgggaggtagtccagggaaactttcactttgtagcatgtggacatttcataactgtgtattcacagcatgtgattaagagaccagtcgcaggggttagttttcacccagccctgtgtgacctttagtcagtacggactgcagagggcaggcttggtcagacctccctgggaattgttctggactccccatcaagaggctcccggatgggcatgggctttaccgaaattcatccttatctacagggccacgccttgtcatgaaacgtcctaccttccctgtagctgacagggaagagccctcacattccagggatttgtctcacctaccactgtgagcaagggagaggggccaaagagccaggatgtctggctgcgagtcaccaggtatgactgtgcactcataaggaaagacagaagtgttctccctaccacacctccaaggtaagggggtgtcacagacgtaggctgactgctcaaataaggcccctggtgtcccatgctgacgggaggaactgtgaaaggcaatccaggttgaaaatgtccatttttaagctaggcaaaagaccatgcccagttcccatgaaggggaaaacatggtgacataaataaaatctcccaagagtctggcagtcaagtggcctttcctctttaagctgctccaaggtcctgatgggccttggctggtctcattcatacatatgactgggcagatactactacttcaggggacctgttgtttccccccaagaaagaatctggtctcacttatgcccactctctgatctctgtaacttcttcttcgtagtactttttttttttttttttgagacagggtctcattctgttgcccaagctggagtgtagtgacacaatctcagctcactgcaacctccgcctcccgggttcaagcgattctcgtgcctcagtctaccgagtagctgggactacagacatgcgccaccactcccagttaatatttgtatttttattagagacggggtttcaccatgttggccaggctggtctcaagctcctgatctcaagtgatccgcccaccttggcctcccaaaatgctgtgtttacaggcatgagccaccatgcctggccatacatttttcttttagagaaacagggtttcactctgttgtccagtctggagtgcagtggcacaatcacagctcactgaagcttccaactcctgggctcaagcaatcctcccacattagcctgagtagctaggtctacaggtgcacactgccacacccagtgaattttttaatttttgtagagacaaggtgtggctatgtcactgaggttggtctcaaactcctggcctcaagcaatcctcccacctcggcatcccaaagtgccaggatcataggcacaagccacccaacccggccttctctgcaacacttaacacacttttactttatttgcttctgtaattagttgtctggcacctctttcccagcgagggcagggttgagctgttcctgtggactctatgccaaagcacaatgcctgagacaggctctgaagacaaatgccgggatgaatggataaatgaagctctgtctcatgttgtagcccctccccaacaaatcaccatcactatgctgaacacttggcagcatcccaccccaccaagtgccatacagcaggcctgcttggatcttttttttttttttttttagcaagagtttcactcttgttccccaggctggagtgcgatggtgcaatcttgactcactgcaacctccgcctcccaggttcaagcaattctcctgcctcagctacctgagtagctggaattacaggtgcctgctgccacacctggctaagttttgtatttttagtagagatgggatttcatcatgttggccacgctgatcttgaactcctgacctcaggtaatccacccgtctcggcctccccagttgctaggattgtgagccatcgtgcccggccacctgcttagatcttttatatggtgtgcttccctgtacagttccccattccctacaattttaatggaacaaaaagttctgaataaaaacaagaaaatgtgaaaagctgtagttaatgtaactttctcaattttcagatgggaaactgcagtgcagggaaggaacgtgcctgtgtttttggtcacctagctctttcgcactagacccccgggtctcctgactcctgcccctggcttgtttgctccacagaactctccgctaatgtggaggggaactgactctgcagggaccagcagtcacacttgcctcctccatttcaatcttggacttggccaggaggagcttgcggtcaaagtcacgctgcttctgctcccgctcggcctccaggtcagtcacctgcttctgcaaatcagccagcttctgacgcagctcagtgatctgggttcagaggcagagaggagtgtgtgaggcaaggatgtagagcacttgcaggatgtgggcagggcctggctgcccctgggccctccaacactgcccccaacttctcctctgggccatactggggctcagcgtggccactccccaaggttcaaagctgctaaagaggcagcgagatgaagaccaggcatgccctgtgggcgtggccaggaaccccacattaccttctgctcatactgctgcttcatggaccggaaatgctggtcccactgcttgttcacttccagcagctgtggggagagactggagttagcaggagatgagcagagaaggaacaaggagagccatctcctgccccatgtacaccagcgtcccaaggtgtgctcggtgtgtgtgaatagtggctacagacactgtctccatccctcagctctcgaaaactcaatgttgctcaaagccatccaccttcatccactgctgcattttaccttgccaggaaagcaagattaacactaagacatggaaactacatagttttggtgaataattatggaacacacacacctctttggagggcagtctgggattatgtattgaaatttcacattttcatcaactttaacccaataattccactctgaagaatttaaccaatagaaacacttacacaagtgtgcaaatatatatacacaaggctaatcatctcagcaatacctgtattacaaaaaaatccagaggccaatctaagcacagaagataggttaaagaaacgatagtataaacagacaatgtgcagctgttaagaaaataagaaaataggccgccaggcacagtggctcatgcctataattccagcactctgggaggccaaggtgggccaattgcttgagttcaggagtttgagaccagcctggagaatatggcaaaaccccatctctacaaaaaatacaaaatttagccgggcatggtggcacgcatctatagtctcaactactcaggaggctgagatgggaggatcacctgaacttaggaggtggaggctgcagtaagccgagatcatggcactgcactctagcctgggcaaccaaagtgagaccctatcttaaaaaaaaaaaagaaaagaaaaaaagaaaacagaaaataaagcacctaacacacttcctcagtttgaagatgacactatccaccatactcttgatataacaattcctcagggaagaaaaacaaccctacatcatcaactaaataaaacaaaaggagtattggccctgccccttaagatatgtcataaggatccacaccaatttcaaaaacattgcatatgataaaaaaaattacaaagaattaaaggaatatagcatatgttatagatatgaatagatactctcaaaggcagttaattttttttttggaggcaggcctaggctggagtgcagtggtatgatcatggctcactgcagcctcctgagctcaagtgatcctcccacctcagctcccccaagtagccgagactacaggtgtgtactaccacacccagctaatttattttttgtagagacagggtcttgctatgttgcccaggctggtctcaaactcctggttgcaagtaatcttcctgcatcagcctcccaaagtgctgggattacaggtgtgagccaccacgcctgacccagttaattttttaaaaaagaaaagaaaaaataatctgtaaagcagtgtgtgtatatacatatatatacacacacgtatatgtataattttattctactttgaaaaaaactgagggatattcaacaaactgtaatcagttgtggttttctctaggaggtggtattcttgatctttttgtaatgagcattatatcacttttgaaatcagaaaaaaagacgcttataacaatacaaaaagaaatctaaaactaatatgcacatcaagaagctttcaaatgtgcgggaggacaaggggaggcaggctcagggttctagagaagcacctgggctgtgtggagaggggctagacggaacagacagaacaagtgtctaccaaaaaggagctgcacttcgacctcgggtctggaaagactggactagactgggggtgtgaggagggggaggaacacatgtgagatccatgggaagaggcggaatggactgcagcacagggactctgctgcgtggcttctctcttggcagcagagggaaactaagagcctcttacgaactggctcctgcaccttagtgggactgggggacatttaaactacctaaagacctggccatcgccttaatggagtttaggaatccactcagtattctgtggcaggcttcggctgctggctggtccttttcattcttgcctaagaaaattcttgaaatgggagtctcaaaatatctgcaaagtagctacaccaatagaggtaggtagctatttttttttttgagatggggtcttgctctgttgcccaggctggcacgcggtggcacggtctcggatcactgcaacctcagcctcccgggttcaagtaattctccctgcctcagtctgagtgggtgggattacaggcatgtgccaccatgcccgctaattttttgtatttttagtaggcacagggtttcgccatgttggccaggttggtcccgaacctctgacctcaggtgatccacccgcctcagcctcccaaagtgctgggattacaggcatgagccaccgcacccagccaaggtagcttttaacgttaaaaattttgacagtaaatttatggagcctccaggctagtgggaagcggccttaatcccttccttccatgatgggtcctccctaaagcatctctcaagggtccctccactcctcatcggtgatgctaaaacttgcctaacttatcacaacctctttccaccatccaaggtctaccataggagcctgcctaaactgtagccccaacaattttaggccatgccccacatgccacctcctcagagtgaccactgtaggcaaagggactgatcaagagaggacagtccagggcaaggagtcagacctcatccatgggcaggcaggtcagtggtcaccatgccaactcctcatggtgacctgggacctgccagagccaggaggccagggcaagcctttgtgctgctggtcccgggaggtaagagggatcctcccactactgccacctcggccacctacctcactgcgctgctgctccagcatcttcaccttcttctcggctgcgcccaaggccaccacctctgggaccttacctgccgtcacactagcctggggagaagcacagaggagccttcaccaaaacctcaatacaaattatctcacccagtctcggtgctcctctaagacccctcacccaagtggccccagccctctgtctccctattcctcccacccagcaggacaccactaaccatcccagtcatgactacgtccccttctagaagtctacaagatgatgattccccctccctgactcagggtggctgccaggccctctccccttcccttctcccctccctacggtcattctccctgtttaggtacaacctctaaggtactaccagccactctcctcactccctacacacatcagccaaaaaactctctggcctggaaggtaagacatttgagatgtagatacagacagatatagatatagatatactcattctataaaacatatatgttttataaaacttttacaaaagttgaagttatataaaatgtttatttaaaaacatttttagaaagatgcagaaataaagatctgtgtaatacacatagatgtttcccagctctgtcctctgtaaggggctaaagcagagacatccagcagcactgagcaaacctagtgctcagttggtttctaaataccattttctttttattaaaaagaaacagggctgctttgaggggctggagcagataaaatataaggtgagtttgatgcatcttatagtgatggaaagtaaggaagtgctcaaatgaataatactaataacaataataataaaagagcatgtcaaaagggcacaagagacaacctgaaaaaaacatctatggccaaaacgggaacactttgaacagcaaaatacatcacaatagtattggattataagtcacagtatgaaataaatactcttgagttcatactgatagaacaaaatagctgaatcaataaataaatgggggagaagggacagctcttccttacaaaagaattctgattaataagtgtaggaagaatgaggaaaatatgaaatcaccattccattactacagtaataactgctgcaggtggagatccaccaatggtcactaaaatcagtgagtgaaagtttaagaaaaaatagagtatttgcatagtctctaagtttctcctcaaaaataaacacttattaattacaaagggaaaattggtcacttgattgcagaaacttgaaagacagcacttggccaagtgatgaaggttaacagtagtaaaacactgacatcatgtacccctggtctgctggactgagaaatattctgcacactctgatgtacacagaacgtcacctccgtgagattcttgccaaaacacgtaacctcaatctcctcatgagatccaatcacttgtgaggcctcaatcgtgacagcaaataagtctatactgaaaaacattctacaaataactggccagtacaactcaaaagtttcaaggtcatgaaaagcaaggaacagctaggaactgtcacagactagaggaaaatgagggagaagagacaactgaatgcaatgtgggatcccagactccatgctggcacacgacaggacatgagtgcaaatctggtgaaatctgaataaagtctgtagtttactaagtagtacatgccattaattcctagttttgatcatttaacctgggttctataagatgttgccgttaggggaagtaaaggaaggggataggggaactctctagactatttttgcaactcttctgtaagtctagttataccaaaataaaaaggtttaaaggttaaaaaaaaaaatagcaagtgctggggtgaaacagcagacaaggccagtagtccggagggtgtgtgtcgactctatctccaagcccctctgtgatggacaccaagaccctcgtcttctctgggcttcaatgcgatgagaagctcaaacagaagaaggtctgcaggccccatccggacttctgacattgtctgccatcatcctggagtcagattctctctattctcagcgttctctttccagcgttctctttccctccacactgcacccccaagtggcttcaggtagggctgggtgcagagcttgccccctacaggctcaggcctgtaagcacaccatagcaccaaggagcaaggtgagggggagccctccaaggaaggtcaccccctttgagaaaggggacagacaggcctgcccacttgaaatctgcggcatcttggatgggagctgtgcttagcaaaaaggtcaacaagttaccggggaaggaggaagagggtggattccaggctctagggtggtgcaccctgaacctccgcgagggagagaggagtccacgtggagtcagcagagctggctgctggccccaaatctcccctaaagagcaacagctaacgttcactgtttacgacgctaaacctactttacaagcattgcatcactgaatcctcacaaccaccccttgaggcaggtgttactatcttcattttacagaggaaactgaggcctaggagtcttatgtgacttacccaaggttgcagtgctggtaaaaggtggagctagtattccacctgcatgcaattccaaggcacactcgtcgcccctctgtaacacatgcctctaatgagacaggtgaccctggggcacaagggcaagtcgctcccactctcaggaagggcaggaagagcatctggctcggggcattcaaggaagacgagtggagattaaagggcacaggaaaagtaaagagacctgtccagggaattccacacctgaggcagctcagagaacccaagggagaacagccgagtctacaagtcccttccacaagagggcagacaaggccggatctgatttggggaataaagggaagaaaagaggatctccatgggctgggattcggaacaccagggaagagcagactttcaccatttatcagcatgtttccctggccgtaccctacatctgcctgatagcaggtcacacagaaatcctgattatatgatgttacttgacctctccaaacctatggccatagctatagaatggaatactagtcccagccttgcctactctataggtagagatgaggcccaaataagaaaatagatttgcatgtcctgggtaaactctacattgtcacacagtaataaggaattaagccattacggtaattgctactattgcataggtgtagggtgggttaaagacattgagccctactgttcagctattaaaccccattaaagggtgaagtaaaaacacgttggtaaagagttgggactcagctctgcagcaaggggaatggtaacgactgggcaaggggtgcagagtctgctcctgcttgggacctggatgtggccagtgctgggactagaggataggggagtgggccagccctgcagcatcaccagaccacacagacactagccaacaccctcccctctccactttagaggctccagagacacaatcccaggagcttagcagaatccaagggagcttgctcaaccaacctaattctgccaggaatatcaaagatgttaaactgacttttgggaaccactctctaagacagaccttgacaaactggaatgtgtttacggaatgcacccagactgagcaaacgactcaacaccaccttctatgagcaatggctgaaggaactggagctatttagccaggagaagagaaggcttatgaggcccatgaagccacagtgactaccagcagcctctaagcatggaggtcaggccaagtaaagaaaaaaacacgtaacagctagaaccttctaccactggcactggctgcaggagggaggaggctcactgtcactggaggtggtaagcagaggctgagtacctgcaaccaaggatgctacagaaggaatttctgaccacatacctgctgctgtccagccactgccttcttgcctgtcccttccatcttcggtgagcctggccgcccagacgcaccctctttgttgccattgctcatcaacaacttcttgagctccaaattttcctccctgggatggaggtaaacagagaaatcacaatgctgaccctgagttaagaaacctacagggctccttaatgctcactatcgcatgagttgcagctgagccccagggagtactgcaggatcctgaaacctgccctcctggaaaaccaaaaagggcatcttcagctaccttgctctcaatctgtggaggtctctgattgtcaatggcagggtttccccagctgtggaatttctatgcacacaagaccttccggatatatccaaacactgcattaaataaccctggatcacattctagtgagaaagtgacaccctttccaattatcttcacatttcttgtgtagaccacggagacggtgcgagcttggtgctaacaggccctgggcacctctctagttactcgccagtttccctcgttaacacagaaggtgcaggctgcaggcccagagccttcaatgtgcaatgatccttagcctgaatttattaacatcctttcactttcattgtatttagagttatcttctatttatcacaggtaatgctgttttccatttactctagttaaagttgcctttataattttaagtaaaaagatgaatcaaattaaagtaaaattctaagtaactaataaggcaggtgatagaggagatcataaaattagtgatgtggattcaggtctgactaaaatgtttcttctttcttttttttgagatagggtctcgttctgtcacccaggctggagtacagtggcccaatctcggctcaccacagcctcgactgctcctactcaagtaatcctcccacctcagccacccccaacctcccccaccacacacccccaccctcttgagtagctgggactacaggcacaccaccacacccagctaatttttttggtattttttgttggggctgggggaggggtggtgatgtatttcaccaggctggtctcaaactcatggactcaaagcaatcctcccgccttaacgtcccaaagtgctgggattacaggtgtgagccacaacgcccaaccaccacttctttatgttctatttgccagctgagtttccgcttgaaaaaccaataagtaaaatgactttcccaaggtcatacagcagagacttgcattcttgccttctaatccgtgacttttttccccagcttcagtttctgaatccatggatggggtcactagggctataaaaaccccaaaagtgcatccttggccatccaaaagcaaataaattacacactgattcaaaatagccagtggctcagtagttaaacattacttctgtggccatacttacaaagtttatattccttctctttctgttgattctaataagaaacaggagaggagggaaaaacagagtggcaagtcctgtctgtgacacgggcctttcctatgtgcctgagcccagctggtacccaccagatgactcatcacccaaactgtccaggaccacagtgcaggcaggaattgtggccactcacaggatggagagcaaggaggcccaagttcctgttgtaagactccaatcaagtccctgcctctccctgggcctcagtttcccctctgcacagtgagaggtctgtctgcatgatctccaagggcttgtcaagctctgacagtcaagatcagtgtttcccaaggcgtgatcctgtgcctacctcgttcataatcacagagactcctggtgaaatgcaggctcctaggtcttgcctaagacctgtcaattcagaatcttgcaaaggaaggaagggaaggcgtataaacttgtaatgcctttccctgaccctcaaccctcagttaagtctaagccccctagtccagtgggggagctctcatgttctcaggaagacagagcaggttgggatggtgaccagcaggaggcagcaaagtcctgagtcctctggacagccagttcaccgttaacaggggagagaggcaagtgctggaggaggaaggaagtacaatctatgctgaccttcttctgaagctctcaaggcactctatacacctcccaaggtggcaaaagggccagagagaaaataccaaaagagccaaggagaaggatcaagagacgtaacctccaaatagggctctgggcacagggcctcagagccacggtcctcaacccagaaatcagtgctgcacaccagcccctcctcctgcagcccccactcctcaccccttctctgaggggcctgaacttaccgcagcctctcggcagcctgatcccgctgttccaggcccttatccaacttggccttcagagcctcgttctccttccgaagctgctcacacagggtctgtggggcaggggaacagacagggtgagggaaaggaggggcccctcccaggtgcaggctgagctagaggatggtggggggcctgtagccaccccagggcccaactccttatcccctttgcctggcctcaccccatccctctctaaggagctaagccacttggccacccacgtgtcctctcccttgggagccaactacggagaagcctgaccaagtatcagccatggggccttctgctcctccaagacagacagctccatcccttctccttcatccctgctcccactgccgggacccctattccccaccagcctcccccagctgacttctacccttctttgaagtcttagtttaaatcccatctcctcagagaagtcctccctgactccccgatccagctacattaggctaactccgttatccttgctcacagccccccgcttttacgcttctcagcacctgtggcagataaagctaaagaactgttcgtgctgctgttttcttaatatctacccccttacccctaattaattcctgagctcccggagggctgggacccctaaccatcctcttgttcactgccagatccccagcccccagctcaaagtttgtggaaggaacaacatgactgaacagccaaatgagcaaatggacaaatgagcaggcgagtcctaggggggctgaaaggcacaccaatttgcaggtgtgagaggtgcccagtgttgccaaggggaaaaccagaagacaaggcattcagtcgggacctcactatgccctcacgccctcacaatgtggctgtgacacttggttcctcctctacaaaagaaagacaactgtttctcttttttttttttttttttttttttttaagacagagtctcactctgttgcccaggctggactgcagtagcatgatctcagctcactgcaacctccacctcccaggttcaagagattctcctgcctcagcctcctgagtagctggaactacaggtgtgtgccaccatgcctggctaatttttgtattttcagtacagacggggtttcaccatgttggccaggctggtatcaaactcctgacctcaagtgatccacctgcctcagtctcccaaagtgctgggattacaggcatgagccaccacacctagcccagggacaactgtttcttctctgcctcctctatagggctgctgagagggacagatgagacagtgagagtggaagtgtccatgaaccatcagtcacttgcttatgtgcggggactcatattggaagctctgtgaactgggggcatggaagaggggtcgccagactcaggacctcacaggctggggggaagggaaggtgctgactagcaatgctagcatacagtgtcagcacagagttgttcaatctttccacagatcctcactgagcacctcacctgtgccaggtacattgctcggtgtttctccatatactgcctcactggtgcctcacaacttcctcaaagctaagtaactcatctctatgttaaaggtagggaaaccaggtaaaatgatacagtctaacaggtgcacagctgctaagactcatcactggcggggagtaaaactccaattggcagaccccacactggtgtctctttcccctgtgatgaaagatcagagaagggagagagatggtgcccaaaggaggggacagcctttgagctgggccaggaccagggccattcactaaacagccatctgctgccttccacctcccaggcctgttgcaggtggatgcaaccatgtgactagttctggccaacaaaagaggtgtagaagggacaagcatcactcctggactggcctacgcacaattctccagtctctttttcctggtagcaggggctgatgtggatgcctcgtattctaaagggcaccggaaagttgggcccctgtctccctgggactctaaggaactgtgtagagcagaaacaaacccctgccacacagaataggagggaaaacttttgttgtgtaacccagggagatttcagagttgtttcatttctgactcacaaaggagactcttgggaaggctgaatggaggacacagccttcaactggaggtggctggacaatgagggagatgaggcttagcaaacagagaaccagctgggcatggtggctcacaccagtaatcccagcactttgggaggctgaggcaggaggatcacttgagcccaggagttcaacaccagtctgggcaacatggcaaaaccctgtctctactaaaaataccaaaaaattggccaggcataagggcgcatgcatgtagtctcagctattcagggaactgaggtgggagaactgagcccaggaggtcaaggctgtagtgagctgtggtcgcaccactgcactccagcctgggtggcggagcaagaccctgtcccccaacaccccttaaaaaaaagaaatcaaaaaattattgttatgagtccattcaatgcctagcagagagccttatgctatacctgaccttgaatatgtttgtttagtgaaccaagaaacacatcagtgaatgaatgaggaggaactggatcaatacacctccacccaggcagtaaaaatacccaagatgccatgtctctgggcgaggcctccagggaacagaatggcctgctcctagtccctaagggaaggccaggacaaggcctcacttgctgtcctacccttgcagtctagagagctgtttccttggagtctctgggccaatgccctgggtgcaaaccggccaatggatagaatcatcagaggtcacaaagatcatcaccttccatccaaggtgctacgagagctatgagttcatttgatcatttattattttgtcctttcattcattcaccaagtgtgtatgaagtgccacgaactgggacgcaacagtgaatacaacagacatggtgcctgcccccctcaagcttaccttctagcagagagtataagaaaaaaaagagtataagaaaaaatgtattaaataaaattattacaaactatgataagagctaagaaggaaataaacaaggaggggactgaaataaaaaataacagaggttggcaggaccccttttaaggggcctaggatctatccccatctcaaagctgaaaagtggatgcgcaaagtgctctcaccccaggcaccttcctaccctgcccacagcctaggcactgtgccaggctcaccttgccagggttcagcctggataccttgaagcctcactgacatcttaaaggggttcccttctctcagcctggctctccaggcctctgcctctcgttcagcctcacctcccaacacacccctcccctccaggtgggatgggcatcctccgtgctcctctacccccacacctctcctcatactgcatctccaacctgattgcccttcatgccctcggcaaccaaggtcacgcaagggggactcccccttctgccatcagcggggcacttgagtgcctgctgacatgaatgagaccacagatcagagaatggcctgggaggagagtctgcagggagtaaggaggcttcaagtcatggctctgtcactaaggtggcgggcactcagatcacgagcagtccctcagaagcctccgttttgccatctttagaatggtcaccaattataactgaacacttccccgctgctaaagcccacaaggctaagaccccctgcccagtgtggatgcccgtcatgaactccgaatggggacctctcttccagcatggactaggttctggactgcactgggtgcttcatgtacatggcctcatttaatgcagcaatctaaccatggaggcacttctagctcatgttactgataggaacattgggggatagagaggataagtgacttgtccaaggtcatacagcaataaagggtcactactggaaccaaggaccatataactccaaggtctggcctggcctagcaaggaaatctgtccattccccacagcacagggaggctttcaaaaggaattcaataggggaggcaggttgggatggtggtcaagagtatgggctttggaatgcgagagatcgaggttccaatccctacttcaccatttaccagctgggtgaccttgggcaaaaaaagggctgcttccccacctgtgaagtggtgataatgagggtgcctaccctggggggaaagaggcattatgaaaggagttgacctttgttccctcccttcccatcccccaaccctgcacatgagaaataaaggcagggctgctgggggtatccccaaccatgacactcgcattgcccatcccgtatttccccatttccttcctcttcctcatccctccccacaacttccttatcctgttcatcaccctgaacaaaaagcccgaagtctgcccacaacacagccttcagaagtccccatggtaccagtggattcccaggagcaggaaggtgggaagagctcggggggaagcacgcctgcctgtctcgggctgccctccccacgcgcctcacctgcagaatggaggtgcgctgctcattcttgtgcaccttggatgccagtcggttgaactccagggccatgcggcccaggtgggtgaagagctggccgtggtccggctcctcggcacacacactcagcgtggtctccaggcgctgcaggtgcagcatcaggttgccgtcctcacggggcagggggcccagcgcctggagagggaaagggcacacggcccactcttcaccaaggcctgagtaggcgccgccagtccattctccctctgcttcctcatttctcatgactcagtttccccctgtgaccccagctcagccccgggaaattctccagttatgcaggttccctgtctggggctgactcacagggcagaacccaggactcacaggccactggtggctccacagcagcggggccaccatcctcccacacactgggccttgcagagtgcctgacagtaagtcacttgtctgctggacctcagcatcctcatctaccaaatgtccgcacaacccttccctcccttcaacctcacagggttcttaggaggatgaattgacccctgacagtaacaagcccagaaaagggacatcactgcacagtcagccctccatatccatgggttccgcatccatggattcaaccaactgcagatcaaaaatcttctaaaaaaacaaactggccgggcgcgatggctcacgcctgtaatcccaccactttgggaggctgagcgggcagatcacaaggtcaggagatcaagacggcctgagtggtgaaaccctgtctctactaaaaatacaaaaattagctgggcatggtggcacgtgcctgtaatcccagctacttgggaggctgaggcaggagaactatttgaaccagggagtcggaggttgcagtgagcagagatcgcaccacagcactccagcctgggcaacagagcaagattccgtcccaaaacaaacaaacaaaaaactgtattgaacatgtacagaatttttttcttgtcattattccctaaacaatacagtataccaaaatttagcatttacattgtattaggtatcgtaagtaatctagagatgatttaaagtatataggaggatgtgtataggttatagggaactactacgccattttacatcagggacttgagcatccatggattttgggtatcctcagggagttctggaaccactctcccatgtttaccaagggacatctgcatatacgtcctgcaacctccgcctcctgggttcaagcgattctcctgcctcaggctcctgaggagctgggattacaggtgtgcaccactacaccaagctaatttttgtatttttagttgagacggggtttcaccacaatggccaggctggtcttgaactcctgacctcaggtgatccacccacctcggcctcccaaagtactgagattacaggcgtaagccaccatgcctggcctacacatgtgtcttctggggaatggcccaagcattcatcagcttctgaggacccaagactcaaaacagtttaaggaaccacagctttagctatttcagaaagtcccaaactagtacagtatgtaagaaataaagcacaccgtgggccagatagttgactctttctctctagtctatctggaatactcctaccaaagacattgcctttgttacaccaattccactcccaaggacctgcagtgttaccctactgcagacggcactgggcccagctcccctgctgggcatctaaggccctacagccgcaggtcccatccacagcagcatccagttgggctccccactttaccctgcctgaacccacacacaccaggtctggtgtctctgcatgtgtcctctctgtgtcctctctgcctctgcaagttctgctcatccttcccaccctgtccacggctcagctcctccagcagcctcccggaaacagttatgggaatcacaggacagcagagctacagggagcctcagagatcaggccgggaaaccaagctatggggaggaggaacttgcccaaagttgccctgtaagtcagtggcagaggtataacgagaactgaggtttcctgactcgccatccagtgctctgctgcactgacctcccacttctctgaactctggaggaatggcaatgactataaccccaacttggcattccctgaacacctgtgtaatggcgtcagtgtgccgcattctaacaagaggaaatgctgctgtttcaactctgcatccattcccccactgcctctttccacaaaggagctgaggtggcagatgctgctctatttaaggctcatgcgatgcttcccatgcctgcgacttctccagactacaagcttcagagcacagggaggctgtgttgtcttggctcaagtggctcagcagagacaggcacactgtagagctaatgaggaacttactacgtcagttaaagttatcggtccaaagtcagagtgaaacactttctgagcaggggatcttgcctccatggccagcatctcagagccctcagggacagaacaggacaaggggacagaaggttccaggcgacagaacataaagagcctttccaatactcagagctgcctgaggcagtggtgagcctctcaacactgaaggcatgctagttagccagacagccacctgagggggccctgcactgggcactgacaggtacatggggcaaccagtgaacacaagcatatttgtcagccaaacctttgtgaagggaggcagcagggatcaatatatcagtgaagggctagagcacctattgctcgcataacaacaattaaagaaaaaaacttaaaagtgggaaggaagggagaatggagaaggtagaaatttaagtcgtttaaagaatcttccagacttttcacaatggttcttcaataagtctgccattttaagaaagaacagaaggagatatagttaggaaaaaggcagccagtgttgtaaggtgtggaatgaggatgctgggcagacgctccagagctgtacgagagacagagagagagagagagagagagagagagagagagagagagagagagagagtgtgtgtgtgtgtgtgtgtgtgtgtgtgtgtgtgtgtgcgcgcgcgcgcgcgcatgcgtgtaagtggaaagttgaacctccttcctgtgtgctccaagagtctgcacaaagagcaaatcacctgtcttacagggccctgggccttcctgacccttctttctcccccggggttggaagcccacagacccaaagggctgagtcatagtgtgcggaggtgcctggcccctggcagaaggcaacagggctggcaaagagcccaggctttcacaacggtcgggtgcccgtgtgctccaagtcggggaagtcactagcccaggaatttgcatatgtgagcgagaagcaccctttgctcctgcccctcgtgtatccccaagtgactccagggtacctaagggatctgaacaggttctgtgcctctcacatggtagcaagtgacaggacacaaagagggcagcaggtcaagcccggggtcctgcccgtccactcaccatcgcattggcatggctgctgctctctggtgaattctgctcctcaggagtgaccacttcaaattcagaggaggtgccctgtgcagaaaggaagttaggtgctgcccgagagaaaaacagctcacccctcctctgcggccctgtggctgagagcagcaagggggacaaaatctcttcccattttgagtacacagggaccgttacatatcatctcacatgagatcacaaagcaggattctcgacaagcctgtcatagccctctgcataatgtgaggtcatatcccctcgatggccaatcctcttttgtagaagggagatgtgggactagctgaccttgaaccagcagcactgtaggattgcattttttaaggccgtgtactttttaaatgctttcatgagctccattatttctcagggtgacccatggagtgggtcagaaggttatatcctctttggaaagatgaggaaactacagtatacagttggttaatgcaaaagcagggattgaacccaagactgcagatccagcattcctgccacggccccagagctgtctcttaggcccagacgtctctgatcggtttcccagaacacagatggcagctgttacggccaccaccaagcatgtcctgtgctggccttcccaagccagtcctggagatcccagaggagtgaactgatctgagaaaagtcccagagatgattcaccaaatttggagactatttcaggattcaaccaaatccacggtggccaagaaatcccagattttttcacatctttccgtcattcctagtagaattactggtcattcaaccaaccaagaagccaatggcccacctgaaccagccattagctctgggatctgggatttccatgtcccgttaaacctggtctgcagcctcccttcatcccagaaaggggcaggatagatgagaggagtcagtgctcagcttccagctgaccctcatggccaccaagaactcacctctggctcttggccctgccctagaaagtctccctcctccatctacattttccccattacccgtgtaacctcagaacaggtccttctttccctgcacctgatctgtaggataaggatgctgaactatgcaatcccttgtaggataccaagcaaaacttctccagccaaatctgtagatttttttttttttttatgagagggtctgactctgtcacccaggctggagtgtggtggcatcaacatggctcactgcagccttgacctcctgggctcaagcgacccttctgcctcagccagcctcccaagtagctggaaccacagacatacaccatcacacctgactactttttttcttagagagatggagtctcactatcctgcccaggctggtctcaaactcctgggttcaagcaatcctcctgcctcagcctccccaagtgctgggattataggcatgagccactgcgcccagcctgtagaagatagtttctgagccctctttgagaatgtgagctccatgtcacatctgtctgttttcctagcactgtgcacactcagtgatacttaacagtatacaacttagtaagtgagaagaattccttgtacataccagggtcttcctggtaagttttaactatgaccttcatttcaaaatggggaggctgaggccccagagagtttgcgatggacttgcccaatatcacccagcgagacggaacacagtttcttgacctcaaccctctttcttcatgttcttgtatctgtcagtaggacttgaggtccatccaggcaacctccacccatgactccaaataaaacttacactggatggaggcttctggactggtgctggcttgtcactggggcatgcaggggctgtgggagatgctgtgacatttgagtcctttcctggagaatcaagaaagcacagatgaactgactgggaaggggagaagcccaggtaccaccctctcaaggacagcccttgacaaaagggttctcagacaggattccccactcgagtgtgggagaatgggaggtggtctcatcagggccaggtagtctgagaaaatggcctgccctggagtgacggggcagagcctgagcagagagaccatgctccctgggcttactgggaaaatcccaagttggctgctgctccttgctgccctgaacaggcctcaatgataaagacaatgatttacaatttgaaaagtctttatgtatctattatcccagccattctcataaaagccccatatccccattttaaaggtcaggacactgaggcttgggaaggtcatcaacttgcccacagccacatagccagcaactgcaaactcaggactgagacttggccctccctccctgacttcctgcagtccttgctgcagggagctccttgaaggtagcttcatttctcactctgagagtggacctggcaccaatcaggaactcaggaacattgctgaatagacaagcagaggctggaaatgcccactgactgcagcacagtggactctgagaccatcactttcctccatttgtccattcagcaaatgcaaccaccagccaatagaaggctgtcacattggcctgggccagataccatacagtagagctgcagcaggaggcatctgagtccagctgaggtgcggatcatttccatcctggtcccagaccttaccctggacttggagacatgccagagtaatgcacactctgtacgcatggtgatgcctctaccatacatgggacttcaaccccgagccacagtcaccctgtcctttaatgggcagcacacgtaaccttacatctgaaatacgctgcagcaggctaacaggcaagcccagcttcttccctgggcctcagcttccctaattgtaaaatggacgcgcagggcacgaccagggagcttccaactcatatgccagctccaagtgacagggagtagctgcttggagtgcgatgcctggcacacagtagctgctcattaaatattaaatatgctgataaagaccccaaggccacaggactgcaatgtagtcaactgttgtatctattactcatgtctgctggggcctcaggagtgctgagtcactggctatttttaacaagattgttttgaagtcccttccaaatctgaccttctgggggatgtggcagccaaaacatgaatggaagggtagcctgtgacctaaggataaacgagagaatgtgggttttggcataagaagggagttcactgtgaaggatttgggcagtttggggtacagggagagtcagaggtacccagactcctcttatacctgtgagctcagccagggggtcgaaggagcccaaggagggagaaggtggtgggagcagctcgttgtccttcactagctcctctgccttctgccggagcctggtcgcttccatctgggactcttccaaaagctcccctagagttattggggaagaggaagcaaaagcatttactcggctcagtgtgctgcttctccccgtcccaggcccctaaccgtgctgccgcctggcttctgaggctccaggccctggacttcactcccaccgttgctctgtgggccaagtgggacaaactccatgctggtccaccataagaaacaggctagagcaaggacgagggcccagcaatcgggggacacaggagcggaaggaatctatgagaaactcctcggctcccccaacccccagcattctctttctgccccactcccttcacacccagccagggcactccacagaaagccaggggctcccccaccctacgggctacccacagcctgagccaccagggcaaagggctgcctgcagggcggagaccttggataattccaaccagccctctaggcctccattttccttctcctacaagtggagatggggaaaccactcctccctccccagtcggccatcccaagcaaggatctgccaagcaaggagaaagcattttaaaaatcagggggctatgctcccctctaaaacatgagactagagaagggcacggcaaggcaaaggaagagtttcaggagtgtggaagaaagagagccccctctggatggggaaatcaatgaaagccttgtctggaggagaagggggcacagcaactgggtgctgatgcacagggcccgtcggtcgtgtggagggaggtggggttgttctaaagtggggatggcttgagcaagagccaggagaagagaactgagggacctaccacctccttgcttcaagccaagctctgctccctgctccaacacctaggaacgcgtgccccagttgcctggtcatgctggctctccccatctctcgtgccccagaaagaggagaccactctagttccatggccattaactgggccttccagccccctttcccttagcccacgcctccctcttggacctgagtcctgtcatcctggtttccgggtgctgaggaatcagggttgggaatactgtcaccatgctacatggtgcatagagacagctgtgaggcaggagccagcgctgggccaggagggacaggggatgacttgggcagaggcatatgccagcttcattctccactgctagtagagggactggcatcacagtctgcagggaggggcgctcgcagggaggggacagggtctgctttacctaacatctttatcccttgcattttttccttcagccgggaattctccttcactaggcgctcaaaagctgcggatgcctctcctgagggcacgctgcccccagggtcgtagatccggtacggtcctctcccttccatgagggtagctcagcccctgccgtggtgcccgcctggctgtaaggacaacagcagcatatcagcaggctggccaggccatgggggcatcctttgcagagaagctctagtctgtcaatgccccagaaggcagtcccccactttaagctggtctgaccatattatagtaaagcaggacagtcacctccttttatctggacgctctgcctctattaatacaaccttagaatggcattagtttctcttagcagcctcaatgcactgttggcttgtttggaacaggagtccaaataaacagtagggtgcaatgtgggatacaagaaagaacctggacttggaaaaaaaaaaatctgagttcatgtcctgtctgtgaggtccagaagaacaggaatcccatatgttttacccatcattgcatcctcagagcctaccacagtattagctatgaattttgcccaataaacacttactcaattaatggtctaggcattaatttactatgggattatgggcagtcccttcccctctctgagggagggaaatgaaagtcttaagttaatttagtaatctttaaagtgaaatgcttgtaccctaagggataagcaagtcaacccagtccaaagttccatttatatgtgtatcatcttctttaaaaaaagaaaagaaaaaaacaccctgactaatatttaatacactgtcaccctcctccgtgagtctcatatcatatatggtctgtcccttgcagttctaaggaacagaagaatttttcatcaaaccactgtctatttgagcaccaaggtttttttttagtaatctgttcagtttcatctgctttatgtcactgaaaccagttggaaaggtgattttagaatcctaactctgtggcttagtagagaagctctctgtccattcactcatccattcaacaattacttattgagcatcgactccgtgctaggcaccagtctgggtgctgaggaattatcagcaaataaaacagacaaaaatccttcatggagcttatagtctaggggtgaaagcagaggaggatggtggggaacacaatatttcaggtaatcaaaaagtctatgcacaaaaggccccaagcataaggagctattttagccaagacctgaaagaggtgagggaactagccatgaagacatctgaaggaagaacattctttgcagagagaacagtaagggcagaggccctaaggctgaaacaccgagccagcctccagccctccaaatagctctccagcatgaaagggccaaggccttcactggggacctcagaagggtttgggggctcggcaccttcctcccaaggtcaccacccccaagacaaaaactgtttcatcaggaatcctcaaagaccctcccaagtccacacaccatgctccgtgggtccttggcgctgccaggtgactacgaccataccaccctgctcccagaatgtaaatgaaagatcagagtgagaaaggattaacagcaacaccaccatgcttgaatcgcctccttgtcaggcactgcattaaatgtttcagatatacaatcttggaggagctgcacagtaactctaacatgcatactaatctcatctgcattttacaagggagaaactgaggctcagggcggttaagtaactcagccacgatgacccggccgcaataagagccaagatgcaaagtcagccctgcctgctgtgactctgacccccaccatactcacacagccaggacacagagccagaggggcagacagggagttcaaatctctttgtagggcagcaccatgctatcaggtcacctctgggcagtttcccttgccctgcagcataagaaccaataaggacttgtccaagagcgtccataggatggaatgggccagaaagaaaaacaaagttctgatgagaaggaccccttctcccaaagactgacagatacaagatgaatacaccgtgtgggaggcacccacgccctgctgagcctgcgaggcaaaggacagctacccacactcccatcacaagtcatcacccggcttaggggtgacttgtttttaacctgaaaggtcagtgttctacagcatagcacaaagtgcagatgtttccaccgaactaagaaacagtgtgggggctgcacttagcactggaactggcacatagtaaagtactcaaaaatgttggcagacattgggggtccttcccctctgcttgcctctgtcctcacgaggcttgccacctggtacagcatgtgtctgactggtgcgggcattgcccatctggctgggaacttcctgaggcaggagcgtactttgcacatctttgtattcctgtcgggagcacaggagggtgggccttccttgagagctgcttggagttcaagaacagtgaaacagagggctacaaggggcctggagccaccttgcatgacaaaggcagcagtgtcctggttcttgtccaccattatgcattcaccctaaatggaactcacagtcaacaccacatgaaggcatggggaatttcttactcaatgtctgccttgtcctgtagattagaggctgcatgaggacagggagcaagtccatcctgtgtgccagggtatcttcagagtggcccagagtagggcctcggtaaaccttgaattcagagaagtcagactgaagggaacaagcccttgaccccgaccccgcctcctgcaaggccatgtccaacatcccagagaaagcctaaccctgacccactgaccagacgcacttggacgcccagacacttctagaatccaggctgggccagccatgctccctcagagaggcccagatgtaaggcgaagggacaaagcaggatgcaggatgtgggaactgaaacccaccccacgtcctccaaaacacgcaacactcagtttctcttggcgctggggagtcaacgggaaaggggttcatgggaaacaaaaagtgggcagacagagctatgctcccctactttagcctcagggggcagagcttggggagaaagaaaggcagtgggcagaggagacgcaggagaaatatcctattgtgggaaaaccctctctggagatcagaggagccacccctggagggcctggacttctggaggaaagaaagacaaagagggaaacagggaatttccaagttctgctgacctcatgcccagatggtcagcggcagtccctggatgaccactgggcagacgggaactctccctctgatcaatgaggtttttataacttctcccagagagaggactcattctcaggatgacagagctggaggggactctccaagggcaatgaggcgaatcctgcattatcaggtgggagagagatgcacccagaaacactcaatggatgaggggctgcattcgaacatgacgatggcatgcactcccctctgctgtccacaaaccacgaggatgttttcaaaggggaaaaggaagcactgaccactcccctccatgtggcagtatctggagttcagagcccaggagtcctcgggcatgagctcatctgattctcactcacggcacaggcagtgcagcaaggcaaggccctgagcagggaaggccaaggtcacaaaggagtcaggatggagctgggaccagaagatccctgctctccctccaggctgcccacagcccatcctccatttcccttcctgcccagcaatcccatggcacaccacaggcccccaccacatcttctcagagtctctttccacctggcctggttccacaaactacaaatcagcaggtgctccaccagcagtgggactccagccccgcttgcccaaaccagaaacagctggtggtatagaagcagccagcgcagactttcttccaaaacaagacctcagccagcggggcctccacagcctgccccagaggggccctggggctgcccgctggaaccagaaaggcccagtttgggggcagaaaggggcccagacagacggcaggtcaggcaacaaccacagaccgtgaagatggaagtgatgctgctgaaaccgaaggagccacccactagcaggcaagcacttgtgggtggcagggaggcagtagtccccagggctcaactctcagccttaccccagaaagagaggggtatgataaagactacattcagaattaaatttacattctagcttttgctctgaaatgctttggtctgtcagattatcttcccattagcagtgttctggtggctgggtaggggggtggtcccagaccccccaaatgatattcacttgcatagccactaacatttgcaaaatacttcatagtgtcccaagcattgtttttccatctgattatcacaacagccctgggaagaaggcagggctgatacctgcctgatggataaggaaactgaagtccagcttggggacttaatcagcccaatttaatgcctttggtcactggctgcatcctggggccagctatccctgcaaccctggagcaggtgatgccctccctggcccagagggaaaagtgtaagcaaatctctggtacagggaggtggaaggtcatcgaggccaacatctacctccccagcagaggtgagggctgccagggatgctggcaggtgggctggcagagggggtatagggaaggggtctccaggaaagacggcacagaacagaacgtcagagaggtctattctagtgtctactctgctgtgtatggaaccatgggctcattccctcacatgcaaggggaggagcatgggccacacagaaaccgggtgatggctaaagctggcctcaggatcaagaagacccaagtctcaggagctagcagcaagctgaggaaagagagagagccagcaccatggaaacatcgctgccttggaggcaggaagaaaggtccacacagggaaagtgctcaaggccaaccttgcgaacacgaggcctgagagggggcctcacctgcactagcctcagctctgtccaccctgtgggctgtgaaaccctggagcagccactcacctttcctgagcctcaggtgcctcatctgtaaagcaggagtaataatagaacctacctgatagaagatcaaagaaattaaatgaaacaatatgtgtatagttggaagggaattctcactttctactttaggcaatacttcctgattatctgatttaacaagaaacacatctttgttttataataagatttccaaaataataagagtatacagtaactagctcagcatttgacacacagcaggtgcttaataaaaggctgaggcaaccccacaactgtgcccagcttatctaagggccaaggctttccccatttgttctctcctttaatgggattttaggctcttccgtcagctcagtaagctaggttctggcctccacttattctctagtgacctgcatatcaccatttaactgtggttaagcagggtgcctggacacaccatagctagtgaacatgtagctataagaagcccttgaaccacgatgccacactcaccaacaactgggaatctgagcctcatttcctctgctgtaaagggcaatatcctgcaattccacccaaggatgaaaggaagtgagatgccatgatatcacattgcagacataaacaaaaaactgtccacatatttgtgttatgatgacctccagtcctccccaaccaatttccaggctggggaaactgcagcctcaggtccatccatcaaaggccgggttggatttttcaggcagtgaaactactctgttcaatactgtaatggtggacacctgccattccacatttgtccaaacccatagaacatacaccaccaagagggaacactgatgtaaaccatggactccgggtgacagtggtgtcaatgtagattcatcaactgtaaaaaatctaccactctggtggaggatgttgataatgggggaagctatgcctgttaggggtggggggggcgcagtatatgtaaaatctctgtaccttcttctcaattttgctgtgaacctaaaactgctctataaaaaataaggtctttaatttaaaagagaaaaggaccaggctgggctctcctgatggctgtcaggttcacacatgagtgaggacacagcacatacttgagacagtgtgtattcaaggaccgcaccctggcatcctcaccaacaaggagcccagacttaactcctccatccttgcaatcaactgagcaacaatgaggctgcagacacagagtctcatatagtaacagctggggcgccagaactgtgggatctagtcaaggtacactagggcgaacatcttaaccctcactaggcctcagttacctaaaaagagggagctgcaaaaatagtaataacatggggggttgtgcgggataatcattaaggccccttccagttctaacatttcaggatctgaaatttattagcactactttctttaaccttctaaccttaagaaggctccaatccccagctccaatcccttctaaggcccaggtggatttccctaacccatcagtcctcccataagagctttcataggtgctatcccctccccgagggcagtcagagaccctcagctgacatccgcagccctgtgccaggtcctcccctcctgcctaacttgtaccaggctctggccaagcctgatctgtgttcctcaacatggcacacatcttcccatgtccttcatcctcccctcccgagtcacccacaaagaaggccccactgtctccactcagcctccgaggcccagattacacaccacccgctaaacacctgagccagaattcacactgcaaaagaggactggagagcacctaactaagctggagagagggtgacagttcgttaggcgctaccgtatgccaggtgctgggccgcatcatgacgcacatgacctcattttcttcttgccacacagatatggaaattatcatccacactttccagcaaggaaaccagtcgacgcagctacatggatgaggaagcagactcagagaagttaagtcatttgcctgagaatacacagctggttagtggtagaacaaataatgcagcctcaatctgtcagattccaacatcagtgccctttccactgctctacactgcctggagaggcggcaggctgaagctcagaggtgggaaaccagacctactttccagttctccagaacgtgccccaagttcctagcccctgcctttatatgtctctagctttatatgcaaccaggtggcaatctgccccacatcacctgcagtcaacagggtttagaatctcaggctggaagggagctcagaggacattccatcctgtgcttacccagtcctctgaggagcccagggactccagctggccaactttagcaatccagatctcaccaacttcctccccaaaacaattcctggggcagccagcactggctacagttaggctgctcccagttctgtttccactggcccttctctcccctctgtggtcccctggaataaggaacaagatgcccatcttcagcatgacagccagccctgaggacatttggaacctgcagccttctctatactgttccacatagggactgccccccctccagtcccccaccaaccctctaccccacactatctctagttggttctagcactggacccaacattccaggcatggtttgcctgaccaaatgcaggctttcacctccacccttttaggtagtatattcctattgagggagcctgggtatacatttgcttttcttacagctgagtcacctactgaagaatgtcctttctcaatgacaacaacctgcatgtatgcctaactggtgagaacaaagttctcatgtagaaacgtgtgcttgagggctgggtgcggtggctcatgcctgtaattccagcactttgggaggccgaggtgggcggatcacctgaggtcaggagttcgagatcagcctggccaacatggcaaaacccagtctctactaaaaatacaaaaattagccaggtgtggtggcgggtgcctgtagtcccagctactggggaggctgaggtaggagaatcgcttgaacttgggaggtggagattgcagtaagccgagatcacgccacagcactccagcctgggagacagagtgggactccatctcaaaagaaaaaaaaaaaaaaaaaggggtgtttgaggaggtgtgagttacctaagggggcagaagtaactgattgattcagtaataccctatctaggaatctagagatctttgcatcagtacacagaagctggacaaaaatatgcactgccacatgctttgtaatagacatttttgctattcttgaatgtccatcaagaagggactggttaaacaaaccaccattcattcgatggaatactatacagccatcaaaaagaatggggtagattgcttggcaatgatacagaaagatgcccataaaatacaaagcaaagtgcagatttatatgtgtaacaggatgctatttttttcaaaaacacattgtgtgtgtgtgtgtatacatacggaatcttaaatgtgcatagaaaaaggcctggaagcccagtgctttgggaggccaaggtgggaggattgcttgaggccaggggttcaagaccagcctgggcaaaaagcaagaatagattctctattaaaaaaaaacttttttacattagcagagcatggtggcacatgcctggagtcccagctactcggaaagttgaggtgggaggatcacttgagcccagcagttcaggctacagtgagctatgatcatgccactgaactccagcctgagtgacagactaatactctgtctcttaaaaaaaagaaaagaagaaaagaaaaaagtctcaaaggatacataccaaactgctactagtagactgctctacagaaggacctcggtaaggaactaaaaccaaaagaaacttttattttacctatgctattttaactctttacatgggaaatctagtcctgttcttatacaattataaaattagtttttaaatacagtagggacagaggaaggggaaaggaaggagagagaagacaactgtcattttttacattatatcttttgtactgcttgagttttggggggtttttccccaataatcatgtgctatttggtaattttttttaaagggaaattttaaaatatttttctaaaaaatttaagtgagctgagtgcagtggtgcatgcctgtagtcccagctactccagagacagacgcaggaggatggcctgaaaccagagtttatctaaccctgtaactcccctgcctccaagaggtaagatgccaattttggggaattcctcttatacaaaatatggtggaaagagggtttcacagattcaaatcctggctatgatcccttctcgaatgaccctgggtaggcctcactttccttgtttctccctatggaaatgttatgaggaccaagtaggaaccatagagttctctgtaaaccttaaaatgctacccagacaggagcagtaatggctgccaaggagctaggaaggaaaaggggctggacaggggctgaggtactcagatgaaagccaaagatgccttgtgttaacaacaaaaagctgaaagctacctaaaatgaagagaaaaatgaataaatacattgtggcaatttcctatcaggaaatactatacagcagtgaaaaaagaatgagccacagctggagatacgaacatgaatgaatctgggtctcactctgttgcccaggctggagtgcagtggcatgatctcagttcactgcaacttccacctcccagcccaagtcatcctcccaccttagcctctcaagtagctggaactacaggcatgcgccaccacacccagctaatttttgtattgtttgcagagatgggttttggccatgttgcccaagctggtctcaaactcctgggctcaagagatccacctgcctgctctgcctcccaaagtgccagtaaggcatgagtcaccacgctcagcctaaataacatttttaaacataaaaaaatactatgtattatttagggatgcacacattaaaaaaaaaactttaaagaaatgcaagaaaaaaaccccactaaattcagaacacttgtttcttgttggtggctgatgaaggagaaatttcaactgattggaaatgtgttatttcttaaaccagatgagtgagcatgtaggtgcctgcgtgttaccctcggtatctgagagactccttcaatttttcttttttctttttactgtattgtttgctttttttctgcttcaacttttattttagattcggggggtacatgtgcaggtttgctacctgggtatactgcgtgatttgggtaggggtgatcccatcacctgggtactgagcatagttcccaacagtttttcaactctgcctccctccctccccactctagcagtccccagtgtctactgttgccatctttatgtccatgaggacctgatatttagctccacttataagtgagaaaatgcagcatttggttttctgttcctgtgttaatgtgcttaggacaatattttctaaaagtctatgttgccagtttcctgaggaccagatcacgcaggagttgcacctgcagagacagaagtgggctggagagggaccagggctcctaagtctgctgctgaagctgactatagcgaaggcaaaggacaagtggcctgaaggccaacagagagcctggccaatgctctgcccagtgggtggagactgagccaaaggcccttgactcatagggcagtcccatacctgccctggcctctcagcatgactccttggtgacacaactcccacagcacccacacacctacacccacctaccccacacacacacccctgcctgggctgcccggtttgtccactgtgtaggtgctcaaggacgcagagctcctgcctctcaaggaacagcctcagggtgaggtccctgggagagaagagttcagctctgcccagagcagccctcagacaaacagccagctgctgctcaccagtcatccattccaatctgaagagtgactgtcctgggccagtcatgggaaaatcatcaagaacttcccacaatggtcatggtggccgccaaggtctttctctgggggttgggagctgtgctcccccacaaaacaaggggacccagctgccctgtgccttcctgtggcaactctctggaggatgcctggataccctccctacagacggccagggataggaggggcaggcactgcaggcatgtgggggcatagcagcaagaatctaggagggcaggcacagcaaggcctggcccagagggaaaccaggagctgccagagccaaagagagggtgacccaatcattggttgttatagagtttttaagacttggaagagaatgccctgagatgccagagagtgaaacattttcattctaaagctgggaaaccaaagtcggcaaaggcgaacagacgtgcccacagccacatgggacagcagtggcacagaagaaatgcacacctcgtcctctggtggccactgtgcactctcttaccacaccatgctactgctcaacctctccccctccctcacagtggtcaggtaagcaatgagggaaaatgatggaggtgagaaaggaagaacccgggctgatgtgggcccacaaaagaaagaagtctggaataacactggaaggggctgcctacgaggtggaaagcgccctgatcccaggggtcggggtcacgcagaggggcactggggctgttgagggaatgcaagccaggtgtcttcaaagccccacccacatctgagtttccgccactccaaacagggacagatgtttgagacaaagcaaaggacaactcatccagaggggacacagcatggaccacaagtggcagagggttgaaggcaagtgtcttagtctgctttctgcaactattctgttgaatatcacagactgggtaatttataaagaacaagtttatttggctcatggttctggatgatgagaaatccaagtgcatgacaccaccatctgacaagggtcatgccaaggtggaagacagaaggagaaaatgagtgattgaaatagagagtgtattagccaaactggccccttttataactaacctcccgtccccctaccccgtgatagtgacattaatctatttatgagggcagagctgacaatccattcatgaagcagagggattacgtttccaagatatgaacttttgggggacacattcaaaccttagcagcaagttatccagagcacagaaaatcaaaccagtctcatcatcttctactggaatcctgtcaatagcctcatgattagcatcattaacgataatagcagcgaccctgtaccaagcgcttaccacactggtggcccgtgctgagtgcttgccacacactatcccattaattcccaccattctaggaggtagcattgacgtcatacagagctgacaggtgaggatgcagaggcccagagtgacagacacggcacctacccaggtctgccaagcactgaatcatgtgctcttcaccaggggtgctcaaggagcagcccggaccagcggcactggcaccaccaccatccactggatcggatgctctggagttgcagcccagcaatctgtgtttaacaaccaccctctacctccatccccaggattgtgatgcatgctcatgtttgtgaaccaactgctctgaccatttcccaatgctgctaaggagaaaaatcaacatttctatgtctggtatcaaaatcttttagggtctttcccaggccaactggtcaattctcccaaccgaggagaggctgattccagttattgtgactagtctactaagttccagaagagacccaggttccactctgcactttgtcatttttttagggtctgaccttgaagtcacttccctccagaagacccctccaaccatctggtgcccccaaattactctgcactccagttatacctatgccaatccgactcatttggcacttactggcacacaatgcctttcaggtcacactcatagcacatctccccatttgaccaaaagttcctggaaggcaaagccagctccttacgcacctgtgcatcaagaacactgcatggcactgggcacaggagtcatcaggaaatgatgcttgggagagcgctaggagagcactctggttctcctcctgccttctcatctctaggccttaatttcctcatttgtgaaatgtgccattattctactcattcactgaacaaactcagaagagccatccaccaggcactcttctcccgctacagaaatacactcgagaggactaaggaggtccctgctcacccccttctattctaggaaaagagaaagacagtaaacaaataaacactaaaaataacaatttgccagacactaagttctatacatatgctttctcattcgcaaataagattctttcatagcatgatacacgtatgagaaaaataaaatagtaacgtgacagaaagtgaaaaaaggggctgctttgcataaaaagatcagggaaggcccctctgaggagctgacatttgagctgagacttgatcgataaggaaaaaccagccatgggaaaaacggggaaagatgtcctgggcagagggaacagcatgtatgaaagcctaaggatgagaacaagcttggcttgctggagggggaaaagcaggccagcatggtgtgaccaaatcacagcgggtacaggagtaaaacagtaaccagtgggttggagagagaggcagacaaacaacctcctacaacgctgcctctctcaaatcaggtcggcctgacccaaccaggacatccgggccccaagtcacaggcagcactgggggtaagggtatgactcagaccccacagcttcctggggccccgaaaaaactggtgggggtatccaggggcaggcatcaaccttcagcatgagtgccatgccatacccatggaacacccaaggctgggagacaaacgtggttacataagcgtgtagaacactgcacactcccagcggcagcttccagaggggcatgatcacgtgcttccatgaagtgccagtccctgatcacattattttcccgggacacagccaggacagcagccttggtcaggggaaagggaacagggtccaggattcaagcgttgctagtcttgggaaagccttaaccttctctgggcctcagtttcctcatctgaaaattaagagttgttagaaagattaagtgaggccgggcggggcggctcacacctgtgatcccagcactttaggaggctgagacgggcggatcacttgaggtcaggagtttgagaccagcctggccaacatggtgaaactgtctctactcaaaatacaaaaaaattagccggggatggtggcgagtgcctgtaatcccagctactcgggaggctgaggtaggagaatcgcttgaacctgggaggcaagttgccgtgagccgagatcgtgccactgcactccagcctgggtaacagagtgagactctgtctcaaaaaaaaaaaaaagattaaatgagatacggaatgtaagcactgtgcctggcacatagtaagctattagcattatcagttttttcactgcctcagtttcttctgttgcaaaacagagaccaccacggggatgctgagtttgtactaatattctaccctcctaatacaattctaccctcctttgtcaaggatttttttaaaacattctgagtccccttttctgacctctcatcagatgccgaattcccctctatcacaccccattgtttggaaaatgagtaagtgctgattaaatcccattttgaccgtactgtgagaaaaaaatgatgcattaggaatctacacatttccctgcactgtcattctgcaagggggtggggaaggacgttgctgattcttctgcatcatccacaaaagtccctccctccccctaccaaaacacaatctctcacccagtcgcacaaaattcccatctgctcctgtacgcacaatgaatgtacaatgcacacgtgcacacaaatgtcctacagtggaaagctcagccttcatactccatccccagaagcactcctggaaactcatccatcctgcacatgcacacaaatgcctccaacaatgtgcatacaaaatatgttcaacagaaatagtatagtaggaactctggagccaaatgcctgagttcatatctgactttgcaactcacagctgtgtgacctcaagctccaagtacctcggtttcctaaagtataaaatggagataataacaatattaatgtttaggatggaagtgacaattaaatgagtctaatacacgtacagcgttaagatcagcacttggaaagcgcccaataaaaattattattttcctcctcgtgacatatgtacactgcttccacaacttgatacgaaaactcctgacgccgcgtaggcaactcgtctccacaggatagacacccaaagggccgcagcgccgcccgcacccggagggtctgcgctctctacaaccgccccacgccgttcccaggcgtgctaccccgcgcagtgcgcacgcgcgccccccaccaggcccagcgccaagcagggagtagcggctcagcccggcttggccgctggcggagacgccccgggaccccgcgcgccgggcctgggtgcacaagccaccttccccagctcgctccccgccgccaccgaggctctggacgatctgggcctggcctcccttcctcccctccatccccgctccgggccggccggcttacccgaggacggggagcttggggacacagcgccccgcttgctgcgtccagccccgaatccagggacggggcagcggcccgggcaaggctccggccccccgtagcactcctagggctcctggacgggggcagggcacccgggccgaggacgaggaagtgccgggggcctggccgggccgccccacccctgggaaagtccccggagactggca

SEQ ID NO: 2826 - DNA, 35189 bp, Homo sapiens
  source 1..35189: mol_type = genomic DNA
tgttgatcttcttcaacttggatttatgtccatgattcgtgcaaatagctatccagggatggacagccaccctaatctgggcttctggcaccacaggcctccagctatggggtccagggtctgaacctcagggcctggcagcttcaggctggcgcccctcggcggacgtggctggcatggccttctcccatctgtgatggcttcagcaaggctactgtgagtggtggtggagagggccccagagccagaatatccatcattctcttctgttctggagacaaacccacacttcccacagctcctcacagaggggtaggggtgtgcgtggggcaggtcctgctacagagcttgaagcaaaaattaaacacacacacaaattggtcatggcaactagagggcctgaaaccacttccgggaggttttgaaggaagggggtcttggctgcctcccactcttaggattgctgctcctggaggcttctgcaacggatggtgggtcaaagccggatgaggcctctctccactcagcagcagggaaggagtttttcccagtcactcccagcagagtacaaatgaaagccttctgggtggagcctccccagtcctgtaaacagctcagttcagggactggtgtacaagctggccacccatctcagcctctcatccagctgaggctctggccacaccgtgcaagtggcttctagtttcttggcaatctgagatcagctggctctgcaagatgaaggtggagccaaatgacacaatctggtctcactgaggcccctcacggtcattttttggagactctaaataaacaaaaattttgaggacttcatgattatgtggtagagcgagtttcaaagtctcttatggaatgcagtgcaggaacagtgaaaataacagctagggttactgggtgctaccaagtgccagggctaagtaccttaagtacgctggtcatgtaatcttcacccagccctatgaagaaggcaggttattatcccattgtaaaagagggaactgggacactaagaggttttaaatgacttgctcatagttccaggtccaggaaatagtggggctaggatttgaacccaatctcaaatcctggagcagttctggggagggagcccctcccattataccaatctctaccactcatcaaagcagcctccaaggggctccactgaacttgtagggttcttcagggaaaaacagaaaatgactgagcagcccaatcccttcttccaatcaccaaatcctccaaactgcaacccctccaaggtgtccgtcccatggcctctactcacacacctgcaaagggacactcgccacctcccagagctggctccatttctgcacaactgtgtcccttagaaagaaagttcctcttcatgttgcgatggacttggcctccctgtcattcccacccactagttataattctgttcccagaagtcccacaggcgaggtggtgccttgtgccccatgagagctctacagggagcaatggcagtcgctaaggtcccaatcttttcacgagtggacacagctccaggctcttcagcctttcatggtggacaccatggtcaggggagcttttcaaacagaaatatggtcatgccactctgctttaaaaatgtccagtgactacacattatgctgaggataagacccaggcctcccaccatgctccgcaggcctgcacggtcaggacccggctacgtcctgaaccctgcgttgcccctctctttccctaccttgttcttggctccagccacgctggtcttccctccgatcctcaaatcagctcccctacttcccctcctcccaccacggcctctgcatttgtcatgttctctgcaaaagcatcctccacccctacctctccacctagctagtgtcactcattctgagagtctcaactcaaatgctgcccccccggtctaggtcggcttcctctgctatctgctcccacagaaaccggctcttcttcctttagggcacttgagtgcagcctgtttgtgtggtgtttgtttattcatttctgcctccctcattagacattacgctgtataagggcaaggactgtatctgcttctgttctctaggcatccatagcacctagcacaatgcctggcattagataatgcactagaatgaatggtttcagcccccctcactctgtggttgccattactctccattcaacactgttttggaaagctgggcctctcctccaccaagagcagaaactaacgacatcacccccaaactcaggcaatgctggcagataagatattatctcccccagggaggaccaagactcagtattaggggctcacctggttctgtaggcctggctgtgggagggtccatcacttgggagctctgatttggatttcgaacccctccacagggtagacgccaggtgtattccggctgcgacaaaactggtgcttaataatcaataatcacacccaaaaattacaatagcacctactgtgccaggacaatactaaatctgtattagtcaagtataattgaatctttataacaacccaggctggcactcccatttcacaggtaaggaatctgaggctcagaggggataacttgctgaaggtcatctagcaaggagaatggctaagcttggatttgaatccaggtctttgtaaatccagagccaatctcttaagcgccatactatatactctggtgtttaaagatgtgtaccaagaagggtcatatgggagaagctgaaaaagaggccagccaggaggtttctgtaatggtccaggggagagctgggatgcctaaggtggggctgtggcagaggactggggaaaatgggacaagtgacagcagatctttggaagaagaatgataagaagggaaaagaggccaggcgcagtggctcacgcctgtaatcctagcactttgggaggccaaggcgggtggatcacctgaggtcaggagttcaagaccagcctggccaatatggagaaaccccgtctctaccaaaaatacaaaaaattaccgggcgtggtggtgcatgcctgtaatcccagctacttgggaggctaaggcaggagaatagcttgaacctgggaggcagaggttgcaatgagccgagatcgtatcactgcactccagcatgggcaaaaaagagtgaaattccatctcaaaaaaaaaaaaaaaaaaggaaaagaaaataaaaaaagagaggagagaagaagaggaggggaggggagaggagcggaggggaggggaggggagaggaaaggaaaggaaagagagagaaacatggtgaggctctggaacctagttacacgtggaagttataagaaaaagcaaacccaaactctgatacccatggcctggggcctggagggagtcctccttcccaccctgcactcttactcagccttctccgtcctagaccagtgaccctgaacagctgtggggcagccctgcgggactgtggccagatccctgcccctgggtagcagcccagagccaggccctggacacccacctgccaccacggtgctgtttagttcagaaggatgcagtttctgaacccctcacttaaccttcctctctggaaggtgtctggggcagcctctgtgtgtgccctggagcaagggagggacacagactcaccagatggaagaggcgcgagttggggagtgggggcgggtgctccatggccatggggggaggggggtagcggatctgggaccagtcctcgaagccatggtgtggcaccatggctggcatgggcgggtaggcgtaggggtaggccccgcagagatgttctgggtggggctccacatggtaacgctctcctgaggcctgcaagaaaggctgacgtctggctttggcctgcaacaggctgcaaaggacacccatctcatcaccctctaaatagaatgttagctctctgaaggctagcaggctgggtaccaaaggctggtatgtggtcatgaaaggctgctacatgggtacagaaatctggatacatgggcatagaaggctggatatatgagcatggaaggctgcatgggcatggaaggctgggtacacatgcatggaaggttgtgacatgggcacagaaggctggtacatgggcacggaaggctggtacatgggcatggaaggctagtacatgggcacggaaggctggtacatgggcacggaaggctggtacatgggcacagaaggctagtacatgggcatggaaagctggtacatgggcatggaaggctggtacatggacacggaaggctggtacatgggcacggaaagctagtacatgggcacagaaggctgctacatgggcagtgaaggctggtacatgggcacagaaggctaggtacatgggcagtgaaggctggtacatagacacggaaggctggtacatgggcacggaaggctagaacatgggcacagaaggctggtacatgggcacggaaggctgggtacatgggcacggaaggctgggcacatgggcatggaaggctgggcacatgggcacagaaggctcatacatgggcacggaaggctgggtaaatggacacagaaggctgggcacatgggcacggaaggctgatacatggaaacggaaggctgagcacatgggcatggaaggctggtacatggacacggaaggctggtacatgggcatggaaggctgggcatgggcacaaaaggctgggcatgggcacaaaaggctggtacatgggcacggagggctggaacatgggcatagaaagttggatacatgggcacggaaggctcatacacggccaaagaaggctagtcacatgggcacggaaggttgctacctggacacagaatgtcaacagtgatgacagctaatacattgtgggcactgcctctgtaccaatactgctctaaggcttttcctgtattactcatcagttagttagcagaggatgtccccacgcccgagcacacactgtgcatccatcaggctagctccatgaggaaggtaagaggatgtcagtgctgctacctccctcaagcctcctcacctttgctttcctcttctgctgtctgagggcttctcttgccttctcctcatctttgaatgcttttagctgagagaagaagggagggagaaaagactgtcggcacaggtggtttctggccaggcctggatccagggcctaaccagccacgaggactgaccggctgatgcttccctctgggccaccatgcgtgggccagccccgggaaagggccctgagggcggagcacagcccaggctgttgctgcaggccacctgcttgtcacagtggtctgtgcacaggtcaagagggttcacgtgaacctcgctgcttctctgctaacatcttttagttccactctgggagagtaaagcccagaactgactgtggaaagtcagaggtagagatatcttagagtaaaactcgtaattgtacaaagaaagagtcagagaggggaagggccttgccgagctcaaatatgattgcagagctggagagaagcagtgagggtcctgacatccagcctcaccagggccctccaatccatgccccctctccccacgaggacaggccagttgcccttcctgggtccagtcactcttacctgggcatttgacagggtgacctgggcctgcagcttctccacttgcttcttcagctcttccttctcctcattcatgcgctcacgatcactgcgctccctctggaagtcctcctcgaagatcttcacctggtgtggagggagggtgaagagagggagggggatggtcctgagtggggatttctcctcaggcccagactcccatgcctcctgctggggtcacagatggcagagctgggggtcgccatggggagtgggacagctacacctccagcctccaccttaacttcaaacagagtagttctgtgtccctctatcttacattctgggcttcaagctaggactttatttgaacaaaggatatatggttttaaaaaaacgttgaaagccatcaaccagtgcaatcctttcactccgctgagacccacaggggcagtgatcacagaaccagagtgtggtgtagaccagagtttggatctgctggttctgagggcagagaccctacaaactccgctagggctccagggtgccctggcagaggtgggttgggtggggcctgcctctgtctcttagcctgtagtttcacatccttagtgcagatcagctgagacactggctaggttcaaggcagtttaggaggattaaatagcacagagacaatgggagagccacaaccttttcgctttctttcaccccaatccttctgtgtccctcagggctagtaggtctttaataccattttagtacctgccaatctcctttaaataaaggagaaaagaactccagttcagagtcttcatttggcaagagtatccggctagagtttaataacattgttctgtttttattgtttattgcgtacagttactttctacttgtgacaaataataaatggttttttccaattacagcagtgatataaagctcccttttaaattcatttatttagaatttattttttaaatactaggtaaataatagcacgtgtggggcatagagatggctaaatcataaaggtggtagaggaacgacttaagctagggttatggtgctggaaaggataaacctagagccagtggggggccctggccaatggccagaaagtggattactaattacaggttccatgtgattccaagccgtctgggccctcaggaaagctccagctcccacagagcacctcccacctgatttcctcccggaagcctcacctgctgtttcagcaactcattctgcgtgaccagctcctgtttccttaggagggcccctgctccttctgggctcccaaatgctgttggtggagatgatggcggggtttggatgctcagtgcttcctccagggcctggaatcaggaaaagatgggaccatcagcaggaacccctggaaatcagggccctttggaggggtcatcctcagggaactccttcctaataataatcatactaataatagccaccactaccagtcctatttaataaatgctgccctatttatttgcattctacacatatcatttcattggatcttctgcacagtgccatgaagaaaagactatgatcatcatcctcattttacagatgtgaaaactgaggctcagagacctgaaggggcttgtccaaggtcaaggtcacacagctagtaagtggcagagcacagattcaagcccagcacatgctcctacccagcaggctaaactggggttgtcatgcagaaggggaaacctccccttccctgaacatgtgtggctcaattcttagcacccagacctagaaggaagattaagtcctccgggggaagcttcagtctccccaacaactgccctgccctgagattcttcactttcagcaacccattcccatccaaaccaccccttccatcctcaacacttatgtacatagagaagactggatttaatttctgcttagttaatattttccctttctaacactgaaaatgggctgaaatatcatcaaataacattttgaaaataaaaaaatactcttaatctatcatgttcacaatagattatataaacagtgtgcccacatcttcttaaaggtttcagttaaccgtgtttcccctttaactctgttaacatgttactcagaactctggaacatgtctcaagactgggcaccctggactttggccccaggacagcatcgcccatgggcctccctggaccgaggggagatagagacctggcccaacttggactcgggcttccacctggtctcctcagctcccctagacacgcaaagaaactgcaggaccgagagtaaattcaggatgctccgaggggaagttatggctccactttatcttcctactccaccccacttttaaatgaaaagactgaggtccagcgacagggagatgcctaggtcatgagcaaagaaggccacatgccctgcattactcatccacatggtgtctgtccctggctctgccaagaaaacctccaaggtcatctttatgatcagcaacatggacaattctctgcctggatttagagccccaagtcccccagctcaggacagatcgcgtttctttctctggaaacaggtcaagggccccagacttggcataatcagtgtttacaaaacaccaaaaccaaaaagaaagggtttccccagcaggcctaggaatgctcaactcatgccagagtccactgtcaccagggtcaggaggcagagggaaaggaaaaacaattagcacgaaacgaaaagctgagccatgaacttaactcctccaggccctcagagaatgtttcctttcaaagctccctcctgtcagcttgcatctttgaaatgtgctggaaagcaggcagaactagagccgttcccaccagggctcggatggcaaaactgaactggagaggctggagaggctaagctgggactagaccactccgcttggctcagaccagagggtttctggtttcctcagcctctaccctgggggccccatctccctggatcccactgcacaagggcgggcccctcagcccgtgctcctccactcccatcagtgtttgctgaacatgtgcttgatgccaggcgctgtacaaggcgcccagggtatacaccttggtgaaagtatgcacctcccaccaccagatgggaagacagaattaaataagtgatgacgagccatgagaaggagtgtcagagaagttgctggtacctcaggagcatagaccagggcaacctgaatgagattctgggaaggctttgctgagcaagtgagggtaaaacaaaccctgacaagcagggtgggcaggtgaggcacaaggggaagagtgcacctccagagggaagggtgacacaggctaattcaagggctgagtcactcccagtgtgggaggcaatggcagagcaggcgggaaacaggatgccagctcactgactgggggttacccttcctaagctgaatggttgggggtgccagtgatggggtgggcattgcagctggactcaagggagcccagccaagggacccgggccaaggcacccaccttgttgagccgctggatctccttttcctggtactcacgctgtcgggtgagtgggctcagctgatcctgcaggtacttgaccttttggcgcagctccttggcctctgctgtcagctgctccttgtcggtctgcagggaatacaaggttggtaagctggctaggatggcctctccaggaggcctcggattctctgtcctgcctggcccagcccttacgttctcccctggccatcacttcacaatgctcacatgcaaagcacctggggtcggtacagtaatgtccatccggtcctgccctcaattattatgtgtcaatttaaaataataattaaaaaaagaaaaagcagtagctcagttgagtaaaagaccctggattccgacaccagttcatccactaagcagctgagacccctggcactgccacagccctctcttgtctaagcttacctacctgtcacaggtacggggttcctaacgtgagtcacacagagacctcaggaggcctgtgagccccaaaactgaatgcgaaattttgttgtgtgtaatctgctagaaagaaaagccatagttctgaccagattcacatgggggtcttccgtgatccacagaaagcgataaactacggataatccctaacagacactgcagctcatacagccttggagcctagaggagagatgacacgcccagagagaactgtgacataaggcagagagtgctcctccagaaagaaacaaaatactgtggggctaaaagaaagatcaccacagctgagggaaggcttccaggaggcggttccataccctctacggaaccagcagggcttcgccacagccagccaagactgggatggcctttagacagcatcaagccccagccctgtaatacgatgggaaacaaatgtccagagaggggaagtgacgtacccaaggccacacagtgagctggggctagaacccaggtttcctattcccttgctctctctccttccatgtcaaaggaggtgttgaaactaggggatggcagcacagtgcagtggaaagaccaggcacatccccaaataaactatatattcctatgtgtacatatatgcgagaaaggtctggaaacagatgcaccaaaatggtaacagtggttccctctagggagggcctgggatcatggcagtgggaggtagtccagggaaactttcactttgtagcatgtggacatttcataactgtgtattcacagcatgtgattaagagaccagtcgcaggggttagttttcacccagccctgtgtgacctttagtcagtacggactgcagagggcaggcttggtcagacctccctgggaattgttctggactccccatcaagaggctcccggatgggcatgggctttaccgaaattcatccttatctacagggccacgccttgtcatgaaacgtcctaccttccctgtagctgacagggaagagccctcacattccagggatttgtctcacctaccactgtgagcaagggagaggggccaaagagccaggatgtctggctgcgagtcaccaggtatgactgtgcactcataaggaaagacagaagtgttctccctaccacacctccaaggtaagggggtgtcacagacgtaggctgactgctcaaataaggcccctggtgtcccatgctgacgggaggaactgtgaaaggcaatccaggttgaaaatgtccatttttaagctaggcaaaagaccatgcccagttcccatgaaggggaaaacatggtgacataaataaaatctcccaagagtctggcagtcaagtggcctttcctctttaagctgctccaaggtcctgatgggccttggctggtctcattcatacatatgactgggcagatactactacttcaggggacctgttgtttccccccaagaaagaatctggtctcacttatgcccactctctgatctctgtaacttcttcttcgtagtactttttttttttttttttgagacagggtctcattctgttgcccaagctggagtgtagtgacacaatctcagctcactgcaacctccgcctcccgggttcaagcgattctcgtgcctcagtctaccgagtagctgggactacagacatgcgccaccactcccagttaatatttgtatttttattagagacggggtttcaccatgttggccaggctggtctcaagctcctgatctcaagtgatccgcccaccttggcctcccaaaatgctgtgtttacaggcatgagccaccatgcctggccatacatttttcttttagagaaacagggtttcactctgttgtccagtctggagtgcagtggcacaatcacagctcactgaagcttccaactcctgggctcaagcaatcctcccacattagcctgagtagctaggtctacaggtgcacactgccacacccagtgaattttttaatttttgtagagacaaggtgtggctatgtcactgaggttggtctcaaactcctggcctcaagcaatcctcccacctcggcatcccaaagtgccaggatcataggcacaagccacccaacccggccttctctgcaacacttaacacacttttactttatttgcttctgtaattagttgtctggcacctctttcccagcgagggcagggttgagctgttcctgtggactctatgccaaagcacaatgcctgagacaggctctgaagacaaatgccgggatgaatggataaatgaagctctgtctcatgttgtagcccctccccaacaaatcaccatcactatgctgaacacttggcagcatcccaccccaccaagtgccatacagcaggcctgcttggatcttttttttttttttttttagcaagagtttcactcttgttccccaggctggagtgcgatggtgcaatcttgactcactgcaacctccgcctcccaggttcaagcaattctcctgcctcagctacctgagtagctggaattacaggtgcctgctgccacacctggctaagttttgtatttttagtagagatgggatttcatcatgttggccacgctgatcttgaactcctgacctcaggtaatccacccgtctcggcctccccagttgctaggattgtgagccatcgtgcccggccacctgcttagatcttttatatggtgtgcttccctgtacagttccccattccctacaattttaatggaacaaaaagttctgaataaaaacaagaaaatgtgaaaagctgtagttaatgtaactttctcaattttcagatgggaaactgcagtgcagggaaggaacgtgcctgtgtttttggtcacctagctctttcgcactagacccccgggtctcctgactcctgcccctggcttgtttgctccacagaactctccgctaatgtggaggggaactgactctgcagggaccagcagtcacacttgcctcctccatttcaatcttggacttggccaggaggagcttgcggtcaaagtcacgctgcttctgctcccgctcggcctccaggtcagtcacctgcttctgcaaatcagccagcttctgacgcagctcagtgatctgggttcagaggcagagaggagtgtgtgaggcaaggatgtagagcacttgcaggatgtgggcagggcctggctgcccctgggccctccaacactgcccccaacttctcctctgggccatactggggctcagcgtggccactccccaaggttcaaagctgctaaagaggcagcgagatgaagaccaggcatgccctgtgggcgtggccaggaaccccacattaccttctgctcatactgctgcttcatggaccggaaatgctggtcccactgcttgttcacttccagcagctgtggggagagactggagttagcaggagatgagcagagaaggaacaaggagagccatctcctgccccatgtacaccagcgtcccaaggtgtgctcggtgtgtgtgaatagtggctacagacactgtctccatccctcagctctcgaaaactcaatgttgctcaaagccatccaccttcatccactgctgcattttaccttgccaggaaagcaagattaacactaagacatggaaactacatagttttggtgaataattatggaacacacacacctctttggagggcagtctgggattatgtattgaaatttcacattttcatcaactttaacccaataattccactctgaagaatttaaccaatagaaacacttacacaagtgtgcaaatatatatacacaaggctaatcatctcagcaatacctgtattacaaaaaaatccagaggccaatctaagcacagaagataggttaaagaaacgatagtataaacagacaatgtgcagctgttaagaaaataagaaaataggccgccaggcacagtggctcatgcctataattccagcactctgggaggccaaggtgggccaattgcttgagttcaggagtttgagaccagcctggagaatatggcaaaaccccatctctacaaaaaatacaaaatttagccgggcatggtggcacgcatctatagtctcaactactcaggaggctgagatgggaggatcacctgaacttaggaggtggaggctgcagtaagccgagatcatggcactgcactctagcctgggcaaccaaagtgagaccctatcttaaaaaaaaaaaagaaaagaaaaaaagaaaacagaaaataaagcacctaacacacttcctcagtttgaagatgacactatccaccatactcttgatataacaattcctcagggaagaaaaacaaccctacatcatcaactaaataaaacaaaaggagtattggccctgccccttaagatatgtcataaggatccacaccaatttcaaaaacattgcatatgataaaaaaaattacaaagaattaaaggaatatagcatatgttatagatatgaatagatactctcaaaggcagttaattttttttttggaggcaggcctaggctggagtgcagtggtatgatcatggctcactgcagcctcctgagctcaagtgatcctcccacctcagctcccccaagtagccgagactacaggtgtgtactaccacacccagctaatttattttttgtagagacagggtcttgctatgttgcccaggctggtctcaaactcctggttgcaagtaatcttcctgcatcagcctcccaaagtgctgggattacaggtgtgagccaccacgcctgacccagttaattttttaaaaaagaaaagaaaaaataatctgtaaagcagtgtgtgtatatacatatatatacacacacgtatatgtataattttattctactttgaaaaaaactgagggatattcaacaaactgtaatcagttgtggttttctctaggaggtggtattcttgatctttttgtaatgagcattatatcacttttgaaatcagaaaaaaagacgcttataacaatacaaaaagaaatctaaaactaatatgcacatcaagaagctttcaaatgtgcgggaggacaaggggaggcaggctcagggttctagagaagcacctgggctgtgtggagaggggctagacggaacagacagaacaagtgtctaccaaaaaggagctgcacttcgacctcgggtctggaaagactggactagactgggggtgtgaggagggggaggaacacatgtgagatccatgggaagaggcggaatggactgcagcacagggactctgctgcgtggcttctctcttggcagcagagggaaactaagagcctcttacgaactggctcctgcaccttagtgggactgggggacatttaaactacctaaagacctggccatcgccttaatggagtttaggaatccactcagtattctgtggcaggcttcggctgctggctggtccttttcattcttgcctaagaaaattcttgaaatgggagtctcaaaatatctgcaaagtagctacaccaatagaggtaggtagctatttttttttttgagatggggtcttgctctgttgcccaggctggcacgcggtggcacggtctcggatcactgcaacctcagcctcccgggttcaagtaattctccctgcctcagtctgagtgggtgggattacaggcatgtgccaccatgcccgctaattttttgtatttttagtaggcacagggtttcgccatgttggccaggttggtcccgaacctctgacctcaggtgatccacccgcctcagcctcccaaagtgctgggattacaggcatgagccaccgcacccagccaaggtagcttttaacgttaaaaattttgacagtaaatttatggagcctccaggctagtgggaagcggccttaatcccttccttccatgatgggtcctccctaaagcatctctcaagggtccctccactcctcatcggtgatgctaaaacttgcctaacttatcacaacctctttccaccatccaaggtctaccataggagcctgcctaaactgtagccccaacaattttaggccatgccccacatgccacctcctcagagtgaccactgtaggcaaagggactgatcaagagaggacagtccagggcaaggagtcagacctcatccatgggcaggcaggtcagtggtcaccatgccaactcctcatggtgacctgggacctgccagagccaggaggccagggcaagcctttgtgctgctggtcccgggaggtaagagggatcctcccactactgccacctcggccacctacctcactgcgctgctgctccagcatcttcaccttcttctcggctgcgcccaaggccaccacctctgggaccttacctgccgtcacactagcctggggagaagcacagaggagccttcaccaaaacctcaatacaaattatctcacccagtctcggtgctcctctaagacccctcacccaagtggccccagccctctgtctccctattcctcccacccagcaggacaccactaaccatcccagtcatgactacgtccccttctagaagtctacaagatgatgattccccctccctgactcagggtggctgccaggccctctccccttcccttctcccctccctacggtcattctccctgtttaggtacaacctctaaggtactaccagccactctcctcactccctacacacatcagccaaaaaactctctggcctggaaggtaagacatttgagatgtagatacagacagatatagatatagatatactcattctataaaacatatatgttttataaaacttttacaaaagttgaagttatataaaatgtttatttaaaaacatttttagaaagatgcagaaataaagatctgtgtaatacacatagatgtttcccagctctgtcctctgtaaggggctaaagcagagacatccagcagcactgagcaaacctagtgctcagttggtttctaaataccattttctttttattaaaaagaaacagggctgctttgaggggctggagcagataaaatataaggtgagtttgatgcatcttatagtgatggaaagtaaggaagtgctcaaatgaataatactaataacaataataataaaagagcatgtcaaaagggcacaagagacaacctgaaaaaaacatctatggccaaaacgggaacactttgaacagcaaaatacatcacaatagtattggattataagtcacagtatgaaataaatactcttgagttcatactgatagaacaaaatagctgaatcaataaataaatgggggagaagggacagctcttccttacaaaagaattctgattaataagtgtaggaagaatgaggaaaatatgaaatcaccattccattactacagtaataactgctgcaggtggagatccaccaatggtcactaaaatcagtgagtgaaagtttaagaaaaaatagagtatttgcatagtctctaagtttctcctcaaaaataaacacttattaattacaaagggaaaattggtcacttgattgcagaaacttgaaagacagcacttggccaagtgatgaaggttaacagtagtaaaacactgacatcatgtacccctggtctgctggactgagaaatattctgcacactctgatgtacacagaacgtcacctccgtgagattcttgccaaaacacgtaacctcaatctcctcatgagatccaatcacttgtgaggcctcaatcgtgacagcaaataagtctatactgaaaaacattctacaaataactggccagtacaactcaaaagtttcaaggtcatgaaaagcaaggaacagctaggaactgtcacagactagaggaaaatgagggagaagagacaactgaatgcaatgtgggatcccagactccatgctggcacacgacaggacatgagtgcaaatctggtgaaatctgaataaagtctgtagtttactaagtagtacatgccattaattcctagttttgatcatttaacctgggttctataagatgttgccgttaggggaagtaaaggaaggggataggggaactctctagactatttttgcaactcttctgtaagtctagttataccaaaataaaaaggtttaaaggttaaaaaaaaaaatagcaagtgctggggtgaaacagcagacaaggccagtagtccggagggtgtgtgtcgactctatctccaagcccctctgtgatggacaccaagaccctcgtcttctctgggcttcaatgcgatgagaagctcaaacagaagaaggtctgcaggccccatccggacttctgacattgtctgccatcatcctggagtcagattctctctattctcagcgttctctttccagcgttctctttccctccacactgcacccccaagtggcttcaggtagggctgggtgcagagcttgccccctacaggctcaggcctgtaagcacaccatagcaccaaggagcaaggtgagggggagccctccaaggaaggtcaccccctttgagaaaggggacagacaggcctgcccacttgaaatctgcggcatcttggatgggagctgtgcttagcaaaaaggtcaacaagttaccggggaaggaggaagagggtggattccaggctctagggtggtgcaccctgaacctccgcgagggagagaggagtccacgtggagtcagcagagctggctgctggccccaaatctcccctaaagagcaacagctaacgttcactgtttacgacgctaaacctactttacaagcattgcatcactgaatcctcacaaccaccccttgaggcaggtgttactatcttcattttacagaggaaactgaggcctaggagtcttatgtgacttacccaaggttgcagtgctggtaaaaggtggagctagtattccacctgcatgcaattccaaggcacactcgtcgcccctctgtaacacatgcctctaatgagacaggtgaccctggggcacaagggcaagtcgctcccactctcaggaagggcaggaagagcatctggctcggggcattcaaggaagacgagtggagattaaagggcacaggaaaagtaaagagacctgtccagggaattccacacctgaggcagctcagagaacccaagggagaacagccgagtctacaagtcccttccacaagagggcagacaaggccggatctgatttggggaataaagggaagaaaagaggatctccatgggctgggattcggaacaccagggaagagcagactttcaccatttatcagcatgtttccctggccgtaccctacatctgcctgatagcaggtcacacagaaatcctgattatatgatgttacttgacctctccaaacctatggccatagctatagaatggaatactagtcccagccttgcctactctataggtagagatgaggcccaaataagaaaatagatttgcatgtcctgggtaaactctacattgtcacacagtaataaggaattaagccattacggtaattgctactattgcataggtgtagggtgggttaaagacattgagccctactgttcagctattaaaccccattaaagggtgaagtaaaaacacgttggtaaagagttgggactcagctctgcagcaaggggaatggtaacgactgggcaaggggtgcagagtctgctcctgcttgggacctggatgtggccagtgctgggactagaggataggggagtgggccagccctgcagcatcaccagaccacacagacactagccaacaccctcccctctccactttagaggctccagagacacaatcccaggagcttagcagaatccaagggagcttgctcaaccaacctaattctgccaggaatatcaaagatgttaaactgacttttgggaaccactctctaagacagaccttgacaaactggaatgtgtttacggaatgcacccagactgagcaaacgactcaacaccaccttctatgagcaatggctgaaggaactggagctatttagccaggagaagagaaggcttatgaggcccatgaagccacagtgactaccagcagcctctaagcatggaggtcaggccaagtaaagaaaaaaacacgtaacagctagaaccttctaccactggcactggctgcaggagggaggaggctcactgtcactggaggtggtaagcagaggctgagtacctgcaaccaaggatgctacagaaggaatttctgaccacatacctgctgctgtccagccactgccttcttgcctgtcccttccatcttcggtgagcctggccgcccagacgcaccctctttgttgccattgctcatcaacaacttcttgagctccaaattttcctccctgggatggaggtaaacagagaaatcacaatgctgaccctgagttaagaaacctacagggctccttaatgctcactatcgcatgagttgcagctgagccccagggagtactgcaggatcctgaaacctgccctcctggaaaaccaaaaagggcatcttcagctaccttgctctcaatctgtggaggtctctgattgtcaatggcagggtttccccagctgtggaatttctatgcacacaagaccttccggatatatccaaacactgcattaaataaccctggatcacattctagtgagaaagtgacaccctttccaattatcttcacatttcttgtgtagaccacggagacggtgcgagcttggtgctaacaggccctgggcacctctctagttactcgccagtttccctcgttaacacagaaggtgcaggctgcaggcccagagccttcaatgtgcaatgatccttagcctgaatttattaacatcctttcactttcattgtatttagagttatcttctatttatcacaggtaatgctgttttccatttactctagttaaagttgcctttataattttaagtaaaaagatgaatcaaattaaagtaaaattctaagtaactaataaggcaggtgatagaggagatcataaaattagtgatgtggattcaggtctgactaaaatgtttcttctttcttttttttgagatagggtctcgttctgtcacccaggctggagtacagtggcccaatctcggctcaccacagcctcgactgctcctactcaagtaatcctcccacctcagccacccccaacctcccccaccacacacccccaccctcttgagtagctgggactacaggcacaccaccacacccagctaatttttttggtattttttgttggggctgggggaggggtggtgatgtatttcaccaggctggtctcaaactcatggactcaaagcaatcctcccgccttaacgtcccaaagtgctgggattacaggtgtgagccacaacgcccaaccaccacttctttatgttctatttgccagctgagtttccgcttgaaaaaccaataagtaaaatgactttcccaaggtcatacagcagagacttgcattcttgccttctaatccgtgacttttttccccagcttcagtttctgaatccatggatggggtcactagggctataaaaaccccaaaagtgcatccttggccatccaaaagcaaataaattacacactgattcaaaatagccagtggctcagtagttaaacattacttctgtggccatacttacaaagtttatattccttctctttctgttgattctaataagaaacaggagaggagggaaaaacagagtggcaagtcctgtctgtgacacgggcctttcctatgtgcctgagcccagctggtacccaccagatgactcatcacccaaactgtccaggaccacagtgcaggcaggaattgtggccactcacaggatggagagcaaggaggcccaagttcctgttgtaagactccaatcaagtccctgcctctccctgggcctcagtttcccctctgcacagtgagaggtctgtctgcatgatctccaagggcttgtcaagctctgacagtcaagatcagtgtttcccaaggcgtgatcctgtgcctacctcgttcataatcacagagactcctggtgaaatgcaggctcctaggtcttgcctaagacctgtcaattcagaatcttgcaaaggaaggaagggaaggcgtataaacttgtaatgcctttccctgaccctcaaccctcagttaagtctaagccccctagtccagtgggggagctctcatgttctcaggaagacagagcaggttgggatggtgaccagcaggaggcagcaaagtcctgagtcctctggacagccagttcaccgttaacaggggagagaggcaagtgctggaggaggaaggaagtacaatctatgctgaccttcttctgaagctctcaaggcactctatacacctcccaaggtggcaaaagggccagagagaaaataccaaaagagccaaggagaaggatcaagagacgtaacctccaaatagggctctgggcacagggcctcagagccacggtcctcaacccagaaatcagtgctgcacaccagcccctcctcctgcagcccccactcctcaccccttctctgaggggcctgaacttaccgcagcctctcggcagcctgatcccgctgttccaggcccttatccaacttggccttcagagcctcgttctccttccgaagctgctcacacagggtctgtggggcaggggaacagacagggtgagggaaaggaggggcccctcccaggtgcaggctgagctagaggatggtggggggcctgtagccaccccagggcccaactccttatcccctttgcctggcctcaccccatccctctctaaggagctaagccacttggccacccacgtgtcctctcccttgggagccaactacggagaagcctgaccaagtatcagccatggggccttctgctcctccaagacagacagctccatcccttctccttcatccctgctcccactgccgggacccctattccccaccagcctcccccagctgacttctacccttctttgaagtcttagtttaaatcccatctcctcagagaagtcctccctgactccccgatccagctacattaggctaactccgttatccttgctcacagccccccgcttttacgcttctcagcacctgtggcagataaagctaaagaactgttcgtgctgctgttttcttaatatctacccccttacccctaattaattcctgagctcccggagggctgggacccctaaccatcctcttgttcactgccagatccccagcccccagctcaaagtttgtggaaggaacaacatgactgaacagccaaatgagcaaatggacaaatgagcaggcgagtcctaggggggctgaaaggcacaccaatttgcaggtgtgagaggtgcccagtgttgccaaggggaaaaccagaagacaaggcattcagtcgggacctcactatgccctcacgccctcacaatgtggctgtgacacttggttcctcctctacaaaagaaagacaactgtttctcttttttttttttttttttttttttttaagacagagtctcactctgttgcccaggctggactgcagtagcatgatctcagctcactgcaacctccacctcccaggttcaagagattctcctgcctcagcctcctgagtagctggaactacaggtgtgtgccaccatgcctggctaatttttgtattttcagtacagacggggtttcaccatgttggccaggctggtatcaaactcctgacctcaagtgatccacctgcctcagtctcccaaagtgctgggattacaggcatgagccaccacacctagcccagggacaactgtttcttctctgcctcctctatagggctgctgagagggacagatgagacagtgagagtggaagtgtccatgaaccatcagtcacttgcttatgtgcggggactcatattggaagctctgtgaactgggggcatggaagaggggtcgccagactcaggacctcacaggctggggggaagggaaggtgctgactagcaatgctagcatacagtgtcagcacagagttgttcaatctttccacagatcctcactgagcacctcacctgtgccaggtacattgctcggtgtttctccatatactgcctcactggtgcctcacaacttcctcaaagctaagtaactcatctctatgttaaaggtagggaaaccaggtaaaatgatacagtctaacaggtgcacagctgctaagactcatcactggcggggagtaaaactccaattggcagaccccacactggtgtctctttcccctgtgatgaaagatcagagaagggagagagatggtgcccaaaggaggggacagcctttgagctgggccaggaccagggccattcactaaacagccatctgctgccttccacctcccaggcctgttgcaggtggatgcaaccatgtgactagttctggccaacaaaagaggtgtagaagggacaagcatcactcctggactggcctacgcacaattctccagtctctttttcctggtagcaggggctgatgtggatgcctcgtattctaaagggcaccggaaagttgggcccctgtctccctgggactctaaggaactgtgtagagcagaaacaaacccctgccacacagaataggagggaaaacttttgttgtgtaacccagggagatttcagagttgtttcatttctgactcacaaaggagactcttgggaaggctgaatggaggacacagccttcaactggaggtggctggacaatgagggagatgaggcttagcaaacagagaaccagctgggcatggtggctcacaccagtaatcccagcactttgggaggctgaggcaggaggatcacttgagcccaggagttcaacaccagtctgggcaacatggcaaaaccctgtctctactaaaaataccaaaaaattggccaggcataagggcgcatgcatgtagtctcagctattcagggaactgaggtgggagaactgagcccaggaggtcaaggctgtagtgagctgtggtcgcaccactgcactccagcctgggtggcggagcaagaccctgtcccccaacaccccttaaaaaaaagaaatcaaaaaattattgttatgagtccattcaatgcctagcagagagccttatgctatacctgaccttgaatatgtttgtttagtgaaccaagaaacacatcagtgaatgaatgaggaggaactggatcaatacacctccacccaggcagtaaaaatacccaagatgccatgtctctgggcgaggcctccagggaacagaatggcctgctcctagtccctaagggaaggccaggacaaggcctcacttgctgtcctacccttgcagtctagagagctgtttccttggagtctctgggccaatgccctgggtgcaaaccggccaatggatagaatcatcagaggtcacaaagatcatcaccttccatccaaggtgctacgagagctatgagttcatttgatcatttattattttgtcctttcattcattcaccaagtgtgtatgaagtgccacgaactgggacgcaacagtgaatacaacagacatggtgcctgcccccctcaagcttaccttctagcagagagtataagaaaaaaaagagtataagaaaaaatgtattaaataaaattattacaaactatgataagagctaagaaggaaataaacaaggaggggactgaaataaaaaataacagaggttggcaggaccccttttaaggggcctaggatctatccccatctcaaagctgaaaagtggatgcgcaaagtgctctcaccccaggcaccttcctaccctgcccacagcctaggcactgtgccaggctcaccttgccagggttcagcctggataccttgaagcctcactgacatcttaaaggggttcccttctctcagcctggctctccaggcctctgcctctcgttcagcctcacctcccaacacacccctcccctccaggtgggatgggcatcctccgtgctcctctacccccacacctctcctcatactgcatctccaacctgattgcccttcatgccctcggcaaccaaggtcacgcaagggggactcccccttctgccatcagcggggcacttgagtgcctgctgacatgaatgagaccacagatcagagaatggcctgggaggagagtctgcagggagtaaggaggcttcaagtcatggctctgtcactaaggtggcgggcactcagatcacgagcagtccctcagaagcctccgttttgccatctttagaatggtcaccaattataactgaacacttccccgctgctaaagcccacaaggctaagaccccctgcccagtgtggatgcccgtcatgaactccgaatggggacctctcttccagcatggactaggttctggactgcactgggtgcttcatgtacatggcctcatttaatgcagcaatctaaccatggaggcacttctagctcatgttactgataggaacattgggggatagagaggataagtgacttgtccaaggtcatacagcaataaagggtcactactggaaccaaggaccatataactccaaggtctggcctggcctagcaaggaaatctgtccattccccacagcacagggaggctttcaaaaggaattcaataggggaggcaggttgggatggtggtcaagagtatgggctttggaatgcgagagatcgaggttccaatccctacttcaccatttaccagctgggtgaccttgggcaaaaaaagggctgcttccccacctgtgaagtggtgataatgagggtgcctaccctggggggaaagaggcattatgaaaggagttgacctttgttccctcccttcccatcccccaaccctgcacatgagaaataaaggcagggctgctgggggtatccccaaccatgacactcgcattgcccatcccgtatttccccatttccttcctcttcctcatccctccccacaacttccttatcctgttcatcaccctgaacaaaaagcccgaagtctgcccacaacacagccttcagaagtccccatggtaccagtggattcccaggagcaggaaggtgggaagagctcggggggaagcacgcctgcctgtctcgggctgccctccccacgcgcctcacctgcagaatggaggtgcgctgctcattcttgtgcaccttggatgccagtcggttgaactccagggccatgcggcccaggtgggtgaagagctggccgtggtccggctcctcggcacacacactcagcgtggtctccaggcgctgcaggtgcagcatcaggttgccgtcctcacggggcagggggcccagcgcctggagagggaaagggcacacggcccactcttcaccaaggcctgagtaggcgccgccagtccattctccctctgcttcctcatttctcatgactcagtttccccctgtgaccccagctcagccccgggaaattctccagttatgcaggttccctgtctggggctgactcacagggcagaacccaggactcacaggccactggtggctccacagcagcggggccaccatcctcccacacactgggccttgcagagtgcctgacagtaagtcacttgtctgctggacctcagcatcctcatctaccaaatgtccgcacaacccttccctcccttcaacctcacagggttcttaggaggatgaattgacccctgacagtaacaagcccagaaaagggacatcactgcacagtcagccctccatatccatgggttccgcatccatggattcaaccaactgcagatcaaaaatcttctaaaaaaacaaactggccgggcgcgatggctcacgcctgtaatcccaccactttgggaggctgagcgggcagatcacaaggtcaggagatcaagacggcctgagtggtgaaaccctgtctctactaaaaatacaaaaattagctgggcatggtggcacgtgcctgtaatcccagctacttgggaggctgaggcaggagaactatttgaaccagggagtcggaggttgcagtgagcagagatcgcaccacagcactccagcctgggcaacagagcaagattccgtcccaaaacaaacaaacaaaaaactgtattgaacatgtacagaatttttttcttgtcattattccctaaacaatacagtataccaaaatttagcatttacattgtattaggtatcgtaagtaatctagagatgatttaaagtatataggaggatgtgtataggttatagggaactactacgccattttacatcagggacttgagcatccatggattttgggtatcctcagggagttctggaaccactctcccatgtttaccaagggacatctgcatatacgtcctgcaacctccgcctcctgggttcaagcgattctcctgcctcaggctcctgaggagctgggattacaggtgtgcaccactacaccaagctaatttttgtatttttagttgagacggggtttcaccacaatggccaggctggtcttgaactcctgacctcaggtgatccacccacctcggcctcccaaagtactgagattacaggcgtaagccaccatgcctggcctacacatgtgtcttctggggaatggcccaagcattcatcagcttctgaggacccaagactcaaaacagtttaaggaaccacagctttagctatttcagaaagtcccaaactagtacagtatgtaagaaataaagcacaccgtgggccagatagttgactctttctctctagtctatctggaatactcctaccaaagacattgcctttgttacaccaattccactcccaaggacctgcagtgttaccctactgcagacggcactgggcccagctcccctgctgggcatctaaggccctacagccgcaggtcccatccacagcagcatccagttgggctccccactttaccctgcctgaacccacacacaccaggtctggtgtctctgcatgtgtcctctctgtgtcctctctgcctctgcaagttctgctcatccttcccaccctgtccacggctcagctcctccagcagcctcccggaaacagttatgggaatcacaggacagcagagctacagggagcctcagagatcaggccgggaaaccaagctatggggaggaggaacttgcccaaagttgccctgtaagtcagtggcagaggtataacgagaactgaggtttcctgactcgccatccagtgctctgctgcactgacctcccacttctctgaactctggaggaatggcaatgactataaccccaacttggcattccctgaacacctgtgtaatggcgtcagtgtgccgcattctaacaagaggaaatgctgctgtttcaactctgcatccattcccccactgcctctttccacaaaggagctgaggtggcagatgctgctctatttaaggctcatgcgatgcttcccatgcctgcgacttctccagactacaagcttcagagcacagggaggctgtgttgtcttggctcaagtggctcagcagagacaggcacactgtagagctaatgaggaacttactacgtcagttaaagttatcggtccaaagtcagagtgaaacactttctgagcaggggatcttgcctccatggccagcatctcagagccctcagggacagaacaggacaaggggacagaaggttccaggcgacagaacataaagagcctttccaatactcagagctgcctgaggcagtggtgagcctctcaacactgaaggcatgctagttagccagacagccacctgagggggccctgcactgggcactgacaggtacatggggcaaccagtgaacacaagcatatttgtcagccaaacctttgtgaagggaggcagcagggatcaatatatcagtgaagggctagagcacctattgctcgcataacaacaattaaagaaaaaaacttaaaagtgggaaggaagggagaatggagaaggtagaaatttaagtcgtttaaagaatcttccagacttttcacaatggttcttcaataagtctgccattttaagaaagaacagaaggagatatagttaggaaaaaggcagccagtgttgtaaggtgtggaatgaggatgctgggcagacgctccagagctgtacgagagacagagagagagagagagagagagagagagagagagagagagagagagagagtgtgtgtgtgtgtgtgtgtgtgtgtgtgtgtgtgtgtgcgcgcgcgcgcgcgcatgcgtgtaagtggaaagttgaacctccttcctgtgtgctccaagagtctgcacaaagagcaaatcacctgtcttacagggccctgggccttcctgacccttctttctcccccggggttggaagcccacagacccaaagggctgagtcatagtgtgcggaggtgcctggcccctggcagaaggcaacagggctggcaaagagcccaggctttcacaacggtcgggtgcccgtgtgctccaagtcggggaagtcactagcccaggaatttgcatatgtgagcgagaagcaccctttgctcctgcccctcgtgtatccccaagtgactccagggtacctaagggatctgaacaggttctgtgcctctcacatggtagcaagtgacaggacacaaagagggcagcaggtcaagcccggggtcctgcccgtccactcaccatcgcattggcatggctgctgctctctggtgaattctgctcctcaggagtgaccacttcaaattcagaggaggtgccctgtgcagaaaggaagttaggtgctgcccgagagaaaaacagctcacccctcctctgcggccctgtggctgagagcagcaagggggacaaaatctcttcccattttgagtacacagggaccgttacatatcatctcacatgagatcacaaagcaggattctcgacaagcctgtcatagccctctgcataatgtgaggtcatatcccctcgatggccaatcctcttttgtagaagggagatgtgggactagctgaccttgaaccagcagcactgtaggattgcattttttaaggccgtgtactttttaaatgctttcatgagctccattatttctcagggtgacccatggagtgggtcagaaggttatatcctctttggaaagatgaggaaactacagtatacagttggttaatgcaaaagcagggattgaacccaagactgcagatccagcattcctgccacggccccagagctgtctcttaggcccagacgtctctgatcggtttcccagaacacagatggcagctgttacggccaccaccaagcatgtcctgtgctggccttcccaagccagtcctggagatcccagaggagtgaactgatctgagaaaagtcccagagatgattcaccaaatttggagactatttcaggattcaaccaaatccacggtggccaagaaatcccagattttttcacatctttccgtcattcctagtagaattactggtcattcaaccaaccaagaagccaatggcccacctgaaccagccattagctctgggatctgggatttccatgtcccgttaaacctggtctgcagcctcccttcatcccagaaaggggcaggatagatgagaggagtcagtgctcagcttccagctgaccctcatggccaccaagaactcacctctggctcttggccctgccctagaaagtctccctcctccatctacattttccccattacccgtgtaacctcagaacaggtccttctttccctgcacctgatctgtaggataaggatgctgaactatgcaatcccttgtaggataccaagcaaaacttctccagccaaatctgtagatttttttttttttttatgagagggtctgactctgtcacccaggctggagtgtggtggcatcaacatggctcactgcagccttgacctcctgggctcaagcgacccttctgcctcagccagcctcccaagtagctggaaccacagacatacaccatcacacctgactactttttttcttagagagatggagtctcactatcctgcccaggctggtctcaaactcctgggttcaagcaatcctcctgcctcagcctccccaagtgctgggattataggcatgagccactgcgcccagcctgtagaagatagtttctgagccctctttgagaatgtgagctccatgtcacatctgtctgttttcctagcactgtgcacactcagtgatacttaacagtatacaacttagtaagtgagaagaattccttgtacataccagggtcttcctggtaagttttaactatgaccttcatttcaaaatggggaggctgaggccccagagagtttgcgatggacttgcccaatatcacccagcgagacggaacacagtttcttgacctcaaccctctttcttcatgttcttgtatctgtcagtaggacttgaggtccatccaggcaacctccacccatgactccaaataaaacttacactggatggaggcttctggactggtgctggcttgtcactggggcatgcaggggctgtgggagatgctgtgacatttgagtcctttcctggagaatcaagaaagcacagatgaactgactgggaaggggagaagcccaggtaccaccctctcaaggacagcccttgacaaaagggttctcagacaggattccccactcgagtgtgggagaatgggaggtggtctcatcagggccaggtagtctgagaaaatggcctgccctggagtgacggggcagagcctgagcagagagaccatgctccctgggcttactgggaaaatcccaagttggctgctgctccttgctgccctgaacaggcctcaatgataaagacaatgatttacaatttgaaaagtctttatgtatctattatcccagccattctcataaaagccccatatccccattttaaaggtcaggacactgaggcttgggaaggtcatcaacttgcccacagccacatagccagcaactgcaaactcaggactgagacttggccctccctccctgacttcctgcagtccttgctgcagggagctccttgaaggtagcttcatttctcactctgagagtggacctggcaccaatcaggaactcaggaacattgctgaatagacaagcagaggctggaaatgcccactgactgcagcacagtggactctgagaccatcactttcctccatttgtccattcagcaaatgcaaccaccagccaatagaaggctgtcacattggcctgggccagataccatacagtagagctgcagcaggaggcatctgagtccagctgaggtgcggatcatttccatcctggtcccagaccttaccctggacttggagacatgccagagtaatgcacactctgtacgcatggtgatgcctctaccatacatgggacttcaaccccgagccacagtcaccctgtcctttaatgggcagcacacgtaaccttacatctgaaatacgctgcagcaggctaacaggcaagcccagcttcttccctgggcctcagcttccctaattgtaaaatggacgcgcagggcacgaccagggagcttccaactcatatgccagctccaagtgacagggagtagctgcttggagtgcgatgcctggcacacagtagctgctcattaaatattaaatatgctgataaagaccccaaggccacaggactgcaatgtagtcaactgttgtatctattactcatgtctgctggggcctcaggagtgctgagtcactggctatttttaacaagattgttttgaagtcccttccaaatctgaccttctgggggatgtggcagccaaaacatgaatggaagggtagcctgtgacctaaggataaacgagagaatgtgggttttggcataagaagggagttcactgtgaaggatttgggcagtttggggtacagggagagtcagaggtacccagactcctcttatacctgtgagctcagccagggggtcgaaggagcccaaggagggagaaggtggtgggagcagctcgttgtccttcactagctcctctgccttctgccggagcctggtcgcttccatctgggactcttccaaaagctcccctagagttattggggaagaggaagcaaaagcatttactcggctcagtgtgctgcttctccccgtcccaggcccctaaccgtgctgccgcctggcttctgaggctccaggccctggacttcactcccaccgttgctctgtgggccaagtgggacaaactccatgctggtccaccataagaaacaggctagagcaaggacgagggcccagcaatcgggggacacaggagcggaaggaatctatgagaaactcctcggctcccccaacccccagcattctctttctgccccactcccttcacacccagccagggcactccacagaaagccaggggctcccccaccctacgggctacccacagcctgagccaccagggcaaagggctgcctgcagggcggagaccttggataattccaaccagccctctaggcctccattttccttctcctacaagtggagatggggaaaccactcctccctccccagtcggccatcccaagcaaggatctgccaagcaaggagaaagcattttaaaaatcagggggctatgctcccctctaaaacatgagactagagaagggcacggcaaggcaaaggaagagtttcaggagtgtggaagaaagagagccccctctggatggggaaatcaatgaaagccttgtctggaggagaagggggcacagcaactgggtgctgatgcacagggcccgtcggtcgtgtggagggaggtggggttgttctaaagtggggatggcttgagcaagagccaggagaagagaactgagggacctaccacctccttgcttcaagccaagctctgctccctgctccaacacctaggaacgcgtgccccagttgcctggtcatgctggctctccccatctctcgtgccccagaaagaggagaccactctagttccatggccattaactgggccttccagccccctttcccttagcccacgcctccctcttggacctgagtcctgtcatcctggtttccgggtgctgaggaatcagggttgggaatactgtcaccatgctacatggtgcatagagacagctgtgaggcaggagccagcgctgggccaggagggacaggggatgacttgggcagaggcatatgccagcttcattctccactgctagtagagggactggcatcacagtctgcagggaggggcgctcgcagggaggggacagggtctgctttacctaacatctttatcccttgcattttttccttcagccgggaattctccttcactaggcgctcaaaagctgcggatgcctctcctgagggcacgctgcccccagggtcgtagatccggtacggtcctctcccttccatgagggtagctcagcccctgccgtggtgcccgcctgg

SEQ ID NO: 2827 - DNA, 35189 bp, Homo sapiens; identical to SEQ ID NO: 2826
  source 1..35189: mol_type = genomic DNA

SEQ ID NO: 2828 - DNA, 51142 bp, Homo sapiens; identical to SEQ ID NO: 2819
  source 1..51142: mol_type = genomic DNA

SEQ ID NO: 2829 - DNA, 2460 bp, Homo sapiens
  source 1..2460: mol_type = genomic DNA
ttccagcttttatttcagatttggggatacagaaggatgcaaaatgaggcaacctagccacccaactggcccagtggtcaaggggggaaatgaggtggccgctagtcagcgctggagccatttctcgacggtgctttctgtttgtttgtttgtttttgttttgagatggagtctctctctgtcgcccaggctggagtgcagtggcgtgatctcggctcactgcaacctcaacggtgcttttttctgatcatagctgagctcaaatgctgaccccagtggcctgtctctaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaatctttagatttcatagatatcaaatgggccaacaaaaatgtatcttggaataaacaaaatatgctaatgataacagtaagatatgtaggacatactacgtacaggtgctgttcttagcatttcatatctatcattttacccacacagtgaatctgtgagatggaagctattatcattccattttacagacacctacactgagactcaggcaggccagttgtcctgcccatgtacacacagctcctaagtggtagagtcaggatttgaacccagaccccgcagcctggctccatgctctcaacagctttgcagaaactaaagttggaatggaagactgctcattccaaatctgtcctattgtccagcatcctatggcccattccagaaagttcagtgggtgtcaattagcttggctgtagtgaccactcttaagtgtaccgttaccttttattttaatttgagaaattaaataaaatacatccacagcagtttacaactctgccatgatgtcattttgtcagatggcaaatttcaggagagggtcaaactcaaaaaaccctatgtcgttacctggatttatcgagaggacatcaaatcacttaattctatcacggcccacacccatgaattcactaagtaattatcacacacctgtcaggatccagacagttgctgaggaccaagatccagacgagactgacagagcttctattccccggcaccctccgtgaacttgggcacccaaaactaagggatctgaaacctgagaggaaatggaagcagactgtgaggccctgcagcgccgtctcttggatggtttattcttctctggcaggttttcccctaggtattcatggcatccaggggcatttcacctcagcaaagtgatgacgctgccactcaggttcccatggaaaccaaactgggacaggaggaacaaaaggctcctcaaggtcagtggtgcaaaggacattagagacaaagacagagacagcaaatcagcccaaagaacagacataaaccggcgcttcctccctcccatcaccacagctcggggctttgtcaccccagcacacctgggccctgcacctcagacgctgcgtgtgagcttctggggagagaagtgtgggcctccagggaggtgtaggcgctcctggctcctggcagactcctggcccaggcctggcctgtgtctgcttccggagccatgcgctgcctgtgctgggatgaatgcatggcccctgcatccttaccccctcctcagagcccacaagcttccgagtgcgtcatcttcattattggccacaggaaacgacttcttggagtaagtgactggtgctccgaggcccatctggacaaaagcaggatccggggtggacgcagaagagcaggcccggagccctgcaccccagccttccctccccatgcgctccacatgcgtcctttgttcagcctctccatttagctctcactttctggatgcagccaggcaccaccttccttccaaaagccttgtttctcagaaaacctttctgcctcctagaaacccaggattccgaggaggaggagggctggccttcctcttgggactattgatcagggctgtcagttcccagctctgtccaatgctctgaactggggacagtccgcatgcagctctgaggacccagatgctgtcactgggtcctggtgagtctgaaaacttgggatgtcggcaccacggtgagagcagagtctgcccggggctgtggcaggcaaaagaccgtctcggttttcactgcagggacttacccagccaggtgtgtgtgtctgagccctgccattcggaggcatcaccgagaggttctggtctcccctgcccaggccctgcctcctggccccactgcaggaagcttgagcagatctgaagctcgcctcagaggaagatcccatccaggggaggccctgt

SEQ ID NO: 2830 - DNA, 8668 bp, Homo sapiens
  source 1..8668: mol_type = genomic DNA
ctgagtgcacatcatttatttggaaggtgaacctagaatgcacaagggaggaagtgcagagagagacccacagggaagggagaaaagccagtgcaggttgtggcatccaatgtgggcgattgaggtcatgcccactggggatcctcggaagtgtcatgtagactatggctcagctgcagcccacccagggaagctgggggatttacacaccaatgcttttcccccattggttaagggttgccctggggctttcaactcccagaatttcaggatgaggcagctctgcacacaggccaggcaagctcttactgcactgaaaaacacaaaacaaaaccaagctatcaatgccggggcttgtggtaggaacgtgtcagcaggaatgactgtccactgcagctgggggacacccagcgggggcccggggcttgctggttggcatcagcagcatctgctatagatgatcaaacccgcacttctcaaaccgtccttggaagtgcatactgggagtgccctcgggcgtgccatagctgtgagacaacgcttggagcatacttttccttgcagagttttgtggagatgcatcgtttttagtttttagcaagtggatattatagattggaatgcaaacttcacaagaatttttttccagcttttatttcagatttggggatacagaaggatgcaaaatgaggcaacctagccacccaactggcccagtggtcaaggggggaaatgaggtggccgctagtcagcgctggagccatttctcgacggtgctttctgtttgtttgtttgtttttgttttgagatggagtctctctctgtcgcccaggctggagtgcagtggcgtgatctcggctcactgcaacctcaacggtgcttttttctgatcatagctgagctcaaatgctgaccccagtggcctgtctctaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaatctttagatttcatagatatcaaatgggccaacaaaaatgtatcttggaataaacaaaatatgctaatgataacagtaagatatgtaggacatactacgtacaggtgctgttcttagcatttcatatctatcattttacccacacagtgaatctgtgagatggaagctattatcattccattttacagacacctacactgagactcaggcaggccagttgtcctgcccatgtacacacagctcctaagtggtagagtcaggatttgaacccagaccccgcagcctggctccatgctctcaacagctttgcagaaactaaagttggaatggaagactgctcattccaaatctgtcctattgtccagcatcctatggcccattccagaaagttcagtgggtgtcaattagcttggctgtagtgaccactcttaagtgtaccgttaccttttattttaatttgagaaattaaataaaatacatccacagcagtttacaactctgccatgatgtcattttgtcagatggcaaatttcaggagagggtcaaactcaaaaaaccctatgtcgttacctggatttatcgagaggacatcaaatcacttaattctatcacggcccacacccatgaattcactaagtaattatcacacacctgtcaggatccagacagttgctgaggaccaagatccagacgagactgacagagcttctattccccggcaccctccgtgaacttgggcacccaaaactaagggatctgaaacctgagaggaaatggaagcagactgtgaggccctgcagcgccgtctcttggatggtttattcttctctggcaggttttcccctaggtattcatggcatccaggggcatttcacctcagcaaagtgatgacgctgccactcaggttcccatggaaaccaaactgggacaggaggaacaaaaggctcctcaaggtcagtggtgcaaaggacattagagacaaagacagagacagcaaatcagcccaaagaacagacataaaccggcgcttcctccctcccatcaccacagctcggggctttgtcaccccagcacacctgggccctgcacctcagacgctgcgtgtgagcttctggggagagaagtgtgggcctccagggaggtgtaggcgctcctggctcctggcagactcctggcccaggcctggcctgtgtctgcttccggagccatgcgctgcctgtgctgggatgaatgcatggcccctgcatccttaccccctcctcagagcccacaagcttccgagtgcgtcatcttcattattggccacaggaaacgacttcttggagtaagtgactggtgctccgaggcccatctggacaaaagcaggatccggggtggacgcagaagagcaggcccggagccctgcaccccagccttccctccccatgcgctccacatgcgtcctttgttcagcctctccatttagctctcactttctggatgcagccaggcaccaccttccttccaaaagccttgtttctcagaaaacctttctgcctcctagaaacccaggattccgaggaggaggagggctggccttcctcttgggactattgatcagggctgtcagttcccagctctgtccaatgctctgaactggggacagtccgcatgcagctctgaggacccagatgctgtcactgggtcctggtgagtctgaaaacttgggatgtcggcaccacggtgagagcagagtctgcccggggctgtggcaggcaaaagaccgtctcggttttcactgcagggacttacccagccaggtgtgtgtgtctgagccctgccattcggaggcatcaccgagaggttctggtctcccctgcccaggccctgcctcctggccccactgcaggaagcttgagcagatctgaagctcgcctcagaggaagatcccatccaggggaggccctgtctgcagaaagcagagaacttggcttctcctcatttgttgttagggccagtccctaagggactaaaaacaaacaaaacaggctatgaacagaagcagtggtggcagcgctgggccagcaatgatgatttctactgttagggtttcagttgtacttggatctgggagggggaagccgatgcacccagagaccctagggctgggctgtaaccacacacctgaggagatgctttgggaaactcaaactgaagccatttgtgctgaatttggggaaagggggtgggatgatggagttaggagcgttgtcgttaactggtcattaattagatattaactaggcattaactagactttcggggaagcaacaaggcctctgtgtccacggttgtaaggtgtgggctaccctgatgaggggtgctccagctgtattcatgattcacattcattcattacatgcctgatctctatctcagaggcccggccttctgttagtaagctctcagattcagggaaaggagtctcagagaactccacatccgtgtggagtcagacggatcagagcagaacacagagctgccttctctgtcctgctctctctcccactcacctgctcagaggttgccagccgggccctgtctccctctctgccctcctgggtatcacggtccctcaacccagggaagctggtgccctcacttgtctcccatagtcctgtgtcatctgggcttctgtggcccctctcagctttcaggaccatccagtcttccccgtccctgttctttctctcgcaagtccccggtggcccagggtctagggagaagctgcattctgagctactgcccacatcgcttccccagggcggcgggagctctggaatggcaggccccgtccttgacagcctatccatgacctccaggggcagctcacagcagcgccacctgcatcacccacagaatggagggagacagcggctctccacacaaaggcactgagaaaaaagaataccctgaaagccacacaggtctcagggcagcagggagtgggagcactcatcacaggccagaagcccagcaagtagcatcagacacctcaggttaaagagaacgtagagattgtcgcttcccaccctccccattctagtcaattcggaccagtttggtacatgctggccatgtgcggtgaccacgctaagtactgtgcgtgtaccatttctcggaatacttcctgcaaccttatgaagttctcgcccaatttaacaagcactaaccaaactcagaaggcatttacccaatgctgcacgttacgaaaatgtaaaagaacgaacacggcttcaataccaggattgagcccaaaggtcacgttctttccctgcggctcccttccccatctggttctggggaagacactctgcacgcagcccccaggagaccacaggccctggactcccaaatcccagcagcaatgcaaagccacccccagaagagctgcccaggacaagtgatcctgcggcccattgctcactccccgcagaggcaggggcagctgactgctgtcccagatggacatagaaggtcaccatgtggcctgctggggtctgcaggatagaaggcgtgaggtgaagagtttgagctggtgcctacacctccgtcttccagccactgaaaacaggattctccagagttcacacctatgcatctggttcaatgctgggcattttgtcaggccacaagccagcagccatgcagcggatgcacctgtagatgatgcactgccttactgtccagacagaacaaaagggatcccctttccaacccgaaactgtcggattctctaagaggtccgtcacaacccatcttaatgcaagagggactgtggctcttctggaaacacgatgcctcggtgccatgaaatgacagctgcttcttttgaagaactgggctattcccatgtaaagctggctgcaatggatgatgtttctgactcatactctggctttaaaatcaaagtgtttgttagaaagcagctttgttttccttctatttcctgtttgaaaagtgaagcgttaacacgaaggagggtcccagcggagttcatgccgggactcaggttgcacacggccagtggtcccgggatatccagggagccactcagaggggacacttccagctgccatgcaaactcatcatgcacccagcccccccttgctccagctctgaccatagtgccctcaacacagggccctgggcagctaccctcaaacacctggatgccaagcatgagagggaaccaacttgccctccctggtctattatcacaaagaaccttggagcccctgcacaggaacccactccttagagggcacaaggggccaagttttgtttgagacaatgagctggcattggaagggagagatgacagctatcctctgtcctgcttccagggcagggcagagcaagctgcttttggccccgtctctgaggcagacatgagcacacttgtctcaggcagaagcagccttagatggtgttatggtttgaacgtgtttcccccgcaaaatccaggtgttgccaatgtgctagcattaagaggtggggccttaagaggggattaggccatgaatggaatcaggtgtcctgatgtaggtgctgtgtggagggagtacattcactcgttgcccttccaccttcagccatgtgaggacggcagcctttgtcccttctggaggacgcagcagcaaggcaccatcatgaaagcagagactggagccatcaccaggcacagaacctgctggcacctggctccagagctgtgggaagatacatttctgtcctttgtgaatcgcccactctccggggttgtgtgagagcagcacaaaatggactgggacagctggaatgtcagtttgcaacagtccccacccacacactcaaggcatgccacggcggccacgctgggtgcctttccgcaggtgcccaggcatcaggagcactggcccagtctcgaggggcgttcatgtcagggaggtgcccccgctagtgtcagcttcagcgccgccagcatcaggaagttcatctcgacaagcccgggcaagagaggaggcggtgagatcacctcctacccatccagagatcccccgactttggagtagtctgaaggacttgagactcctgaagtgagaggggacagagctaggagaagggagggcagccagaagggcaggggtgcagggggcgggatgaggagagccaggctggcattagcaagagcttcttcatgtccttttggcccaagggggccgtgttctctgaggaaatgggacttgctccagggaagaggaagagctcagcatccactttccctctgccgaacagctcctggggaaagcccaccactgtcttcttgccccgctctgtgccctcacacaagcgattctctccacctgcgacgtgtttcctctccctcccctggccagtgtccatgggttctctgagacggaacaggaagtattttaaggaagacctccctaacctcctcccagctgggtggatccctccctctgggcccccacacatctcagtttcaaaagaccattcacattgtagtctaaattagtggatccctggtgtgtgatgtgtgcagttataatgggttgcctcagcccccaacgcacctttcattgccttcttctgtgataatgcccctgggccctgtacccatttctcccttgccagctggcatgatgtttagccctgtgcagaggcaggggcctctccccggttccgacatttctttctctgcttgccccggctgctggggggacatgagggacacttggccctgttctctcttcagcaataattagtcccagcccaggttcctggcctgctgctccctgaggagggtttgccagtgccagcccgtgcttccttgtaccaggacttggtctgctgggacccagtggaaagcccacggctgccgcccccacccaccttcccctgcttgccagccacagtcaccagctgtagacttgtgtggctgtgctgcggaagcagatctgggtggaggagggccccacgcacagacgtgaatatgaagggaccctctagaggttgtggcaaacacaggtgccccgccccatgccctgtctgcagtcacagcccttcctacatggagggtgctatcatcaatcttctggggggctgtggacactctgcatccccatacctgtggcagtcctggcacacggtaagctctcagtaagtgtggtgagtcactgctgaaggaactaacaaataaacctcccaccaccaaccacaggtagctggggcagaactagggaactgctgaaaggaggctggtgaaccctgccatgacatgcccgctgtgcccaggacccaggctcccacagctcgcgtccttcctctatcccagatccattcaaagtgaagtggcctccatacaggcttccctaggggccctgctcagtgtccatgaggccaccatgccgccgttcaccaggggacgtgagaaaggggctggcctgtggaccaggactgacccaggtctgagccccagctcagcggtcggctagctgtgcgagcttgcgcagtagctccccaagtgtggctcaggacgcacagcatcggcgtcagcatcgcccaggaacctgttagagatacacatttttggccccaacctgcatcgaccaagtcagaaattctgcagtgtgtgttttcgtaagtcctccaggtgactctgatgtactctcagggttcagaaccattgagagagagcagtttagctgacctcctccaggcctcacctgcgcatggtcacgactgtactttccgcacacagtcgccgagatgcgtgtgaaaccccaagcacaaagcagagtgaatcgcagtggccagagcatacctgaagcaccagcgctggtcccctccctccccctctcctcacctgcctcctaggagtcggagggtccgtggaaatggtctcctcctgcacatctgtgctgctgtgactgggtgcaggtctgagcagaggctttcggagtgagctgagcaggcgagcccgagcacggcctctcagggagcgagcccataggctggggagccgtccctggagatgcccctgggctccttgcggggcatggctgagttcctgcctgtccttggcaggcccgcagtggtggggtggctcaggcagttacccttttcacaaccagtgctgctgggggtgaaggcaacgggtgggtgagcacggacagtgtgagccacgtggccgggagctgggccagctcgctgtatgtgcacatcgtttccatgtgtgcagcagaaattggcgtctctgcacaaagctgattttagtctttctcaccttttcttgctcagcttaaaataggcctctcttcagggacaaggtggccttataccaagccaaagtgctgagggcgcagggagacccgcgagacagggccccctgaagtcctggcggtttctagccagcctcttgaaattgacttgaaggtgtttaccttgcagattattttttccaacttcccac

SEQ ID NO: 2831 - DNA, 8025 bp, Homo sapiens
  source 1..8025: mol_type = genomic DNA
ttccagcttttatttcagatttggggatacagaaggatgcaaaatgaggcaacctagccacccaactggcccagtggtcaaggggggaaatgaggtggccgctagtcagcgctggagccatttctcgacggtgctttctgtttgtttgtttgtttttgttttgagatggagtctctctctgtcgcccaggctggagtgcagtggcgtgatctcggctcactgcaacctcaacggtgcttttttctgatcatagctgagctcaaatgctgaccccagtggcctgtctctaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaatctttagatttcatagatatcaaatgggccaacaaaaatgtatcttggaataaacaaaatatgctaatgataacagtaagatatgtaggacatactacgtacaggtgctgttcttagcatttcatatctatcattttacccacacagtgaatctgtgagatggaagctattatcattccattttacagacacctacactgagactcaggcaggccagttgtcctgcccatgtacacacagctcctaagtggtagagtcaggatttgaacccagaccccgcagcctggctccatgctctcaacagctttgcagaaactaaagttggaatggaagactgctcattccaaatctgtcctattgtccagcatcctatggcccattccagaaagttcagtgggtgtcaattagcttggctgtagtgaccactcttaagtgtaccgttaccttttattttaatttgagaaattaaataaaatacatccacagcagtttacaactctgccatgatgtcattttgtcagatggcaaatttcaggagagggtcaaactcaaaaaaccctatgtcgttacctggatttatcgagaggacatcaaatcacttaattctatcacggcccacacccatgaattcactaagtaattatcacacacctgtcaggatccagacagttgctgaggaccaagatccagacgagactgacagagcttctattccccggcaccctccgtgaacttgggcacccaaaactaagggatctgaaacctgagaggaaatggaagcagactgtgaggccctgcagcgccgtctcttggatggtttattcttctctggcaggttttcccctaggtattcatggcatccaggggcatttcacctcagcaaagtgatgacgctgccactcaggttcccatggaaaccaaactgggacaggaggaacaaaaggctcctcaaggtcagtggtgcaaaggacattagagacaaagacagagacagcaaatcagcccaaagaacagacataaaccggcgcttcctccctcccatcaccacagctcggggctttgtcaccccagcacacctgggccctgcacctcagacgctgcgtgtgagcttctggggagagaagtgtgggcctccagggaggtgtaggcgctcctggctcctggcagactcctggcccaggcctggcctgtgtctgcttccggagccatgcgctgcctgtgctgggatgaatgcatggcccctgcatccttaccccctcctcagagcccacaagcttccgagtgcgtcatcttcattattggccacaggaaacgacttcttggagtaagtgactggtgctccgaggcccatctggacaaaagcaggatccggggtggacgcagaagagcaggcccggagccctgcaccccagccttccctccccatgcgctccacatgcgtcctttgttcagcctctccatttagctctcactttctggatgcagccaggcaccaccttccttccaaaagccttgtttctcagaaaacctttctgcctcctagaaacccaggattccgaggaggaggagggctggccttcctcttgggactattgatcagggctgtcagttcccagctctgtccaatgctctgaactggggacagtccgcatgcagctctgaggacccagatgctgtcactgggtcctggtgagtctgaaaacttgggatgtcggcaccacggtgagagcagagtctgcccggggctgtggcaggcaaaagaccgtctcggttttcactgcagggacttacccagccaggtgtgtgtgtctgagccctgccattcggaggcatcaccgagaggttctggtctcccctgcccaggccctgcctcctggccccactgcaggaagcttgagcagatctgaagctcgcctcagaggaagatcccatccaggggaggccctgtctgcagaaagcagagaacttggcttctcctcatttgttgttagggccagtccctaagggactaaaaacaaacaaaacaggctatgaacagaagcagtggtggcagcgctgggccagcaatgatgatttctactgttagggtttcagttgtacttggatctgggagggggaagccgatgcacccagagaccctagggctgggctgtaaccacacacctgaggagatgctttgggaaactcaaactgaagccatttgtgctgaatttggggaaagggggtgggatgatggagttaggagcgttgtcgttaactggtcattaattagatattaactaggcattaactagactttcggggaagcaacaaggcctctgtgtccacggttgtaaggtgtgggctaccctgatgaggggtgctccagctgtattcatgattcacattcattcattacatgcctgatctctatctcagaggcccggccttctgttagtaagctctcagattcagggaaaggagtctcagagaactccacatccgtgtggagtcagacggatcagagcagaacacagagctgccttctctgtcctgctctctctcccactcacctgctcagaggttgccagccgggccctgtctccctctctgccctcctgggtatcacggtccctcaacccagggaagctggtgccctcacttgtctcccatagtcctgtgtcatctgggcttctgtggcccctctcagctttcaggaccatccagtcttccccgtccctgttctttctctcgcaagtccccggtggcccagggtctagggagaagctgcattctgagctactgcccacatcgcttccccagggcggcgggagctctggaatggcaggccccgtccttgacagcctatccatgacctccaggggcagctcacagcagcgccacctgcatcacccacagaatggagggagacagcggctctccacacaaaggcactgagaaaaaagaataccctgaaagccacacaggtctcagggcagcagggagtgggagcactcatcacaggccagaagcccagcaagtagcatcagacacctcaggttaaagagaacgtagagattgtcgcttcccaccctccccattctagtcaattcggaccagtttggtacatgctggccatgtgcggtgaccacgctaagtactgtgcgtgtaccatttctcggaatacttcctgcaaccttatgaagttctcgcccaatttaacaagcactaaccaaactcagaaggcatttacccaatgctgcacgttacgaaaatgtaaaagaacgaacacggcttcaataccaggattgagcccaaaggtcacgttctttccctgcggctcccttccccatctggttctggggaagacactctgcacgcagcccccaggagaccacaggccctggactcccaaatcccagcagcaatgcaaagccacccccagaagagctgcccaggacaagtgatcctgcggcccattgctcactccccgcagaggcaggggcagctgactgctgtcccagatggacatagaaggtcaccatgtggcctgctggggtctgcaggatagaaggcgtgaggtgaagagtttgagctggtgcctacacctccgtcttccagccactgaaaacaggattctccagagttcacacctatgcatctggttcaatgctgggcattttgtcaggccacaagccagcagccatgcagcggatgcacctgtagatgatgcactgccttactgtccagacagaacaaaagggatcccctttccaacccgaaactgtcggattctctaagaggtccgtcacaacccatcttaatgcaagagggactgtggctcttctggaaacacgatgcctcggtgccatgaaatgacagctgcttcttttgaagaactgggctattcccatgtaaagctggctgcaatggatgatgtttctgactcatactctggctttaaaatcaaagtgtttgttagaaagcagctttgttttccttctatttcctgtttgaaaagtgaagcgttaacacgaaggagggtcccagcggagttcatgccgggactcaggttgcacacggccagtggtcccgggatatccagggagccactcagaggggacacttccagctgccatgcaaactcatcatgcacccagcccccccttgctccagctctgaccatagtgccctcaacacagggccctgggcagctaccctcaaacacctggatgccaagcatgagagggaaccaacttgccctccctggtctattatcacaaagaaccttggagcccctgcacaggaacccactccttagagggcacaaggggccaagttttgtttgagacaatgagctggcattggaagggagagatgacagctatcctctgtcctgcttccagggcagggcagagcaagctgcttttggccccgtctctgaggcagacatgagcacacttgtctcaggcagaagcagccttagatggtgttatggtttgaacgtgtttcccccgcaaaatccaggtgttgccaatgtgctagcattaagaggtggggccttaagaggggattaggccatgaatggaatcaggtgtcctgatgtaggtgctgtgtggagggagtacattcactcgttgcccttccaccttcagccatgtgaggacggcagcctttgtcccttctggaggacgcagcagcaaggcaccatcatgaaagcagagactggagccatcaccaggcacagaacctgctggcacctggctccagagctgtgggaagatacatttctgtcctttgtgaatcgcccactctccggggttgtgtgagagcagcacaaaatggactgggacagctggaatgtcagtttgcaacagtccccacccacacactcaaggcatgccacggcggccacgctgggtgcctttccgcaggtgcccaggcatcaggagcactggcccagtctcgaggggcgttcatgtcagggaggtgcccccgctagtgtcagcttcagcgccgccagcatcaggaagttcatctcgacaagcccgggcaagagaggaggcggtgagatcacctcctacccatccagagatcccccgactttggagtagtctgaaggacttgagactcctgaagtgagaggggacagagctaggagaagggagggcagccagaagggcaggggtgcagggggcgggatgaggagagccaggctggcattagcaagagcttcttcatgtccttttggcccaagggggccgtgttctctgaggaaatgggacttgctccagggaagaggaagagctcagcatccactttccctctgccgaacagctcctggggaaagcccaccactgtcttcttgccccgctctgtgccctcacacaagcgattctctccacctgcgacgtgtttcctctccctcccctggccagtgtccatgggttctctgagacggaacaggaagtattttaaggaagacctccctaacctcctcccagctgggtggatccctccctctgggcccccacacatctcagtttcaaaagaccattcacattgtagtctaaattagtggatccctggtgtgtgatgtgtgcagttataatgggttgcctcagcccccaacgcacctttcattgccttcttctgtgataatgcccctgggccctgtacccatttctcccttgccagctggcatgatgtttagccctgtgcagaggcaggggcctctccccggttccgacatttctttctctgcttgccccggctgctggggggacatgagggacacttggccctgttctctcttcagcaataattagtcccagcccaggttcctggcctgctgctccctgaggagggtttgccagtgccagcccgtgcttccttgtaccaggacttggtctgctgggacccagtggaaagcccacggctgccgcccccacccaccttcccctgcttgccagccacagtcaccagctgtagacttgtgtggctgtgctgcggaagcagatctgggtggaggagggccccacgcacagacgtgaatatgaagggaccctctagaggttgtggcaaacacaggtgccccgccccatgccctgtctgcagtcacagcccttcctacatggagggtgctatcatcaatcttctggggggctgtggacactctgcatccccatacctgtggcagtcctggcacacggtaagctctcagtaagtgtggtgagtcactgctgaaggaactaacaaataaacctcccaccaccaaccacaggtagctggggcagaactagggaactgctgaaaggaggctggtgaaccctgccatgacatgcccgctgtgcccaggacccaggctcccacagctcgcgtccttcctctatcccagatccattcaaagtgaagtggcctccatacaggcttccctaggggccctgctcagtgtccatgaggccaccatgccgccgttcaccaggggacgtgagaaaggggctggcctgtggaccaggactgacccaggtctgagccccagctcagcggtcggctagctgtgcgagcttgcgcagtagctccccaagtgtggctcaggacgcacagcatcggcgtcagcatcgcccaggaacctgttagagatacacatttttggccccaacctgcatcgaccaagtcagaaattctgcagtgtgtgttttcgtaagtcctccaggtgactctgatgtactctcagggttcagaaccattgagagagagcagtttagctgacctcctccaggcctcacctgcgcatggtcacgactgtactttccgcacacagtcgccgagatgcgtgtgaaaccccaagcacaaagcagagtgaatcgcagtggccagagcatacctgaagcaccagcgctggtcccctccctccccctctcctcacctgcctcctaggagtcggagggtccgtggaaatggtctcctcctgcacatctgtgctgctgtgactgggtgcaggtctgagcagaggctttcggagtgagctgagcaggcgagcccgagcacggcctctcagggagcgagcccataggctggggagccgtccctggagatgcccctgggctccttgcggggcatggctgagttcctgcctgtccttggcaggcccgcagtggtggggtggctcaggcagttacccttttcacaaccagtgctgctgggggtgaaggcaacgggtgggtgagcacggacagtgtgagccacgtggccgggagctgggccagctcgctgtatgtgcacatcgtttccatgtgtgcagcagaaattggcgtctctgcacaaagctgattttagtctttctcaccttttcttgctcagcttaaaataggcctctcttcagggacaaggtggccttataccaagccaaagtgctgagggcgcagggagacccgcgagacagggccccctgaagtcctggcggtttctagccagcctcttgaaattgacttgaaggtgtttaccttgcagattattttttccaacttcccac

SEQ ID NO: 2832 - DNA, 8025 bp, Homo sapiens; identical to SEQ ID NO: 2831
  source 1..8025: mol_type = genomic DNA

SEQ ID NO: 2833 - DNA, 6696 bp, Homo sapiens
  source 1..6696: mol_type = genomic DNA
ggttttcggtgtagcagacatttaattcttatttgccaactcctgagctaggacctgggaacacaaagttaaataggacacgattctagtcctctaggcaccaacggtcttggaaaggaaggcagacaagtaaactggccatttcaatactacgtggtcgttacaatgctagaggtaggcacagggggcgcagtgcaagggaggaagggcgttaacatctgccacctacttccaggtgccaagcactgttatcaacattattccactttattccctggtgattatgaaaggcaggtattgatattcacacttaacagacgaggaaacagcctcagggagataagcttacttgacccagtctctctcctagtccatatcagaaccaagattcaaacaggttttgtttagaaaatctaggatttttcagccataccaaaataaagtagcctcagggaatcaaaacattcacgaaagaaggtgacttctgaactgagtcttgcaagaattctggaaattaacctggcagttgtatcaggggtggtaaggggacggaacagcttgagcaagagtgagagttccttggggtttggggagggaggaggaaaaatgattttttacttaagaacaaatagcaaggaaggtttgtgagctatgattgggggctggaggggaaagcctgaattctatccagtaatccttgaagggttttcatccaagtggcctgatgggatttgcattttactctggaagatgacttggggattggcaggaagtaaggacactttttttcaagagaatatagccctaaactaaggtagtagcagtggggatataagtggataagttctagatatacttgggaaatataattggaaggacttgtggactgataaagatatatttaagatgtgcagtcagtaggacttgttgattgaggacttgttgattgaaggtggggtgaaaagatgacacaggtttctggcttggttggaaaaagcatagcatcatttaccaagaagaaacgagatggaattgtttggggttgggaaggtggacgatgaaatgttgagtatcacgcatcttacatttgaggtatcaatcattattggatagaaagtcttatttagtgagatggtaatggttgtagatgtcagtgatttgttccaggggacaatgagtaaactgagaagagcaaaaatctacaaatggagcaatgaaggtcagcattccatgaagaagcagaaattgatgagagaggaagacaagagtagtcagagaagttaagacctggaagctaagtaaggagagggagtgggcaactatgatggaaaggccataaagcaaagattgagaagtatgcactggaggccattgtttctggatgtcagggtaggaaagagtaaacggtgacagtagaggtctccttgcagtgaattggggaatgaatatcaagtgaaatagtgcacagagtctgtatacaaccctttggaaaagcctgattgaaaagagaaagatgagatgcggagggagaggcattcaaaaaatgctagttacagcatcttattgaggaatctaaggcaggagtagggagacctgagtatgatggagcatggtagggttgggagtcaagtcaagctcacagcatttcagggttagggagataagctgtctgcagcagtcaatagttgagggttcagcagggcttccaacagggcagaataagggactgaactgccagcttcagggcaggggacaagccatctctcctgataggaaagggtcaggggttgagtagagtcttcagcaaagctgggaagttgggtgttccccagcctgttacaggatcccagccaggaccagagcagaaaccctggccctctacctcttcatccagacaggactcatggcagccacgggttacctagggaggaggctggcatcagatctgggcctactagtaccagtacttaaagagtatatctcctcaccctgtactcacatttcaaaggctattccacaccaccctaactgcccccaagtcccccttagcactccccatagttgtttgaaaacgtccacacccttcccttccatacttacatcaaagagtcctgccccatgctgctggtagagccttgggttgagaaagccaagaggggggcggccactaaggatcctgtgctcattgatcaaggataggatccccccaaacactggagtagaggcctacaagagtgaaggtgcaagtagaggtcaggggttctgagtgattggactttttgggagtgatgctttaaagtatcagacatctctaaggagtcaggggttctaggtgcaaggtgttcaaggtgttagggggtaagggtagttcctgagtgagagtttggagatgggctgattctcaccgaggttccggacacccatggaatgggcactctgttgctgaccacccagtagccatcagaaagtgcagccacatctgggtaggcacggccactggcattgaagtaactggatggtggcaggtgggggctagagctcaggaacttcgttacagcttcctcctgaaaggcatttttgagtgagtattggcatgtggcctgcccagcagtcagctgaactgaggatcccccatcctcactcttaccctgcatccatccacacaaacacacgtacctggtatgaaggccgtgggaacacattgctgaagccaccaccactgatatagtcaacaatttcatttgtgatgaggaaaggttcctggaaggatgtgcctcccactgtggtgacataggggctgaggggagaagacagcatttggatagtaggggacccaaggggacctccaagatatgtggggaggggtgagtatagcccaggtcttgctggaggaactagactctgtggggaagcatgtatatgggattgactaagagattttgagccttcaaggcatggcccgaggtgactgtgcacacttttctctacagaacacccaccaaatcttccactaaaatgcctgggaactgacgaaaaggaacaatgggagctgtatcccacacaagagatttggggcctgggacctgcaggaagaagagacaggagtacagcaaccagggcaggcaaagcttaaggctgaaccacaggagcacatggtggggtcaagacaaaggttctacatcatgagatcacaagtgaaaggtggtggttatacctgagtggtaggctagagtacttacctggaggcagggaaggtagggcggaactggtgtcttccagagacagaccaacacccggccccactgtcacctgagagagaccaagtgtagcattcatattaattggttagggcttagtatgtgggttcggatgtcagaggggaaatttgttactgtaggaggtcagagtgtagaggtcaggtcagtggtccctactggaaggtctgagttcagattatgagtcagagaccaggctcagggatcactgtggagtcaaagctcccaggctgcagaggtgtaagcattgtctaagtttagggtaggaggtcacctgaggcgaagagcagggtgagaccccgagcggcagccttcatgagctcagtgttgacccgctggatgtaggcgctgctgagggagtcctcatcatctccatagctcacagtatgcacatgtggcagggctgactcattactgagcagcatgagccactgcaggaagggctcctgtccctcatgccggcctggattttttttttttttttttttgagggatgggcacaaagatagtcactgggggttgtcaggatctctctccagcttatagcattcccttgagggagcagggatcaacacccatctcccacccccttccccactgtccagtcctcttggtagtaccagggctactgtagacccaggtggagatgttggcaccagcactcatcaggtactgcacatctagactggcctcaatcccggcccggccccggccctgttgtccaaccacacgggctactgatgcctgatgtgcaaagttgccaccgaagaggcgcatgaactgagccaggtctgagtcatggaaatactgctccaggaactatggagggagtcagagcagagatcgtgggtccgagggtgagtcccagggtggtaaggaattgaggacactgtggggaggctatgaggaccctggggctctttgcttggctcacctgggcacaggcttggctgttattgctggtgccagagcccacgtcttgtgaggtcaagttgtatcgcttacggatcacagagggggttacccccagatgcaggcctacagtccctgtcacctgcggctcaggacgttgcctcagggatgatgttgggggaaaacggtgcagtccccccactgtagggagaagtcaggcttgaggagatcttatagactgtaatgcccaccttacaactcaccccacccccagtccccaatggcatctaaacttcctcagcccctggatctgtgtgccccaacccccattcaccccataggtgttaccaaagtccacatggggggccaaggcctgtggaagctggtagggatgtggggaccttacaacatgggtttccgtaggtcctcccacatagtgatgaaactcagccccagggagcagcagctctgcttgtctggaggtcagagaacagaggtcagaaagctcaaaacggaacagaagaagctacctctgagcatccctgggcagtcagtcactgtctccccatgcattagctcccacccacaagccccagcaagctctcaactccctcccatccatctcactgatgggatgactggtgccctccatggagcaatcatttcctctcaccggatgctcagccagcaagtcagaaagtcctgtgtgatcacagaatggcacttctgggctccggctgccaagagccatttttgcaccgtgtggagggtcagtggggatggcctcaccagatcagccacattctctagggtcaggtattttcctgcagggattcagaagaggcacttgccctcattcattgctttcccaaactcccccttttggacctcaactatgagacatcaggacttcccaaagcctggaacagggtaaaggagggctatgtgtgcaggtgtagggtgtacttgggaagcagaggaagaaaaggctggagagacttgaaatgccatggccaataatatggatttaccctaaaggccagtaagttgcaaatgtcgcaccacagcatgtattgccatgatcatgaaaatgaatgaggttaatacatataaattttccattttaattttaagcttatgtccggtaaatgttttcaaatctttcggtaccagttattcagtttagctcaaatttgcatacttgttgattttaagcttaacacgatggtgagtcactgtttcctgccatgcacactagtgtcacactgccccgtccccagcctctgcagttcacaagcacacactccccctgctgtgaagggctttaaccaggagaaggaaccaatccattttgactgttggagagactgttttgaagcagagtgggggagtacagtgaggggtggggtggagggaggagactgcagatcagctggggagctgggcagtagtccaggagtgggaataaataacggagttggtcgtaacaaaagacggcaagaaggagattaatccaaaggctctttgggagttagaactggcagccttagtatgtgaacaaaagaggaaattagaatggatttgagggtaggggaaggaacgtaagttgtactagatgcctggtagctagtaagtagcagagtcagaatttgagttcgtatttgatcataaagcctgtatactgaaccacatccccttttaggtttctagcctgaggaacacaagtgtcttggcaggctctgacatgatcgccatcccatgcccaacccagccctgtgtccctccaccgcatcccacatcctgtcctcagtcccaaaaggcaccgtattgaggagagctgggatccgacacagcctgcaccagctccgagagtctttccacattctgctgtctcagggcaaaggtgagactcagctcttcctcagggtccgcacggcccagggacacccagcctgggggcagcctgtagggtcaggggtcagggacatggctttggttagggtggagatggaaaatattggtcatggaaggttccagattaggagctgagaccttggggaggatcctaggagcagatacagatcacatgaggtgaatgataggggactgaggctaggaacatagagatgaagctatggagtgcgtactaggagctggcacgggggtgagagaagctaggaccaggacagtgggaggcagaacagggtatggggaagggggcagtctgtgctaagtcaactcacgtcctccgctggtcgggctccgggctgtaactgcatttgccagagaggatgagggcaaagagccctaggaggctgtaggggcagcaggtgggtttcagtgggagctacgttgtccttgtgttcccaccctcccaatgtgtgctccctccaacgtgatccctttctcccgagccctctcaatttctcaccaggcttggagtcccattctgcccttccgcggatctgctgtcatgtgacggatcacatgagctctatattccaccacc

SEQ ID NO: 2834 - DNA, 82238 bp, Homo sapiens
  source 1..82238: mol_type = genomic DNA
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggtgaggcggcccccgagggcccgggcgcgggggcgcgggcggccggggacgcgggtggggacacagtctcggagcccggcaggccaaagccccgctctgcggccgagtccgggccggggtgggcagcaccggggtgggcagaggtcagagccaggcgcgggagggacgggcgcccgccaaggggactcaacggcgcacagtgccagggtcgctgggcgggcgagggcccggaccccaggttgggccgtggtccccccagctcaacaaaagcagcgtgcccggcgcggctgcctggggaagcctgggtccccctttggccccagggactccccttccttctcgcttcggcgctgccaggccggaccccccaggctccttccctccacgccgccttcctctgcctacccctcgtgcctcggacaccggtcccagcctgacgtttttaaagagaattttacagcttttatcattggggtggggtggagacaccagataggcaactgacatgtgagaacttaatgtttagggatcgggagatttggtttggggaagaatagtttgtctttaagcacgaaagctgggtttccagaagataacccagtcctcttccggaattgtttcctgtggtagttttgtgtattctatttttaaacggtcttctgcagcgtgtttgcttagggtcattgaatcttgtggcttagtcttcgtttacataaggagaattcagttaggtttggttttggcgagcttctcagaccttatgaaaatatgcgacttttttttttttaaacctgaaaacatacgacggtttttaaaaattacttagttttttgccttaggcaactttaaaatctgtagattcaaggtatcataccagaaggtagtttttttgaaagtatgttgtctctcgttaaaagcattctgtttaaagtctttaaagtttaacttttgtacttttaaccctttactgaaatccagtaataaaatttcaccgttattcaagatccatctcccagcatccctgactaatcctactgtatgctgatctctcgttgatcagcccctggctatcttatcctcctttctacactaaacactcatcctcctccccacaatgtcccttcccttctggatcctttatcgtgctttctgattattgaggtagcattttggaagtaacgagggggagtctggccgaatctgcttagaaacccctgggaatcttgattcctggtgtgtgttcttcagcaccactctggagtacagcacatcttttgtgaatcagaagaggatcaggtactgaattccctcccggtaactggagttatatagttgtcgttgtattaataacttaaagacttagaacaatgacagctatcaactcatttggggctttattacaaagtaataatgcttttcattcagctgtggagtgtgtttactttttataggatgagtgggaggaaaacagctgggataagtggttcaccggttcttttgtcaggataataagagggtcagaaaagtttggagaagtgctgcttggtagaatttgttggtagaatttccagatctgtttctcacattattctgttactctctctaaagtaacaataattttcaccccacagccttgttgtgaaaattgattataagaggactggctaattacatgtgacttttttaaatgctcaagaaaaatattaaactattttggcaatgatatttattcttttttgtatatataatttcaacttttattttagattcagaaggtagaagtacaggtttgttacatgggggtattgcctgatgttaaggtttggggtgtgattgatcctgtcacccaggtagtgagcgtggtacccagtaggtagtgtttcagtcttatttccaccccttccctttgggatccccagtatctgttgttcccgtctttgtgtccatgtgtactcaatatttagctcccaccataagtgaatagaagtttatgctggatctttcatcaccaactatttggagggtaaatatatgttagatatttgcatgtaataaatattcagatgataaaatattgaaataaaatgaaagcataagtcttctcttttaacaaccttgactcagatattggcctaaacatagccagttaaaagaaattgggtacggtggcttgcaaacgtgaggatttttttttcctgtacctttaacagatttattttgtagatatatgtgtacatcattaagattagaggatggatagaaagaaaaaggaaggaaagaatgaaataggaggaagatgaggctgaactggcagtttggaaagccgggtggggtctgaataaaggactagaggcacaagtgaaaacgtggaagaacacagtgggttgtctcagtctttggtgacttccttgggcccaattcttttgtgacaggtctgtgggcatgatcaagtggaggatgggtggcatgagaagagtagtagttacgtaagtgatttcatatttcctcagcagatattcaggcacctaccaggtgcctaagtttgtgttaaatgatatagtcttgcaaactgtcactcttgcagagattgacaaggattattggggggatggggcagggattggggcagcattggccagtaagagctggactggtcaggtttcacagaccagatggaacttggactagaccagaatatatgtatgcaatagccaggaggtctcccttccaccagtcttgtttctctttgatccatccttcacatttctagagttagattccttaaaaaaaaaaaaaaaccttgtattataccctcatttaaaacaaagccattttggaatctcaactgcttttgtgtaaaaattaaaaaaaaaaattgaatggtatatatgaggccatttgccatccaactctggcctccttatgtagcctcagttctcatcatttcttatgtccatagccccttcatccccacctttcatcctttgcctccccttgaacatttcattcttacactcacctagatgtttcaggtctttttgccaatacatgcctttacatgtggcgtttcatcttccgtcaggcttctaccatccgtcatctgtaaactcctgcttcatcctttaagatccagtcgggtcttgacaccattatgttttggaaaatcaactgatttaattctgcgcgccccctccccccaccacctcgtatttatgtgtgtttgccattgtgttagggcctgcagcttcagaggtgagtaaggcccaatccctcctaagagttatttaggctttttgtctctttgctgttatagcaatttgcttagatccccttaatagcacctgaaatatgtattttagtgtttctgtttagataactttttcctggttaacttaaaaatctttgaaagcatgtatcaaaattgtatgacatgtgcttgtaatgttaaatgtttttgttgaatggaaaaaatatatatgggcataatgaaggaatataatttcctcatagagggaaaaaaaaggtttgaggaggttacgagtagtttcataaaactctatttttacattcactaaaattttattacctctctttcagttagctttccctcattccccccaagttgggttttgtgtttttacatgtttttgtatgctttcatagatagtgtcctaacctcttttttttttttccctcaaagacagggtctcactctgtcacccaggctggagtacagtggcacagtggcaggatcaccactcatttcagcctcaaactcctgggtttaagcaagcctcctgcctcagccactgcagtagctgggaccataagcatgtgccaccatacccagctaattttttaatttttttgtagagacagggtctcactgtgttacccagactggcctgacctctattatttgttgtcctgttttgtcatcatctctctacttactttttctttccaaccaatagtaacctttacaaaagcaaagattgtcttatttatattaatcattatattcttagaataaaagtcactggttaatatttattaaatctttatttgcttaaaagaatattttcagtacctttcctgaaattttaagtcaactcattaactttgtgttgtttatgatagattgcaaacttcccgccatttgttctggtcctctctgcaaatgtcctaccttttgttctggtcctctctgcaaatgtttggcaaatcttccaaccttcactaactcctctaccttactggttacattgaagacatacactaacttagattcttgacattttgggaaaagctttgggcaatttctgtttcatccagccaacatagcccagtaagcatttcccagtctcccaccccaggacccaggatttaataccgaagctcttaccgatactaactgcccatgctttcagtccctctttcccatgtgaagcctcccccttctcagagatgagtgatatagttccattgttagcagttcagcttcctcctttcctttacttctcccaaaacaccatggcaaatcctcagggggtttgcctttttaaaaccctcctctgaccctacatttctgtttttgtctttttatgtctagtgaagtggttttctttatctaatattaaagtaagaaattcatggataggataattgcatgtataataatttgtaatgaaaatttgtgtgtgtaggagagagatccttgtaagtaaagcatgtggaaataggtgacaaataagccattaaatcccattaggcttttttcctttgctaatatattgataatgaggtttctaatgagagatctatctgacttgttagtgctctcttgttattcttgatctcaagtcactcaggtttgcttattgaggtgaagataggtgatttgggttcttagtgctactgtatatctttcaaatttcatattggaatacattttaaaataggtgattttcttatatgattagtacatgacctagctagttttaattttataaagtagtatcaacttaattttgtttccatttttattttggtagattttcttacatttttctcttttttaattatatttttgagacatatagcctatctcttcagaatcagtatctgatttaagttttatagttgtatcagggtttggtatgattcccacagtgattttttttaattatgactttgagttttctgagtattagaattcttatttgttactattataggacagttcccaagaagtaaacatccaacttgagaattaccatacatgaaaataacagctgtgcctgggaggcctttatgaccccttcagctatcaggccctcagttgttccatggcaacaagattgaaatgagatttggggtccaccaaccacccatttgctttgtccggtaaaggaaaaaaaaatgtgtgcttttgttttctccacatcgagaatttccctctccttcttcagggtataccttaattacagagcttggaggttattgcagaggaaatacttgtgttggggtgaggggcatgttggtcagaaagacccagagcagtggacattaagctttgtcgtaaagagtgtgaattctccaggtggaattggagtctgaagactgtgctcttccactttactgacagtttctacggtttttatgtttctgtttctttcttgaggatggagtttttttgtttttttgtttttttgtttttcgttttttgtttttttttcagtcgttgtgtctctgttttctggctgattcctgctggtaactcagtacatattcctgaatgcaacaaattccctttggaaagccagccaagaaagagcccagaaattattttcccacaaaaatgtgtaaaaatatatattgttacttgtagcaatcatgttatggctcaaatgaaaatttgtggactggcaagaaatcaaacctttgaaaatcagtcttagtgctaagtaacttgtgtcttgtaattcagtaatgaagtattcattgaatgcctgacaggcactgctaggtagtgggtatatgtatgttcgtgaataaagtagacatggctcttgccttcatggagctttctattctaatagggggaacagatgaagatcacctacttgtatcattagaaatagaattatgttctgtgaaggaaatgaggtacagtgagaaaaaataatccagtttaggatggcagctacctaaaggaggtcatcgaggaggcctttctgcaggagggactttaatagaaaactgagagaagatagaatcctgtggaacaactgaagagataaagaattctaggcagaaggaacctgtttaaaaagtcatgaggcaggaaaaagtttggcatgtttcaggaattgaaaggaggttggcgtggttagactcctgagtaacggggtggcaggggtcagatggtgcgaggctttttatgcgagtattctgagtgctccatgaatacattgatgggcttaaaggagaggactgataaaatacagcttgttttaatacaggttgagtatcgcaaattcgaaagtctccaatgaacatgtcctttgaacttcatgtccatgattttggagcatttggaattttcaggttagggtcactcagcctgtattacttttgatggggccaagagtggaaactgagggaccacttaggtaattcacctcatggaggcaagagatggtggtggtttggaaagttaggatagtggtagtgaaaatgcaatggatttgagctctcttctagacaaagaattaacaggatttcctgttagcttcgctgtgaggagtcaactgaagtaaagaatcagaggaggattgttaagtttccagtgtgaacagctgggcgtggggattcctgggatggcaaagcctggagaaaatcaggtggtggggggcatgttaagcttgaactttgttgcgtttgaggtgctagtgtggcatccaataatggtgccattaaatggtaccattactactaaacattttttccccctaaagctctaaacttgtccagcccacagctcaccatctttagatcttttctcaaatgttaccatctcagcaaggccttccttgaccagccaaacttatgttgaaaaccccacactgaccatctcccttccctgcttaatttttctccatagttaattttcaccatctgacatgttcttttttttccctaatacccagtgtgatagcacatctgacatgttctttattttactttgttattaactgaactgctttctcgctataagatcgtcagggatttttgcgtatggatcactgccatatccccagcacctaaaatagggtgtggtctatagtaaatgctcagtaaatatttgtttattgaatatatgaaacgacttgaaggattctgtagtgtttccacgattaaattttcttactagtatttgttcaggcttttggcttaaaacagttcagttctcttttttaagtgaatgtagattttgtatatacacacacatatatatgtggatttgcattgtttaggaataaaaacctaaaatctaccattcatattttaattttcttaattttcaggttacaactgatggaaaaccaaaaatcgttgatatcattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacggggttccagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatctagcacacacttaaggggaagggatttcacaagaaatgaatcattggagctgtcttagaagaagccattattttgttgtttgatgaggtaattagaattgggcggtatttttcagtgagcttgccaaattttatgttttgaatacaaagatagagaaagtaaccacatcatagctttgccttcatgttttactgtcccttcatagtattcccagttaacttgaccatgaagaaatacttaggctatagtagctgttaacttaaatggccagctttgtcttttttttttttttaaacttctttttttcttttttttttcgagacatagagtcttgctccgttgctcaggctagagtgcagtggtgcaatcttggctcactgcaacctccgcctcccgggttctagcaattctcctgcctcagcctcccaattagctgggattacaggtgcccgccaccacgtccagctaatttttgtatgattagtagagacagggtttcaccattttggctaggctggtctcgaactcttgaccttgtgatccgcctgtctcagcctcccaaagtgctgggattataggcgtgagccagggcactcggcctaccagctttgtcttattctatgtccttggtagaaaggcctgggtaagctaaacgtaaaaaataattataaagcaagcacagaggagctcatgagctaaggagcatgaaggatggatggcaagaatttgtgatcctgtactcttaagcagcattagtttggaacataaaattatggttatttagttagcttttcccaccttttgccatctatctgaattgttcttaggtcttgtcttttaagtaagcttgttgtggcagcatattggctttctgtgccgtgtaataaagcaccacagacttagccgcctaaaaccttgtgtattcctgtatttattatatcactgattccatggggtaggagtccaggcatggctttttgtgggtctctgctcagggtctcacaagactgcagtcaagattaaaggctcagctgaggctcaggcttcttttccaagtttacatgattgttggaaaaattcatttcattgcagctgtaaaactcatgatagcttgcttcttcaaggccagtaagagaatctctgaccttggtgatgaccccagtctttcttttaaagaactcacctgattagttcaggcccgctgagaatcatgtcacttttgatttgctcagagtccttaattgcgtctgcaaaatccctacaccttctttacgtaccataacgcaatcatgggagtgacatctcattatattcacgggtcctgccttcacttaggggagggacgtgggtcttcttagaaatctgcctgtcatgggcagatagcagccattaataatccaggttctacttccttttctgtgtgttaggaactgattatctgtgtccccaccccctgccaaaattcatacattgaagccctatccctctttgtgttggtatttgaaagttgggcctttgggaggtatttagggttagatgaggttatgagtatgtgtcccctcaggataggattagtacccttataagaagagacatcagagagctctctctagagcaagctctttctagggcatatgaggacacagcaagaaggtggcctctgtaagccaggaagagggctttcacctatgctcaaccatgctggcaccctgatgctgagcttccagcccctagaactatgaaaaaataagtttcaattgtcagagtcatccagtttacggtgcgggttgagaatcccttatctgaaacgctggggaccagaagtgttttaggtttcagattttggaatatttgcattgaatataccagttgagcctccctaatccaaaatccgaaatgctccaaaatccagaactttctgagtgccaacatgacactcaaaggaaatggtcaatggagcatttcagattttcgggttagaaatgctcagccttctgaattactctagagtttggcctgtcttcccccaagtcaaccttgttattagaatatgtttcaaagggaaacttgggattcctgtgagctatggtactctgagaagctagagagaattcctagtaagtcttgcaggcttagagccatataaagtattactcgagcatttatttatttatattaattttgagatggagtcttactctgtcgcccaggttgaagtacaatggcacaatctcggctcacctcgacctctgcttcctgtattcaagtgattcttctgcctcagcctcccgagtagctgggattacaggcatgcgccatgacacttggctaatttttttgtgtgtttttagtagagatggaattttgccatgttggccaggctggtctcaaactcctgacctcaagtgatccacccacctcgacctcccaaagtgctggtattataggcatgagccaccatgcctggcctcatttatttttaaatagctgcagtaatcccggctttagataaaccacatgaactaataatatcactagtgttcaaaggtagaattatatgtgtaccatatgtattgctattaaataaagtcaaaaaaattataaggtttgtcttttctcagcttggtgacgtatttctttagctctaacattaagtattctcagcccctcattgtgggtttttaaacttaatttttaattgtgttcagtatgtcttaatagtttaaaaagacaaatatttttacaaggcttctaacaaaaagagttaaatcctgtcccacttctcccctactgttttctactttaacagtacattaatacattaaattatcttcagtttaaaataacatgctaatattttttatttcttgatttttttttctagtcttaatctttacttgtagaattaatatgtggaagaagagagtttaattctcaggtcctttatttccaagaattttttttgcattttctcttaggtaacttcctctccgttgttttgctgtttttttctggaactcctgttaattgaacattggacctcttgacttgatcctccaatttttaaatttttttccaccttttcttcattgccttaatctttttccttcctgagagatttccagcattttctcaacattgtaacccttgtgtgaattttttaaaattttgcctatttttaattgcaaaagccccttcatgttcactgggagcatatttttgtatcatgtatgcaacattttatctctgagataaaattttaatttttttctatttcattgtttcttccctccccttcctcctgttctcctttcttagtctcctattctgcttcctcctctcctttctccctttttcttcaccctctccttcctctttctctgcctcctcttccttgttctctgctttttatgttagatattttgtttaggtgtctaatcatccctagctgtcttattttagcaaggcacaagaaaaggtgattggaagctcctctgcttatgtagggtcttttggtgggtttcactatagggtaatgataacatttaggggaacccccataatatcagtatacactatatttttttccctcaggatgcccagttaccttaaagaagtccttagcccatttggcctggggtttaggggaggagtgagcaagaagtctggccgtaggtattcaggtaaccacaccatgcaaggggcctggagtgatgtcatgcagactcatttttatgtctcatcctttttgtattagttccttttcacattgctatgaagaactacatgagactggggaatttatgaagaaaagaggtttaatcgactcacagtcctacaggcttaacaggaagcatgacttgggagtcccaggaaacttacaatcatggggaaggtgaaggggaaacaagacatgtcttctcatcatgatagagcaggaaagagagccagcaaagggagaagtgccatgcttttttttttttttttttttttgagacggagttttggtcttgttgcccagactggagtgcaatggcgcgatctcaactcactgcaacatctgccacccgggttcaagcgattctcctgcctcagcctcctgagtagctgggattacaggtgtctgccaccacacccggctaattttgtatttttagtagagacagggtttcaccatgttggccaagctggtctcagactcctgacctcaggtgatctacctgcctcagcctcccaaagtgctgggattacaagcgcgagccaccgtgcccagcccccatgcatttttaaaccattagatcttgtaataattcatcatcacaagaacaacaagggggaaatccacccccatgatccagtcacctcccaccacatccctcccctgacacgaaggggttatatttcgacatgcgatttgggtagagacagagccaaaccatatcacctgttctttgctttgttgacatgtcagcttttctctggttcagcttggttggtgaagtttgggcaggatgtgggatggggcaatgggagtgctcttatacaaattttccgccagtcttcttagtcagaactctcttctccatccatccataacatgtactcacacacatgttcagtttaatttttttcagggatgtgcaggtgtttagatattttgcagtagtcaataaaaggaagaattattaatcactgggattctgactagttgcatctctgcaactctttagtacatagttttcagaaagcagcacaatgaagtcttcaagtttctttgatgtagtcgtgcatttatttatttatttatttattcatttatttatttatgacagagtcttgctctgtcgtccaggctggagtgcagtggtgtgatcttggctcactgcaacctccgtctcctgggttccagcaattttcctgcctcagcctcccaagtcgctgggattataggcacccgccaccatgcccggctaattttttgtatttttagtagagactgggtttcaccatgctggctaggcaggtctcgaactcctgacatcaggtgatccacccacttcggcctcccagagtgctgggattacaaatgtcagccaccgcgcccagctgtcatgctttgaaatgaattaaatgtttatagtctgttttttccacatagcccataaactgctaacagacttttatttttctgtcagtttaagatcaactgttaagttaggtgctttgaacactttagtagcctcattctctaaggatgatattcctaggcttccttgagaaaccagtggtaagctacttatgacctatggtactcccatgagcagataaaagtacaaaagtgaatagaactttaaaaccttttattgcaaaatatacatacataaaatacataaaacacatatatacagttttatgaatagtatagctaacaccattgtacccacccagatcaagataaagagtattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcatacgtcatttttcccttggtgttgtgagatttcagattcctgagacttgcccatgttgtcacgggcagcaatgatttattaagtttcattgctgtgcaatatgccatggtttgtacctactacattctatccattctgctgtgatgtgtgtgtatcctgtgcacatgtgtgtggatgtctccagaatgtgtgcataggagtagaattgctgaatcatggagatatgtcactaggtcatgccaaacagtttttccaagtgcgtgtttgtttgttttttaactggacaggacatcttcttgaccaagtgtctgtattaaaggacatttccaggccgggcacggtggctcacacctgtaatcccagcactttgggaggccaagcactttggatcatctgaggtcgggagttcaagaccagcctgaccaacatgtcgaaaccccctctctgctaaaaatacaaaaattagctgggcatggtggtgcacacctgaatcccagctactagggaggctgagacaggagaacacagaggttgcagtgagccaatatggcgccactgcacagcagcctgagtgacagagcgagactccttctcaaaaaaataaaaaaaagacatttccactagcagtgtataacaaatgttttctgaccccatgatcatagagatattctcctatatttctaagaagtgtcacagcttttctcttctgtttgttctagaattcacctggaagtgattttatatgcttagtttgaagagttctgtttccttttttctgtaaaaagacccagttgtcccaacaccatgtgttccacaattttcactctaatttttaatgccttcttttcacttggcacccttcaaaatgtggtgagcttctgaagtctctttcgtattctctttgtcccttcgtttttggatgcttccccgacttcctttattctaattttagtagcattttggaaggaagcacagtacctttttcattttaccacatttaactggaagtcattttaaaaatcaacacttagtcttaaatatttttggtttttaaaaaaaataaaataaagataaatccaggcataatgaatgacttggccagattcagcatggtacttagatgcagtgacagccaaaggaaactgtgcgtgtgccctggcctgtgtgatgaggctggcaagactgaaatcatttggaagcaaaagcctctaagagggcttcactgcatggtaccctaacactcagatgacacttagcccgttaagaaaaatgtttgatttgttaggcatcctctctttaagagagtcagagaaatgaggtgtaattggtaattaaaaagattacgtgtatcatatgacaatcagtcttaatacattgtagttactgtgttattagaaccatttttaagataccaacctaaaatggtcaaatgtaaagattttattcttagaaaaaataactttgtttatgtagaatactcaaatatgcaaaataaaatttcataattgcctcataaagttagctttactctaacttggctaaagttagatcagatagcccagattataacttttatctgatttttttggtgtaatttttgtaactagtctgccttcgtggtaaggaagatacatagttgtgatttgagaagtatctggttccatggaccgtgcagactttgatctcatttataattaaattatgtctattggattgtttttattgtactttatgtttttttaagaaattgtgattaaatataacttaacgactttctattttgcagttattttaattagttacttcatttaatcttttggcatttcatgattttctgtaatgtctgtacaaagaagttgctgctagccacctgtgtagtgggacagtagtgaataaatacttggaatttaaaagctagtgactacttccctttttgttgttgcagtgctttattgttttgccgtgggctgttgcaaaaacattaaagttcagaattcctattctttaaagaaggttcagttttgagtgaaaagtgctagcttgtatgccagcgtgtttgaaattacacattctgcagacatccagttgatttggaagtgattaatggcacagaggccttcaaaaggtcactatttagtattagctccttgaagctctgtgaatgattgttttcctctatttagttgtgaggaaatttcatccaaaagttttctgcctgggaagtaattggatgaaggacatggggatgagttaaaggtattgcacaagtgaggattgatgaggctaccagctctgagtgtttcaaccttgtcatttatacatatttaaaagctggttttgatgaccacggttccatgattgcaaagaatatgaatactctacattttcttgattgatcattcatgttggttgatgctcagttcacttttttgttcacaagaataaggtagagattttcttccttttacagatgaagtagaagcctgtgggttccttctagttagtgatagagtttggattcagagccagatttatctgactttaaatcccatatcctttatacagaatttttggtttccatgatagaactaggttccagttttcaactttcctcttgttcaggcaagtaatttgatttctctgctgctttgctttctctgtttgtaaactaggcgtactgtttgcatcgctctactaaaagtttaaagtgttttaaaacactttgagatcgtttaaaagattattacaagattttagcagtttattgagatagtgtatgttgaaagcactttttaaaccatgaagcattgtataaatgaaggtattattctagttgaattatttatggatgagaaaaaagaagtgataaagacattaagtaactacttagagtattaaacacgttgttgtacatgagcatccttatccaatttaagcttattagagtagaagtaatatacttttttgctcagtagtgtatcattggaattggaaagcatttagtgaatgaacaggttactctttttttttctgtagattcctgcaagctggacaaatccctcaggcaaatatcatattggcataaaaaatggctatgacttctatcctaaggcactcaaggaaaggatacaggtaatgtacaatctggtaccaatgagttgtattcttctgacttgtcttcttcctcagattttattcctactgaagaaaaagaaatatttcataaaatctcattaacttagttttttgggtggttggtggctttcaaacaatgactgcttaaagattctgctcaatggaatgtcatccgtgtaaacttgtgattcttgatcttgggtacatggataagtttagggaatctgtgaatacactgaaattatattcagatttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtgttaaggtaagtgttaattcagtcctaaaactgctgaagtgtaagaagtaccagtgtgccattagaaaaataagagtggtaagcagaatgataaagagcctgctttaaaacagttcaatagaactttctgtgataatggaaatgtttgaaatgttcagtttctgctctaaccattatggtagtcactagccatgttgctattgagaatttgaaatatgtttagtgtgactgacgaattgaaattttatcttagtaatattttaaaatttaagtttaaatagtgtcatgtggctagtgactaccgttttaagaatgctgatacaagtagctgatacaagtacctaatacaagtccagggttgcagctgtaaaataaggtataatcctgggaagtgagcttgatggataagatgtgtggggccttgcctctgtcgtgttatttccccaagggcctgtgaagcataagaagttactcagattaccttatttgtcagtttctaatcattctgcaaaacaaacaagaataatgcgtataacttctattacataatatgttattttaaaatttcaggctggaatgcagtggcatgatcacagctaattactgcctcaacctcctgggcaatcctcccatgtagttgggactacaggcacgcaccaccacacccatctaatttttgtattttttgtagggatggggtttcaccatgttgcccaggctggtctcgaactcctgggctcaagtgatccgcctgcctcattctcccaaagtgctgggactacaggtgtgaaccattgcatgactgcattttatatagtatattaaatgtaatcagctgtgttgataagatgtgatttaatatgcaaatatagtgttgttgaagtggactgttcctttagctgcgttgggagttaccgtgagttaaagacactgaagataaaggttaaaaccaatttcagtgacatagaaccctatcaagtcaaagaggatggaaaaaaaaatagggaggacattgaggatgcctgcattgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaattgactaaccagtttttagtaagtgatccatggctttatctgcttcattagaaactttttttttttttctctttgagacagagtcttactctgttgcccaggctggagtgcagtggctcaatctctgctcactgcagcctcagcctcctgggttcaagcgattctcgtgccttagcctcccaagtagctgggattacaggcacctgccaccccacctggctaatttttgtatttttagtagagacggggtttcaccttgttggccaggctggtctcgaactcctcacctcaggtgatccgcctacctcagccttccaaattgttaggattacaggcgtgagccaccacacccggccaaaaatgattttttaaaacctctctatgagaattgtgtagtatcacaactgtaccaacaaagtccacatataaatgcctgtctaggtttacctgagtatttgtcagcctaattgtaaggtaatttttctgtctttgcagaaagaacggaaggaaaaaatctgggaccctgttcacagagtggcccttgcagaagcctgtagaaaacaggaagaatttgatgttgccaacaacggctcttctcaagttggtgctagtcgatttcatttaaacattaccctagaaccatattcccatagagtttctacagaactaatagactgtttttccacaagttttcttttttcacaaattttcttttaagttggttaattttactaatttttcctttattatttatcctcaagtcaatgtacatatgtatgaatttttaaaatttaacacataatacacgtagggtaaaagtacataaattgtgtttggttatgaattctcccatgaaagctgcacctaggaatttctcttgtgccccttccttgtcactgctccctttttccttccgaaagacaaccaccaccttgacttctaacactgcagatgattttgcctattttgatttgtgtaaaatggaaccatatagtatggttttgttttttgttttttgttttttttttttgagacggagtctcgctctgttccaggctggagtgcagtggtgtgatctcggctcattgcaacctctgccttccgggttcaagctattctcgcctcagcctcctgagtagctgggattacaggcacgtgccaccacacccgactagttttttttttttgcatttttagtagagacagggtttcaccgtgttggccaggctggtcttgaactcccaaccttgtgatacgcccaccttggcctcccaaagtgctgggattacaggcatgagccaccgtgcccggcctatgtattctctaattatatgtattattgtcacttttaaaaagggtttcaaaatacttcatttttcagttaatatattagacctcaaggtccttgtttcaaaacatgggagggtgtagtccttggttcccatatactgatttgtggaattgatactgatgaactgattatctctaagtcacctgaattattttaaaagtaattaagttttccgggctttatcccctgataattctgatttactaagtgggattagaaacagcatcgatgtttgtgatagcctttacatgattgtgatttgcgtgaaatttagtaattattggccaagataataatttgctatcctactagtttctgatgtgacagcctcagattatcataaggacaaataacttgctcaggattgcacagctaagttgctgaattgagatttgaatccatatttcttccctctaggttaatactcacaccacactatttatagaaggcagattgattttaagcaatattaagtgcttttgatcaaagacgactacctttttcaataaattgccaaatagtaaatatttttagtactctcttatgactgctcaacactccccttgtatcatgaaaacctaggcaatatgtaactgaaccaggaaggccatgttccagtaaagcttcatttacacaactttgtcacaggctagatttggcccatgcaccatgatttgtcaacccctgctggatcttaatatagtaacatagtctagagatattcgtctcaatttcagtatttatatgcctttctatctcccagcttatttctgtttaaaccagtcattttcctaattatttgagtacctaacttatttttttatatacactctaggttagagaaatgttttggagaggtaacacctgctagtgccagttgttgtctagtgtgtacgtaatcgaatttaaagcacttggttttattcatgaccacagagctaaaataaggcttcacttacccccattaaatgcttctatttaacatagcagtttctaaaagatataagatgattcatgggttttattatttatttggattcttaagaaataaatttgagatagaataggtcctgatataaaaatctaaaagtcaatagataacctattttgtagcagttttagagttgcttttggaaataagttagataacaaatatgtaacaagcatatcttggctaaatggaatcaccaacgtgtagcacagtgtatttcccaaagcaggcctagtgagtgaataaatgagattgagtaaaataactgttttttagatctttattaattagatctgtattaatgggtatctgcttcattgaattgaatgacaagttgcatagatagaacaaaattttcttacattttttcagggtaaaataattttactatggattaacattgtatctttggctgtatgttaatacaacttttagaaggacagaatgtactaatgttaatcagttttccaactgactaggcaaataaactaatcaaggaggaacttcaaagtcaagtggaattgctaaattcttttgagaagaaatacagcgatcctggccctgtatatgactgcttggtatggcatgatggcgaagtctggaggtaaacttcgtgtattttatacatcttcatttacaaatgttttcttttctactctgaaaaacattaaatgctcagagctgcacagaattttggtttattcgtgatatcactcagcaaaatcatttaagggccaaattggcatctgggtagttttggacaagccccttgaacttctagttataattattgacactaaacctgacttttatctgatttaaataaacttacttcattaataatttattagtatgttgaccatccgtatatttggaaatgtttcctcatttgttaattgagatagtggtgcttacagggctttgtgaaaattaaatttgatgtttctagatatagtaagcaatcaatgtacgctgttgctgctgctgtttctattactaaaactaataataataatgcgatttataccaagttacccatcatgtacgttttttagtttcttttttagtgccttatatactgcatatgtgcttcttggagttgattagtctgccttcttgagttactatctgcatgaaaacaggaagacattgttaatacagatatttagccatatgtgtgctttaggatttctgcaaaaaaaaaacaaacaaacagggactatttcttaaacttgtagtcaagaattacttgtagtctgcgtccctgcttatacacaaagaattgcatcacaaggtggggcacacacagatcatgccatgactgcttcctcactgctctcacaattgttcaccttcacagtgcacccttcttaaaggagggttctcctcccacgtgtgcaggtactaactcatctttcatcaaaggtgtatgcaatgttaagttgaatgagaaatttctgctcaatttggggatgatggtgttaataaaataactgcacataactctttcaatctagatattaaatattaatgcacttttgtgtgtattcatacatgttgttttgttgtgtgcatatgcatacacgttttgaaaaattattttccagaggctttatacagaataataaaccttgatacatccaccatctggggtaacatgatacagtcacactcagtgataagccttaggtgcgttttagtgtgggaaaggaggcaaggttaaattcaaggaaaatgctaaatacgaaacagagtatatttaggaaagtatatactacaaaagaacttaaagaaatactaaaatattagcagggattgagtagtgaggcaataggtggtttcatttaaagtgtttgctctaggttctgaaaacactgcagattactttgtcttaggaaaaggaatccggagtcaggatgtccagggtaccagtgtgtgtttccacaagatttccttggtcttcaaggtgcttgataaagtgactcacttgtagcagtttgttgacaactattctaagggttttgtttagaacttttgagttagaaatgaaatttaatctaacattaagtgaaataaaatctgaaatctcagaataacattttagaacattttattataataaatgaatatagcataattatactttcaggtggtactagatataatgtaacttttttgcataatacagtatatcctatagggctttgatctcagagatccaaaattttttgaagagaaccttgtagatcccagggtacataaggttaatccagtcctgtctgcagatgttctcatttcacatttcaaaaatgccaaccatttctgaagggaggtaaagtgacctattctttaagtaccgtgggttttttgttttgttttgtttgatgacgaatgtccagtctgtgctctccctgccacatttctgctaattgtttagcgcgtatctctgcacttaacgggtggcctcagatgactctgttctgagcatctgtcaggacgcagagcctcagactcattgtcactccaaatggaacaaaaactggttgagagaaacagtgtttacagaggattacataaaggagaagctattagttgatttctttacagtggattttgaccttgcttatgtcatgtttccttttagattcttgatgaaagctctagattctttccacagaaaattgagagatgtgtgaaaatgtcgagaaatacataaaacaaaagccttttctctcatcctccccacttacatgtaccctgctctgtgtatgagcctcattttgatatcctttctctgtattctagctgctacttgaattcagtcaactagaccttcagaaagttataaccttgcaccacattcatacttgtcctctgtcgtgttatttagagaagtcagtaataatttatgttttgatgtgttggttgtattgttgagtcattccaatgatggtggttataagaaactgacctgtggaatgtgtcactgtatttgctgtgagaatgttgttaaggatgatgatttcgttaattccttaatcatgtggcagatgtttattgagtaccttctttgtaccaggttgacaccatagaagctactccatggactctagattccatggaagcaagtgttgggaacgtctgaaccagtctaggaagaatcgagaaagatttcccaaaagtattaataacatcttacattgagacttgaaggatcatcacagtaaactaagcagagaggtagaaagggtgggggaaagatccagaggatgttggaggaactgtgagaagtttggtgtggccacagaggatatgatgggagcaggaggtgagggaggtgagcagatgattattaggggcattgctctggagtttcaatgttaagagccgttggaagacatggaaggttttcagcaggagtcaaatgtaggggcagagcaggccatcagctcatcaggcaacagcggtaaggaagagacagtggaaataggcggacacattatggagatgggactgtgcggttagatgggctgggggaagaacagagggaggactttgtagatgacttccaggatggatgctggccgattgcataaattttggagacaagtgctacttctgtagcatgtggaagatttggtgacatgcattttacccactaatctcaagcctgattctgtttaatatgtgacttgtttgctctttgcttcattttctccataagtgtttagtttcctataccttcgtatattctattatttgaaattacatcagtcatattagggcaatgcataaaaacaaatttttaagaatccttttttccaaagtgttgtaatttgttaatgaaatatgcttcagtatttatgataaatcatctctctgtgctctaccagtaggcttctattaatttacttggcaattttgactgacttgcatagcttgttaaaatacagttcttgcatttaaaacatacttagagctaaaaacataatattgaacttttaatgatgttcatttcatttatgactttttgaatattaagtgtattttgttttaatcaggctatcttctaaagtgttcggaatataatttaaaaactattttagttagtaaaatggaaaaaacatgaaggaagacaaccataaagtaatgtagaaaatgccttctgtgagaaataaatttaagtctgttataactataggactgaagctcagtaaaattcacctagtttcaaagagcttgtgtaagccgttagattcttgaagccattactaaaagaagcagctggaagttagacctaggccatgtgtctgaactatcctaaactgctctaaaactctaagccaagttttagctgtaattcttaagagtccaggtggtttttaacctagagttttgtgaaggagggtatttttaaagcactttgtgcatgatttaagaactggttgctgtaagctatcttacctaatccttactgcccactctaagaaacaggctaaaccaggcagtcattatatttatatttgttgtggtagaggtagtagtatagtaaaatagtggagagactatgttacatgatttttagaaaggtaagaaaataaattttactgtctccatttctttttaattaatagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggtatcccatttcagattgaccaatgagatatagatttatgaggtgataaagtggtacgttgcgatagctcacagcaaccttctagagaattttaagctagagatcgtagctaaaggactaggtccagaatcataaaggtgatttgatttacctgcaagatgttgttttttaaggtcataaccatgtgggatccagtccaagaatataaaagcatgttccaacatcagaaaatccatcaataggctgggtgcagtggctcatgcctgtgatcctagcaccttgggaggccgaggtgtgtggatcacctgaggctgggagtttgagaccagcctgaccaacatggagaaaccccatctctactaaaaatatagaattagctgtgcgtggtggcacatgcctgtaatcccagctactcgggaggctgaggcaggagaatcgtttgaacctaggaggcggaggttgcagtgagccgagatcgtgccattgcactccagcctgggcaacaagagcgaaactccatctcaaaaaaaatccatcaatagaatttatctcatgaacagcaattttgcctcgaaatcttaactcttgagaaattcacccatgagtacagagaatcagataaaagaatcctcactacggcactctgtgtgatttcaaaaaagttggaaactaaatacctattaacaaaaaaatatattttttaaacaactgtgtgttattcttactgtgaaatacagtcatcctttggtatctggggggattggttctggaatgtccctcagatgctcaagtacctgatacaaaatgacatagtgtttgtgtataacctacacacatgctctcccatgtgctttcagcatctctacatgacttctaataccttatagtatgtaagtgctatataaatagttgttatactgtagttttttaatatttatatttttgatccgtggttggttaaattgcatgtagttggtgcggaacctgtggatacagagggccgaatgtattatatagcaatcaaaatgctgtgtgtataaacccctaatacataaattatattgaaaaaatatgtactgatgataaaacttgtaaaattctaaaacatgccgaatagtactatgcagtgtttatagatatgtgtgtttatatcgtgaaaatgttaaatatatagatggaaagattatgcacaccagctccaggatggtggctacttctgggggaagttctccctcccagggtagggggaaaaaggagaatgaagtgggatgactttaactctttaacgtccccctcctacctcccagttcattgaggtatagcttaagtacaaaaacttcacatacatacatatacataatttgataagcttttatgtaaatatatcagtatatccaggaaaccaccacaatcaaggtaatgaacatactcattacccccaaaagtttgctctctctattatccagcctttctccacccacatcccggggaaccactgatctgttttctgtcactccagattatttcacactttccagaattttatgtaagtggaataaaaaatatggttttctttccttcactcagcataatgattttgagattcattaatgttatgattataaagctggctctttatttctgagtaatagttctttatatagctacaccacagtttgtttatccagcttcccattgatggacgtttagattgttttggtatctgtcgacatatatttttatttatttttgggctgatagctgagagaaccagttggatatggtaaacatgtacttaatttttttttttccttttttttttttttttttttttttgagacagagtctcgctctgtcgcccaggctggagtacaggtggcacggtctcggctcactgcaacctctgcctcccaggttcaagtgattctcctgcctcagcctcctgggtagctgggattacaggcgcgtaccaccacacctggctagtttttgtatttttagtagagacagggtttcaccatgttggtcaggctagtatcaaattcctgacctcgtgatccacccgcctcggcctcccaaagtgctgagattataggtgtgagccaccacgcccggccacttaacttttttttttttttttttgagacagagtctcgctctgtcgcccaggctggagtgcagtggcgcgatctcggctcactgcaagctccgcctcccgggttcatgccattctcttgcctcagcctcccaagtagctgggactgcaggcgcccactaccatgcccggctaattttttgtatttttagtagagacggggtttcaccgtgttagccaggatggtctcgatctcctgacctcgtgatccgcccgcctcggcttcccaaagtgctgggattacaggtgtgagccactgcgcccggccttttttaagaaatattcaagctgttacctaaaggggctgtacccttttcactcccaccatggtgtgtgagaattccaggtgctctgtatcctcagcaacacttgctgtggtcagtcttaatagtggtcattctaactggtgtaaggtgttttgaaggaaaaaatcacattaaacttgtgctctcccaattttatctggggaaagaaataagaaagccagaatccgcaacattgggcgaatgttttcttgcatgacagcagctggctagagcagaggagtctcagcattgctgcagaccctgtttcaaagccacatagagatgcctgcctacttctcctggagctccaacacactatagtccccaaacattaaggcccagtgccagttgtcatttatcattgtgcttgtattattgtttttctgagactagtgggatatttctctatattcatgtcttttaagaaactttttcactaaaaggctagttttttgttttagtattactttatatataacatgtacaaaaacagatacaaatcacaagttgtacaactctttgaattaccacaaagtggacacttctttgtaactacaactcaggtcaagaaatgaaacataatgaaactcccatcatgccccttcctaatcagtaatgtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatccatttttgtatgtgacttctttagttcagccttatttttgtgagctttatctcatagtacatagtagtagtttattgctgtataattgtcagttctatgaattgatgtacatgtaaccatttactgttaatgaatcttgtggtggtttttaagtttttgaattttataaacagtgttgccatgaacatttttgtgggtgtcttagttacatgtgcacacattttggtattgtgtgtacctagaggtaggatggctggctcataggctgtggcagtgttcagctttcactccagccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgtttatttgccctttgggtatcttcttttataaaatgctttttcaaatgtttgaaggggggattctccctttttttattgtgaatttgaaagatttttatatattctggatataaagctctttgtcagctatacatgttgcaaatactttcctttgtgacttgagtttttgctctccatgaacagggtagcagagtaatgtgtattctttttatcatgattaataatatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctgtgagtgtttgtgagttgttgattcagaagattaatgattaatgatcttggatatttttaggtttataagtgctcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacgtcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcctcctacctttttgtgtttatgtgcttatatgtccaggtatatggtgatatgcctggaggtaacttataaattagaatatgattggctaagaaactataggattatatatatgcccttattttactggctaatctgtttctgtaaattgctgcctaaactagagtcttaatctctttaatagatgatagaagttataaatcataagtgtgatcttgtcaactacagttacggagaagcaactcactggccaaattctgggtgagtgttccttgacagttgtttagccatagaaccttagccagtgaagagtatgagatgtttttcataagtggattgagtgtcacggtggaagaaagaacagttgcagtggttagatgataactgtgttcaagaggactttcatcctcttgaagtcctgtttggctcgtaggccgcacacccccgttcctgtgttcacatctgtgacgatgttaatgctgttcactgcaccatgcctgaagtctcaactctgagcatgcctgtgctgtcctttgtggctcttccttggttaggtctccctcacagttcttctgagatatgcaacccacagactctggtgttttttcactgtcagatgcactgcatcctcacttctcttcccaggcaatttagatctgacaatctgtctatcattataattactagttccacaagcactctgaagccatcctcagttgtatatacatacccgacagacgcccagacttgctgaaattttgctattctctttagtgacttgcatctcatctgcaaaacttactgttggttgcgtatgttcactaactcggtcagttttcacatctcctcaatccattctagtgtgtctaggatgcacccccactcccctccttcctcgttggcttcattgtctttctgctgccaaatccagtgtcatggccttgacctaatgttaccttcctttttttcttcatagtagtagctatttgaaattacctcgagtatttacttgttgatcatctctcccccattcccatcaccaagctatcatctggtttttgagacatcactttacggtcctcgtaacatgcaccctgttatcatgagtcatttcattcttccctcttctctcacttctttattttacttaactgtatttctttctctactttaactttcatcctcttgaagccctcttttgctaatattcttccctttctcagatactcacacttacaactttgaagggtcctgtgcatggctctgtacctttttaatgttaacttcattttcttcttcatggtataacctcatctcctctacttaatgtcagtatatttttcttgtttgctgtcaagctctaagcaggtttcttacactttaaaatcttgctcttaagttcttcctagtgccttagttaccttttccacaaaagttactggttcttttggtcaatttctactcataattgtatgtacgaatcttctgaggtgtgtcttcaggactatgttaactgggggatggaaatagaaccacctattgcccgagtcactactaatattttactaccttgtagtatattttcccatatatattgttttgcacctagcactttccccacgtttaatttggccttataactgcttccctaccctaaagcccaagtagggtatatcacttagaatggctgtatcatgttccaccaagggtggatgtaccaaaatttatgtagccatatatttaaacaaggttttggtactatatacactttgggaatagaggctgattatatgttcaaaggaattctctctttttcaggagaatttgtgaagtaattaatgaagcagtatggaagcataatataatttatgtttcaagtgctggaaataatggtccatgcctgtctacagttggttgtccaggtggaactacatcaagtgtgataggttagtttcctgttttagaaatagatttgtttagaaacaagcaaacaaaaaacaatagttaatgaaatgttacctgtatctctgctacacgtaagacactgtacaccttaagtgtgtcctcaggaaacttatagtctggtaggggaaccagcacatctagaactgaccgtaatttaaagtggactgaaataagtggtttcatagaaatacacatgcatgcttttaggtgcattagcatatttagtctaaaatatcctgggataaataatcctgggagataggtattttgtatccaaaagcaaagttcttagtaaaatgtatggtacatagtagactttccttgtttccttattaaattttattcttccatcgtattagagagaggactggtgttgagagattaggcagtttactcaagtgaacagtggatttggaatcaggatccccgtttgttttcttttcttaatgattaaatccatcccacaggtgttggtgcttatgtttctcctgatatgatggttgctgagtattcactgagagagaaattacctgcaaatcaatatacttggtcttctagaggacctaggtaggtgcaggtagaacgcggaaccattacgtatattcggttaaactttacactgttgagaagggcagagttttagataagtttgctagtttttttctgttggtttttacttttttttcagtattttcattttgattaacagtctcatctcagggacagataaataaaataaatgaaatagtttcattgttacatggagaacatcactattctgagtataaattcttattcctatatccataattcttcatttataagaatctaaagaaaaagtagggacttggatatctttatatagtagtgatggccttgttttaaatagtttttgatatttgaactttggtgaaatgaaagccctaagcttttataaagcatcacagtcatagggcccacgtacctgtggctcatgtctttgaagttataacttactttgagcaattttgggtgagatccaaaagtaaacaagttctgactgagaaatgaagtctatctcttttggttccctgaagccctctgaactacatttatctgattctgtgaactgattttctgaagaggtatattaagtcctaatttatgtaattcttcgttatatcatcagcgggtacatgcaccttctgaaaaataaagcctattttaattcatctgtttggagttaatttataaaaagaatagactttgaatttagttcagcaaataccttagtgcctacagtgggcaaggcataaacgaacagtttgtgatctgagtttcaaatgccattttagtatgatgggactccagaggtgggagcaatcacttgagcccttcatggagaagacggtattgaagttgaccttaaaggatggataggatgttgagagacagaagaaaggagttctatatgccaagaataacatgaacccaaagatgagcaggtttcagtgtaaagttttttgaggacataactagtaactgagtatgtttgaagtataagattagtggggaatattggaagataagattagaaaaattgattgtgctcaggtgagatgcaataatgttatattctttgagttacagatatcttcctcattttctctaggtggtttcctctttaaaaaataaacttatcttagtagcttattataaagtgtcattgaaaacaaccaggccgtggatatccacatggatcagaaagctttgctttgcgctgtcattgtagactgcccctgccagcccagctaaagacactcaataagagtggcttaggagaagagccaaaagtcagcaaagcttgatgtgtttttgttcagttaataaaagtgtaaaattattaaacttattctcttctaaaactgagtttggaattttaagttttatcttattgtcaatgtaaaaacaaagtattagagaatgtttaaaccagcctttgccgatactcgccatagagcatttaaagaattattttaagaaaacaccaaggagttcatgaattatgggggaagcttggattaaagtagatactgattcacaaagcagatgttctaagaattgaatttgtttcatttttcataaacatgaaataatattagaaataatttgctttaattattacattagatggtataaaatatgaaacattgattaatggtcactgaacagagcatgttctgtaatctttgaaaaacgctgcctctgcatcagcattgactgagacacacagcaactactgacttccaggcatttgcacgtgtggcatatttcttaaagacgtattaccaaatgtctgggccgggtgcagtggctcacgcctgtaatcccaccacaccacttttggaggccaaggtaggtgaatcacttgaggtcaggagttcaagaccagcctggccaacgtggtgaaatcccatctctactaaaaatataaaatttagctgggcatggtggtgggtgcatgtaatcacagctacataaacaggtcgtgaaattttattatatattgtaattgagaagaaaaatattaactggctttttttgaattttaaggaaacatttctgtttcatgagacttttttttttttctttcctgaaacagagtcttgctctgtcacccaggctggagtgcagtggcatgatctcggctcactacaacctccacctctcaggttcaaccaattctgcctcagcctcccaagtagctggaattacaggcgctcaccaccacaccgggttaatttttgtatttttagtagagatggggtttcaccatgttggccaggctggtcttgaactcctgacctcgtgatctgcccgcctcggcctccgaaagtgctggaattacaggtgtgagccactgagcccagctgagactcatttttagaatactgatttaaacatctagaaatgctttatcatttaccactttaacaagctagtggaaaattaataaagagcaataagtagtcagaattcatgactctttccagttattttttccaatgctatcaaataccaatgctcattctgaacaccattaggcaatacagtgcaaacaagaaggtagaaaatcaccctaaaccttgttatctgtgatatgtgcaggtgacatattgatgaacatccttttagtcattcttccatgaattagtgggagatgacactgttcaggcacttttgtagcctacttgttattcagtattacattgtgagcatctttacaggtcaacagatatttacctagtagtaattgttctaagatggttcctaaaagaggtgctgtcagcccatttcaagaggaatatatatgtattgctttcagttctctataaaaaatgtaaagccaaattgctctagtgtttctacccaagagtaaaaatagttcactcagttgggagatggtataaggagagtctggcagcctctgtggggaatgtatggccacttagccagggaggcggaagtgtgctattctgtgccattccttctttacttggggcagaggacagagctttgttggatgataatgtggttatgaattctgagggttttaattcatcagactttgcttgtttgaagccctcagctggacagtcctgttagacttcagctgtccagtatggcagcagtcagggacgtgaggttagtctgcgttaagatgtgctgtaagtatagaatgtacaccaaatttcaaagacttggtacaaaaaaaacaatgtaaactaattcatttttctttgtatctattaattacatgttgaaatgctaatatttttgctatgtctagttaaacatactaaaattaattgcattaatgtcttgttagctttttttaagtgtggcttatagaaaatgttaatttatatggcccacattatatttctattgtacagtgctatattagaccttaaacagaaggaaagtttcttattacagataagagagatgtacactcatcaaagagtcagaacagtgacatttattttctctctctaaatatacctgacactgtggcctgtcacacatgcccagatatgtatatacacacagacatttctgtacacttacaaggaaaaaataaatgctgcctatgggaaaatggctctgctgggtgttttcccccattgattcttcatagtagtatctgtgtcactatttgtaatgagtgcagttagtacatagtgttatactattggatttaaccagtggtcgtcttaaaaatgcccatgtatgtttagctttcaccatcctaagcaaacttcaatggctttccatttagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtaagcgtgttctttattgtccttacattattgcagaccaatatttttgttttctgaagctctcatggtaagaacatgtggtagaattgataattccctgggcacaaagtagagtttaaggtaacgaataacttatgtgataatgataatttgaatgtgtgtttattcagcagtatatttgttggctgtccgctgttaacgactgtcaagcagtattttagctctggggctaaattagtgaacaaagcatcaaaaatagctgcctatgtggaggttacatcattatatatattatagttgggataaacagactctgaacaaaataaaaaactgtagatgttgcatgttagaggttaatggatgccgtgagcaaaatgaggtagaaagagaaggagggatttctagagtggtgcacaggattaaatagagtggcactgggcttagccaggactcagatttagggtagccaggctgctgtgaagctccctcctcagaaacgtccctctttaagttgtctctcctctgcctcctttcttccccgcttttctcacccacaccacagtttcttctgctcaccacatctcctcagcatggcctgtccacactggtgctatcagcataagcctgtgatgatgtaccacttcaagtgctacatccttctctaggttgagcccacactcttaggatggatcctaacatgaccctctttctagttctcttcagcctcaccaggtatttcaaggcctcttggcctccatctttgggtgtactgcactctgcctcgaagtcctgtctgccatgttgtggccttgcagactcctgtacattctctaagaggcggcttatctgtcagttcctctgatgtctgacaatatcatcaatgtttatgtgtttaatgagctctggagaggacaagaatgatacagcactcatcttatgaattggtggcctccatattcttcccataaaacagtaattcccaacctggctgtaccctagaatcatctgagagttgtttaataaataacaatctctgggacagtcctcagagattctgatttaattggtctgtcatgagacctcagcatcttttttgcttgagttcccctggggtttataacatacagttgggttgaacaccacagccaacagccatcttgtttaacccagcagtgtttgaaagaaaatgtcattcacatgcttttagatatctgctttgtacgtttatattacgccacaaagcccacaccagtctctctgcccaccacataatgagaacacagtgatttttgtggaatgaagccttcatgtaatgcaagcagtttgagtcagactgtttagttcaggtcttcaaaaaagattttaaaatgagtgttagaacacaagacattaacaccagagggtctacaggtgatcgatcatactggtgggcggctaaggtttcagatagtgagtgctacactacttgtttttgtttcttaattttaggtctgaaagctaataacattgactacacagttcattcagtcagaagagctctagaaaacactgcagtgaaggctgacaatatagaagtatttgctcaaggacatggtattattcaggtattgttgcctatatgaaaaatgggttgtaaagcatcattgagataatatcttagatattattgggtaatattttgttttataacagtgattcagtatatctgaattatggattatatggccatagaactacaagcaaaaaggatacacaaacaaattttgtagttaagacaaatctgttgcactaagatcaagaaatgtaatagatggaggccatgtagaggttagaaattcaaagaaatcgaggtcaaaaactggccaatcataacggcatagggattagttcctaaatttggtcacttgagaataacagtgtgaatagagtggagtggaagatgtgactggtgttgtttctaaaaatgtagaattgtcctcttagttggggtactaggtagttttgagaggtgaatatagacactaactttttgttttacaactgaaatcaaattgattggtaatttgcaacaaaatattttttgacccaaccatttatatcttaccatgtatattattttcactaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacaggtcagtaataggctggcagtaagctgacgtattcacatttgctgtttgaatgagtggtatcataataaagaattgctgtttgggccagtgttgtgaagagaatacatgaattgacagtatgattattttaaatcttagtcataagagaaaatattagagcaatttggggtccttgtacaatggcaatttagttagcatcttaaactaccagggaaaacagtagaatgagcctcagtgacccacagctttattaaattgtggataataaaatatcaaatttcttttccactttacctacttaggtataagacagagctttctgttgaagaatgaaaagtagaagcagtctaggagaactgcagctcgattaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaaccaagtcgctaaatttttttggaaagatgtaacatttttaaatggaaaaaaggaaaaaaatactcatctttaatttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtattgatgtatcttcatttttactttcttcactctttaaaatgtttaaaaggttaaaaaaaaatccaaagtatatttgcaatatattgctttcttgctaagaaataactagacctatccatctgccaggttattcagttcttctggtgtgtctatattcatttaagcagtgagtttctaaagaatcatattttgtccttgtatgaataagtaaaaggaaagaagaggtacagcagaacctttcaattagatctccctctaactggtgttttcttttgtcagctaaacaaagctgcagttgcttgttgttgttgttgttgttgttttaagagacagagtcttgctctgttgcccaggctggagtacagtggtgtgatcgtggttcgctgcagccttgaactcttgggctcaagtgatattcacaccttagcctcctgagtagctaggactagtggcgtgcaccaccaagcctggctaaatttttttatttttgtagagacaggatctctctatgttgcccagtcttgtcttgaactcttggcctcaagtgatcctcctgccttggcctcccagggctttgggattacaggtgtgaaccaccacacccagccagttataccttttagtactcagatgaagaaagcatctgttaaacaaatagttgtaaaccaggcatagaatagtatcacaacagtatctccacatctaaagttgtctgtagtactagtttgagctaatttttcagttgggagtaattaaaatgcacttattttgtacctgacgtctcattttcccatttcaactggtcaaatgttgctatacatttgtttgggctgtttgctattaattatgtgacctagtgtcaggaaattggtgtcaacctctggttaagaccttgattaaaagtagattgatttattctgtcagtagtttagaccttcccccgctcttttaaacatttgtttatggatattgacacttaccgattcttttttcaaggtatgtggctatgatatagcatcccctaacgcaggtccgctcttcagagttccgatcactgcagttatagcagcaaagtaagtaacaggttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgactcttgtgtgctctgagagtaactgatggcacctggcatctgccctacctctgcatcaaaactatttccaccacagtcactctgagctctgcattgcccagttcagaggataactcaggcttcgtctgacccgatcccactgtagtatttgacaatattacttcactcccctccattcctgccctttttgtctctgtcgtttttgggatttactctcttctcttaatgcttccacttttctagttatctactgtagaagcagaagttaagaaactcttaacttcccatcttattcctctggaaccaaggaaaaatcagcagattatattacttcctgcttaaagtatatcagtggcacctccaaaggtcaagttcaagctccttaaaatagcaaacaatgctccctcacaattatagccctagccagtgtttcctgtcattccgtacaccaaattacacattttggccaactcactgattttggcacttgaggattctcaggatttgtgcatgtgcacagctgataacttggtttcaatttcctgtctcttcagttaatgaccaggtgcattcctggtcatccctgggtgaagggagtcccttctttctgcttcgtggcacattttacgtgcccctggacagactttagccaatatattgtaattttttatttaacttacactctttcactgtgagcccaccgaaggcacagagactactgttatacaggatgtataaaataaattatctagtggatgaaggtgagattgggattgtgagagtactggaaaccaagtggaaattctaaactaacagttctgttactctggtaaatattaagtatgcaatagatctcagcccatgagaaacacaggatgaaattgaggagaataaatttaaaaagtggtatacatgtggaaaaattgtgcaacagttaaattctcagccgtatattccctcgaagtccagtagtaatttagaccaggtaatgtgtaagaccttcaggagtcagctgccacgccatctccttcaggaagcttcccaggctccgtaactcttcttgtctatctggagcatcttatgttaaatgtctctgatgatgattctctccatgctagattgtctaggttaaagaatcatattttcttctttgttacgtttctagctcctaataacagggcctcatgtagtaggcactcatttaaccgtttgtcctactgacaagaatttgtctctagcataaaatttgtttccgtggtgggtagttatgcatttgaactttatttcattgatttcttacaaaagtgctttgaaagtagtttgcctttctttactgttttacatcatgggagtgttttgaagctacaggaggagcttaatttaacacaagtctcatagctataataccagtgacataaaactttatcattgattttaatatctaggactcactgtagtttggaatctggtaattggaaaattctgtgaatgttgtagaatgcctttaacaaaaaagagaatgcttttttaatagtgtgtgtgaatgtatcttacaaatcataaaataggcaaaaagtagaatcatctatactctgctattcagaggttatctctgctaacctactgcaaaaattgaacaatatcgtacctactgttttgtaaccagcttctaagtccctgtgtttatttccaatgaattgttattttgcgtttatccaatgaaatctagagtatctgtggtcttataataaatatatacatttaattacttttattaattttcagagtaaatgaatcatcacattatgatctagcctttacagatgtacactttaaacctggtcaaattcgaaggcattttattgaggttcctgagggtgcaacatgggctggtaggtaaaattaaaatctgtgtgaccgcttatctctgtttacgttctaatgactatagctgtatgaggttcgtttatctgtagcatgtatttccctggtactaatatatgtatttgggtaccttagactttctgtaaagttcaaaacgtttttaagatctagtacaattttgcattggcccatacaggaaattaagccatcttaagatgtttttaatatttaaggtttgagcttagtttagaataatgccttacctggtaataattttttttttttttttttttttttttttgagacagagtctcactctgtcgccaggctggagtgcagtggcatgatctcggctcactgcaacctccacctccccagttcaaacgattctccttcctcagcctcccgagtagcttggactagcaggcgtgtgctaccacgccaggctattttttgtatttttagtagacacgaggtttcaccatgttggctaggatggtctcgatctcttgacctcgtgatacactcgcctcgtcctcccaaagtgctgggattacaggcatgagcaactgtgcccggcctaatttttaaaatactacaaatcagtttaaacaatgcagctgttgcttaaacctcaaactgttaaactctcagaattttagaaatagagctttaatctttgaagctctgtttatagaagattttcacttcagtgtctctgaaattttgagagtaaatgattgcctaacacaaagctcttgaattaacatgttatagtcctgtgagagtgctcatgtcattcttttttacaagagctgtgggtgtaccatattttccttcacaagttgtgtgtcctaaatttacaatttagcagtcagtatagaagggtatgtcagttgtcagagctcactcccattgatagaaggaagcaaatacgggcagtcaagaaagtgtcacccaatttaaattagtagccagcattgttgatacttcttggatttggcccctctgctaagcactttacagagattatcttgtctagtcccgtcagaaccctataaggtagataggtgtcattagtaaaaatggcttgtattttacttaggagtgtgttttttgtacttgtatgaaagtacagatatatttacatctgagactttattgaaaatgaaatattgaaatcacacatgtatgacttggtttgggaataactggttgtatttggttccccataccattttctggtcatctatctgtatgctgtccatctgtttgtcacctggtatcacaggaaataccagacttttcttgttttttgtaattaggtaaaggcaaaataatagcaaaagctgagagctaaagcagtgaattgaacagcacccaatatagcctgttaatttgcacactggtttataatggagctattgcagcagtgagaggcttctgaggataatcgggttgtactacactcattcattaagcatatttttctgtaccatctgtgccaggcccttttcagtgggctaaggtggtgagctacttagacaaggaccctgcttccagaggccttgagagcatctagtccaagatattgcagttaagagaactggattagagggaggcagcacagagtagcggcaaggccacgggctttggaaattgagaagtctgggtttggatccacactctgccatacgctaatggttacctgggggcaggtttctaaattttctggacttctgtttcaactgtaaatatagtcgttagtctgttgtaaggattagggattttatagtacttggtacatagcttgtcttcgttgggattacgctcacacttgacagtacttctagagggtggagtcagagttgctgtgttcagcattcctggggtcccattctcatagggcccctgggacttgtagagctccaggctctggtaaaatgtgcactggtaaattaaagaatacaaatctatggttaattaatactgaattgggtacttgtttagtgataaatggcactgatttatgattggtttaggttggtattgaaaataatttgtttttttaaataaaaattatcaaatgatctagaatgcaagtagttaagagaatttaacagtcttagttttatttcaaataattagaaatattgtcataacactagattttgtattcttagcaactgactaggttctgagagctctctgcacacctggttttatgagccacggcattgcgccttgcttcagttcccttgaattagcttgggtgttctttagaaaagctgccaatctggcattgcggtgatcttggcttacctccagcgctggctcagagtaaagttaagcataagtagtcgtgccaggctttgtagacgcacacagtacacaagtagaccaagaagagagattaggaaaagttatcaatgaggaattgaggcatgataacaaatagaggtttccaaaaatataaccttccttactttatctggaattgactggttttcagctaaaacaaggagggattttaaaaggtacccgattaatgtaattgtgtatgcatctatggacagcttgctgtttccaggtgtttgcagcctcatggtggtggttcattttaataccagtttctttcgttcccatagaaaatcttctagtcttctacctttattaatattttgttgattctttgtttttatggaaatatgcagatttgagtgtacattttatttttgatccctattatgtccctacatgggaattatccctaagtgggcattattaaagccactttatgtcaattttaggtcttataagtttaaagctttgcttctttctttcttattttagaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctagtaagtttaattatagtttataatcctaacacaatttatttgcctttttggtatgggctaagactaagtatttgcatttgattttatagtttgtatttagcatgttgggattatatatttttttaatgccaaaaaaatgaagtagaaaaatagaaaatctaatcagggtacttgaaatcaagttggaggtaattatggctgtaattcttgaatagcatagtcaaagaaacatactagtctggtagattctcgtgccttgtagttaggaccctgatttagattattctttgttgtactatagattaatttctttaagacctgtttgcttgtcacttaacttattttactaatgctgtgttgttaagctatgaggctaatttgcattataggaaaactgctactgcttcatgtctaagttatctcagatgatggcagactgcattcttatctgtggtgttggaaatgatgactagtctttcttccatagaaggtgaaagtactgatgttcttccttcaatgcgctcctttgtgttttcagttggttctgggattttcccagtatctcttggtttctggttactttcatttgtgttcttccatggatcagtgttgcttcatctttttaaacttttaaatcactgattactagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaaagttgaagtatctttattgtgtcgttatacttgattatttttcttttggtcctaattttttatttcacttcgaaataataaaatcacatttgctttattatatgtgctttcagaagctgcctaggatcttttatgacaagaagcatagggttatgagtaaataactatgtatatttaaatacaccatatctctgcaaatgatttgtctaactcttacttagcatagctgttaaaatttttgagttttcttgctacaaacaggaaaagtttgaaaacagaattgctctgaaacagctagtatttatattctgtaatttgagaaaaataagaaaagagatatattttatttacttttatttgcagggtggaaaagcaattgaattttgcattgctcgttggtgggcaagtctcagtgatgtcaacattgattataccatttctttccatgggatagtgtgtactgctcctcagttaaacattgtaagttccacaacattttcatgatttttaatgtcagttacttgtgttactggagagtaacttcattggttagatttaaactttaatgaggggaaattacctgtggttctgaagatagcagtaggctttgtgtgtgggtacttataaactttatattggacacatttattttaggtacaaaatattgcttatttttagtaaagtttgagaaagtaatttgagaaatcctttgtagcatgcatcggaaggaatcaaccgctttgatgttcagtcctccttgaaatacgaagatctggctccctgcataactttgaagaactgggtccaaacactgcggtatcattcaatgttttaggaactacagatattgaatatagattggggggatctcttacactcttaaaaaagggccttttttttttttaatccacctgcatgctagaggtgagaattttatccttgccagcagatctctgcaaggcagccccagtatcagcttctagcttcactgtcccacctgaccagcaaagtcaaggatggtggatagccgatcccagtcatgactagttaggatcagtggacattaacctttttatttcttgctgtaaaatagcaagttaacattctctctgatattattttgtgaatcctaatgcagtcatttttagaaactgcaataccattagaaactgtttattaaatggtagaaacttaagtactgtagcctgctgtttgtgcctcagcagctccccttacaaaagcagggcaccttgacctgtgttcacatactcactgtgttataaagatacctggtttcttttgtttaatctgaccttaactcatcggcatgaagcctagtcttaagtgtattaaaataaccaattagggacaatagtcagtgacacggtgatgtctaaagatatactgcttcctagaattatcaataaaaattaaaacatccagcttttgaagatatatccaacttatatcatcctgatgttttcttcctaaatctaaaaaattggagctaaatttagagtagattatgtttcactgacattttaaactatatttaaaacttactcttcagtgtcagttttctcctttataaaatctgtacattagcaacttccttcagaggactactaaaaatatgaaataacattccctcggccaggaggagggctgagtgtggcccctgccatctggtgagcagcaggggtctggggaggtctgtgctgcacacaacacagtactgtcaacagtttgcacaaggggtacaaatcagaacctgtcttgcaacacttttagttgtcaccctagtgttaggatttggttgtattgagagctgtttgttcacatttgaaaatgtttttgccatgaaaagattgcctttgtcatatttattgcaaaatctaaactgtatgtattgatatgattcaatcaaataattatgtaagttagtgattaaaatattgtagagtatactgaaaaggatagctctcaggaaggttcatctgcactttttgcaatatgttacagattttgttgcatatggttttatttgtctcattcaatgaactcttgaatcaaaccagttatgtagtttcctcattacagcccagtgagtgcaaaaacaaaacctttaggatcaagagatgttttgccaaataaccgtcaactttatgagatggtcctgacatataactttcatcaagtaagtgtttgcctagtaaagtgtacccttaggatgaacttttgtgttttatttatgattcatagaatcaaaaatggaaggacagtgtatatggtatatataaaaaacagaatcaagtgattaacagttaatttggaattactctttaggaaattataatttgtaattaaataccattcagttgtaaagtcacaaaatgtaattgagtggtgacctagccttaagccttagtttataaaatcactgatcactgtccattggtgccatctgacccaggggtgattagatggctcagaaataccatctgccttctggtgatggtgctgggcctgattgctttctgcgaagaaggcactggaacagggaaaggtcagagtagctcccaggtgggatgggtggcaaaagtaatggaggccagtgtaaatgctggaccaaagaattgttgtaagatcaatgagatttcaataaaactgttactgaaacacacatcagtttggttataatgttagggaaatggattggtttcagtgaattttcacatttcagttttataaagtaattagaggtcctgaagtatgtatatgttgctttattaatgaatacacatagccaggtgtgtatttttaaaagtttgtaagagagcagtgacttttataagtgctaaaatactgtgtgttctatattttcaaaattttttaccacaagtatttttaatgttttttaaatgaaaaagtctcatgtcaataacaatattaaaaatttgtatcagaaattatatgcaaatcatgccaagtaatcttttttgttttttaatagcccaagagtggggaagtaactccaagctgcccactactttgtgaactattatatgaatctgaatttgacagccaactgtggattatttttgaccagaacaaaagacagatgggttcaggcgatgcctatccacatcaggtataaaattgatggtgatttttagaattaacggaagctgtttcctgaactaacaaaatcctggtttcttgttatggtaatgttcatactttaaaaaaaacaaaaattatagctttgtgtttagtacttttgcaaactgtgagagcctgtttgttgtagtcggtgaagaacagatggtgtcaactatttcaccatgtagttgtgctgaattagaggaggacaagggtgaaccttgcccacactggccagcataacttttggtgtgtggtgtttctccttcctatacactgattctacctatctgaaggtagaatcatcaaagcatgcatcaaagagatgcgagcctcttgaaatgatcctaagtctgagggggctaaagagagcactgcagcagtggccgcatgtcttcagttcatttgtacttttaaatttactacctcgttggacaactctgtaatgagcacttactacataccaggcactatgctttgtgctgttttattgaagggaaaaatcacataatttatagacattttatcccttagatattactgcaaagaaatgagatatttcctgtaatatgtataattttatgttgacaaatgaaaataatttatggagatttttttcaattagttgttaaaggaatggtatcgattttcctcaaagcaagtagcagtcacatctcattacagactggcctactgcagtgctattattttggttactttttaaatctcagaaaaagtggctgacacaggatacagcatctcttcctcttgaacctgttaagtggataatagatttgtatcccttgatctctattggtttcctgtttttttcctgtctgtaataaaggagtgacattttggttgtaatttgaagatcagctgggcatggtggcacatgcctgtgatcccgtctactcaggaagctgaggtgggaggatcgcttgagccctggagctctaggctatggtgcactatgattgcaccagttaacagccactgcacttcagcctgggcaacatagtgagtccccctctctaaaaggaaataaggattaccagtagtcataagttacacgtgtgtgtgtgtgtgtgtgtgtgtgtgtgtgtgtgtgtatttgtcctagatattctatggtgcctcaattttgctcatttttttggtagtgtttcttatatgtctctgagggacccatgaactagaaaatcactgcttttgtcattctcaagcagacactgagttttgctaaaagtgtgggagtattctgtcgttctggaaagaatgagggctttgaagtcagacctgacttcagctctcttatactttactctgtgtgatgttaggcaagtcacttgatgtccctgatcctgtctgctcaccagcgtactagggactttatgtgttatatgaacgtctggatagttagttccttgcactgtacctcacatattatgaacaagtctgtgaatggtaactttcactttatcctctttcagtgatttccgttgacttggttaaacttaacttttcccaaatgttgtttttctttttcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataagtaagtgataacattgcttatacttactgcccatcgtatacactgtagtccttttaatgtcagtttatgacatctaggctaaatttagaggatgtagtcattttttttttggctgaagtatttcttcctttgatttttgaagtcttagctatgggaatgaattcagtgtggaattgttttcatgtttttccccttacttgtctttgtgaaactttctcttttgttgctttttttctctttgaattctcttgtttagaatacctaaaggggcaggacctggatgctatcttgcaggatccttaacattgtcaaagactgaactaggaaagaaagctgtaagtattagttttttaaacactgaaattacctattaaaaaatttcatttctttaaagataagaattaattccacatttcagaatggataaaagagaagatatactcttggggaaaaaaatttaatccttttttcccaggttactagtgaaagtcagttaatatttagttgtcttttaaaatgtatgctacttttgaaatatttaggcttctttttcacaagcctacagtactcaggccctgaacctgtcttacctcctacggctaatacacttgaacttcctgtgaaacatgtaaatacaaatcaaacttggcttaaatacatgtgatatttaagattagaacatgttatagaaatttaaccaataagattggttgtccatataagattatggacataggaataaatcagattatcttggggtgcttttaaaaagtagtcagaacaattaccctaaaacatgtttcttcacacttctacagacctatctcattggaatttcacatggttaagtaggaaaatatgagatgtttcttttggtattgccttttaatttcaaaatgatgctttttttagaaatatgtttctggttgttgtactttagacatatatgttacagttttataagtacctacctgtttttgttttttccttctatgttttcattacaaatttattatgagaatgatgtttatatagatctatcaccttttgtcataataatcattttagctcaatgccagtaaaagttgtcattcttaacagttttgcatttctctgtactattacttcttacagagctaagtaagcctgctacataaatgctgttatcaaaatgagtagttctcatacatcttaagaattatatttattttttgccactattgaaccaaaagccatttatttactgtcattgaagcataattggggaaacttgtgcttagaaagttgcctaccctgacatttcttgggtctcatttcagtttatactgtttatacatacgtactttagtataatttgaagtaaatcaatagttaatggtttgtaattaatacatgcactgatttaagaaaccctggtagttttttttgtagatttcatttcacaggaagcatagctgctccagctattgggcgtcagctgtgaattttcgttcagatgacagatgacactttgaagagtctgcttacttgtgaagagtataacagaaaagcattattagtaaaagtgggcttttagcaattcagaaatagttactacttcccagttacattgttttaggagacaattgtgaaattaaattataaatatgtggtgttaactatggtagctatttatcaagggagaccttcctgggagaaagcagtaacttaaagctgttgagttcattataacttccatcacattgtttatgtaatcttttctcagtggtttagcgttttcttgttttttggtagttgggaaggtaactttcacttcactttgactttcacagtaactttgttgctttttataagaatgcataggcaatggggttgttgtggtaccctttaatcagactagaccatcaactaaatttactattttaagaaatgcttttataagcaatagattttgatctactaaatttttcaataagaagttgacatgtactcttagtaataacatatttgagtactttttcttatgtaaggaatgaaagtggcaatgttgctttctttaaaagcatgccatcttaatcacagacctgagccttctaagtggtgtaacacaggtggaacataaactgaaagacaattagacagaggttctgtctccatcctgtgtagattatgcatgttttcttacagaatgtcgttctaactcccaggggcagtctgcagcaaaacgacaaggaaaatttaaaaaggtactgattgtcagttcttaaaaaagatgtcttaaagccttatttgcatattaaacttttttctgtcactattataaaccttttttttaataagtctcccttagtttcctttctttgcattctaaagtatagtgctcttagctgtacttagaagcattgttgacatactgcttttctaaaggtttttttttttttccccaccataaattcctggatgactcattttctctgtgtatacaaaaattttaatgctattcatttcttgctacagatatgataacaagtagcaatatttgaaatttttcatatttacaattttatagagagatggatgtgataattttttttttttagccatataagctaaagcacttatttttaaagtctaaaagcacttttaaattgggtgatttgattaataaaatgttgcagctttttaaagcgaactttattccctgctcttgtatccattctggttctgaaagaagagaaacaataaagatcaatggatgtagcaggaacagaaataaggactgttcactgacaattaaagcttatgctaagaacacagattttaagcccatcgctactaagtggtctgatcagcctctctgcagcatattaagcaatctttgatttactgctggggccagatttaactcagaaaagaaaatgtctgctataaatatattttagggccaggcgcagtgactcatgcctgtaatcccggcactttgggagggcaagttgggcagatcccttgagctcagcggtttgaaaccagcctgggcagcatggtgaaaccctgtctctacaaaaaaatgcaaaaattagccaggcgtggtagcacacacttatagtcccagctactctattggaggctgaggtggaaagatcgcttgagcctgggaggtggaggctgcagtaagctgagatcacaccactgcactccagtctgggtgacagagtgagaccctgtctcaaaacaaaacatacatacatatatatatatatatatatatatatatatatatatatatatatatatatatatataaaagggaccacatatttaataagctttctggtgaagacgtgctacgtcattcaacattttcatgatttctttttaaacagaaagaattacagtgggaaaatcagtaatgtcctaatgtatacttgttaattagtagtgatatggaactggggaatcaccattctataacagcttatcctttattaaaatgtcttctgaaatgtccatattattacataatagtaaataatttgtccaaacaaaatacagatactaggaatcatctttctggagaaagatctaaagatcagtatttctcaactgggtgtcttgaccgtttgggggccacgtaatgggataaaaacagcatttttttaaaataggaaatgtcagttcatcagactcataaaattgtaatttcattttatgtattaatgtgtatatctttgggacattgtaaaaatagtttgcaagttactgctttagagaacaaggaataggtattctaggaatctattaaaaatagaaggcacttatcacgaaggccatagccaattatttttcttcttatttttgttgaccttttgcaagtttgggtagattttgtttgaattaggttgtatagttaggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgattaagataaatagcattttgtatataattcttaatagattttttcctctgggtttcagtgacttgatttgaaacggtatgtcaccctttttaaaattccttgtaaaatgcaataatatattttctgtttgtttgtatgtttttttaagagacagtctcactctacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgcccaaggtggtctaaaactcccggcctcggacgatcctcctggctcagcctcccaaaatgctgaaattacagacatgagccactgcacccagcctgaatattgtcacttttaacagatcataaatagcattcaaatatgatataaattttaaaaatagtttatgtgaagcttttaaatttttgagtattcagttactaacaattttaagaactaaagaaattgccattttgaaccacaatttaacttatagtgcgttgtgttgcccaaagagtagttattggtttggcaggtgagtttgactttctgaataacactgttcagtttgaacactgttgaaatacttcatgaatagctggaatgccttttttctaaacttaacattaaatatatactgtagagaaatcttcatagcatttctgctctgaagattcttcttgactgtctttttaaaccataatcaagatttctcaagaataaaggtacaaaattatttctattaaattggtactatgttaaccccttgagaattgtcataaaaatattaatatttattggcacaaagaagaaattattgtgatacagcaagtgaaaatagcgccatttttcttttgattagaaattaaaactaccaggtttataatttttactaataaaaaattccctgtcctgaaacatcttgtaggattacactaacatttataattgttaatttgatatatttaacatgtaaaatgctgattacaaaaccttgatttttgtttcactaagataattcatcataaactttctttgtctctttttttgcttttaatgatagtctaaggttactaggatatcttttttcccacttttgataggtctttgttagaattaattgtaaatcctaaattaattttaatagattgttcattttaaattcaattctcttttctcttctgtactaaaacaatagcaaatacctctgagtctgaggaggaagtgcctcacaacacataggctgcctgcctaagagcagcatacctctctccctgatacggtgaggaggtgtgggaagctcagggagaaagactggagaccactcttctagcacactgggtggcagagaagctcaattccatggagaatggagctatattaacagaaagtaaatattggaggccacttagcccctttaattcctagatgtgttgtctttgctgtacagatgacactgatgcagtctgtttccataagaacttggtggtagaagatcagctcagattttgcgcttaccttggctttgctcagggcagtgcctacccagagagtgaacctcaagaaggagaggagcaggacaggcagctgggtcctgaaagagctagcccaagcaatagacctgtttccttttcccagtctcatgtttcacgtgaggcctttgtttacaggttctggccccctgacctcagagggagaatgacagccagtggctacaaatggatttatatggttatctgacatcaaagtggttttctgtgctttaaatgagtcagtgtggagataggattattattttgtgttggaatactattagaactacaaccatagttcctgttgtttactgttacatcattttataccccgaaattgtgttggtgaaaatatttaaaatgggaatatttgtgtcgtatatgctcctaaaaatcctatttgcgggaggtgaggacttgcagtattatttttttactcaaccagagtaaagctttttcagtgaatgtctttttgggaacatttgtttcagttttacaaactttgttaattaaaatgaatatagtattttaatttagcaccattttaaatgcaaacctgaagatagaatttgaggaactgacttaataaataacgacttaattaaggacacccagttactgtgccaaaaacaaatctagcaggtatagcatgtgatttcatttcccaaataatgctttacctttcacaagtcaagacttatctgtgaataaaataaatacagttactctccatttctctgctgctgtcttcaaagcaaaacttctcaaaagaatcacagacatgttgacttccattctcttttcatctctgtctcctccagcctggactgctccactgtcccctgacactgttcttgtccgggggggtcagtaggctctgtgctgccgggttttcagttccttccttcttcgtcgtacactgcctctcagctaaatgggcagttgatcattttctctttcttcttggtggtttttcctcaaggcttccgtgatcccaggtgctttttgctttccttttctcactcacagagctgctttttccattcactatccctaactgaccttattcatccacatatttttcaacattgtcagcaacacattggttctacctttaaagaagatctcaaatctattcattttctcccatttctgcgacccatttttagtctaaggcagtgtagggtttcctaggtttgtttcctaacttgttgtcttcttgcctccacctttaccctctataatctattttccaaatagaatacaaaccaaaattttaatccatacaggaaccagagtcattaaacaaaaagcagaaatctttaatcatgtcactgtcttttgtaaaactcttctggtatgcttcttagtgcacttggaatacaatatatagtattttttcttttcttttttaaaccatattctgtcaagccctacttaagttggctgctgcctgctttctcagaagatacagctgtgcttgctttatacccagctcaggtctttacacttgctcatctgctccttgttcattgagggtcgtttgcgtaagatattacctcttcagagtggctttctataaccactttgtgtccatcggctccccctcgttacctgacagtcattctatccttttctgttttgttttcttcctatcagatgtcagcatctggtctgttctttacctattctagcattacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattactgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagtaggtttttaaatgtattttaattctttaaatgtttagttctattttcccaactataacaatattgtgtatatatacatagaccgtatttaaaattattaacagcagttggtaggattataggtgcttttaaattttcctctttttatataaatgtgtaatttatttaaattataaatatataattttgtgattaaatgttttaatttttattttaatcactctaatttgttcttggaagataattttattggaaagtataaaaaagaaaaatcacttttgcccacaattcataaatagtcattgtcctcttattattatttttttcctctgtgtttgtacatgtagcagtgtgaataaaattagtttccatttttcagttacttttttattatgatttaacagccgtataaaatactatttttaatgtctgtgttgtatatggttctatggatgcaacataatctatttaaacgttttattttgcatatatatgtttatagcttttcttcatgatgctgcgataaacatttttatacataaaggtgattttttaaaatttccatcatattgcatcttaaaagtaaaaatcgtctcgctgtgttttgccaaattgctttctgagatgagtataataatttacactccatctagctgtgtatgtgtgctactacacaatgcaaaaaccagccattactgctgtcttaaattacgtctctagttattattaaaggagagctttttagatgttatcattcgttattagtatagcttctgacagttgagcatattcttcacctttttttctattcagacattaggtgtttctggtcgattaaaactttttacataaaagatattaatgcttttctgtacttgccacagattttactctagtgtactctttgactttgggcttgctttttacttgaaatttattctatgtagtcaagtcagttgctttttccatctgttatgcaatatttcttttactgctgatattctatgggaatcctcttcagctgattatgtatgcatccttgcagttatatggttttagagggaatagaagtcatcatgatgtgaaaatatttcccagagattgaaccattgtaatgtcagttcacttgcaaatatacctttcccacttaaaactaaattgtatctccactggaagtcaaagtcttcaggtctgtctctgcctgattttaggatgtcataaacagttgacaatataatataaattcttcaaaagtaaaattgcagagattgtcttctggcatgacagcctgaggagacccatgatgctggtccccagtaaaactagtgaaaattatttaaaaacaaaacaaaacaactttttaaagcctctggaaatggtccaaaggacattgagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtaggggctctcttgtaaagtactgttgggaacactggggccccaatgcccaggaggctgtggttccataccacacgaggcaagctgagaagaccacaggagagtgctaagctccttaagtgggggtgtcactcaaagaaaaacatgccattcttccactccctgttccagagcttgggcttagtgattttgccagtgtggcctaaggagttcataaaactgatagctcctaatttcttgctgaaggaattgacttcatttgcaacagaagatggagaagtccgtgtgccttaagggctctctcaaaaacagtggagaaaaaaggaatgaaaaaaatgaacagagcagagcctcagagaaatgtgggacaccattagtgcaccaaagtccatggaacaggagtaccaggagaacagagagaaagcaaaaatatattcagtgaaataatggctggaaacaccccatatttattgaaagacattaacctacatatccagggaactcaatgaactcaaagtaaatgcaaagaaatccacaaatagacatagcatgttaaaaatactgaaagtcaaagataaggagaagatcttgagaggagcaagacaaaaactcctcatcacttacaaggaaatgctagtaaggttaacaactgacttctgagcagaaacagtagaggtcagaaagcagtgggataatatattcagagtgctcaaaaatctcaaccaataatcctatatccagcaaaactgtcctttaaaaatgaaaatgaaataattcccaggtaaacaaaaacagagaatttgttgctagcaaacccaccttataagaagtactaaaagaagttattcagcctgaaagcaggtgatctctggcagtaatttgaatccacattggtgagagtggggaaagaaacactggtaaagttaattattatggaattataaaagacagcataaagttctcatttttttcctgttaactaatttaaaaagcagttctgtaaatattgtgtatatattaggcctatgtaatatttaaatgtaatattctgtaatatgtatttgcttatagcacaaaggagcaaaactgtattgggctaaaaaaatgactgcagatagtaaagtaattattataacagttaattaattggtgtattacagtaatagatacaacagatagaatactactacagaaggaaggagaggggaatagagctataaagggataacatttctgtatctcactgaaattaagctaggaaaaatctgaagctgattcttataagttaagatgtatatggtaagccttagagcaaccactaaaaaaaaaataaaaatgaacttgaaaaaaatcattaaataaatttaaatgttcatttaaaaatattcacttaatacaaaagaaagctgtataggaggaacagtggaacaaaaaaacaggatacatcaaaaacaaaaaataaaatcgaagacctaagtccaaatatatcaataatttaaagtttacaggaaattaagagaatcccatttacagtaacattgaaaaaaataaaatgtgtaggaacatgtttaacaagagatgtaagaattatacgtcaaaactacaaaacaattgttgaaagaaatttaaaagacctgagtaaatggaaaaggtattctttgtctgtggaccagaagacttaatatcattacactattcttcatattgatcgaatgattcagttgaatccccatcaggatccttttatagaaattaacaagctgattctaaaagtcatatgtgattccctgagactcagaatagccagacagtcttgaaaatgaagagcaaagtagggctcacacttcctgattccaaaacttaaatagaaagcaacagtaaacaagacagtgttatactggcacaagggtaagacatatatagatcagtggaatagaattaagagtccagaaataaaaccatgtgactatggtcagctaatttttagttttggcaagggtgctgatgcaaagaccatttaatgaggaaaggatagtatttgcagcaaagggtgctgggactggatagccatatagaaaaagaatgaagttggacccttgcctcacatcatatatacaagttaactcaaaatgtatcaaagagctgaaactacaaaactcaatgagacgtagtggtaaactttcatgaccttatatttggcaaaagatttttaaagataccaaaagcataagtaacataagaaaaaaaaatagataatttggacttaatcaagattaaaagcttttgtgcttttagcatagcatcaagaaagtgaaaagaacggcctatttgcaagttacatatttgtaaggagcttgtatgcaaaatatataaagaacgctaaccttttttttttttttttttgagacagggtctctctctgtcacccaggctggactgcagtggcacgatcatagctcactgcagccttgaacccctgggctcaagggatcttcccacttcagcctcccaagtagctaggactacaagtgcacgccaccacccccagcttatttttttaagggatgggatctcactatgttgcccaggctagtctggaacccccggcctcaattaatcctcctgcttcagcttcccatagtgttgggattacaggcatgagccacctccacacccagcccccagaatatataaataattcctacaatttcataatacaaaggcaaatggctcaattttttaaatgggtgagtaatctgaatagatatttctataaagatgtacaaatgaccagtaagtgcatgaaaaaatgctcaaaatcgttagtcttcagggaaatgcacatcaaaatcacaatgaaatacaacttcacacttactaggatgactggaatcataaagtcagatgatgagttttggcaagtatgtggacaaagcagaatcctcagacactgatggtaagaatacaaaaatgatgcagactttttggaaaacaatcttgactgctcttcaaatgattaaacttagtttccatatggcccagcagttccactcccaggtatatacccaagaaaaataaaaacctatattcacacaaaaacatgttgatgacagtttatagcagcattattcataatggccaaaaggtggaatgtccatcagctgatgaatggacaaacaaaatgtggtgtatccatacaggggattccttttcagccatgaatgggattaatacatgctccaacatgaatgcaccttgaaaatagtatgttaagtggtagtagccagtcacaaaaagaccatgtattatatgattctattcatattaaatgtccagaatgaggaaatctatagagatagaaagtagattagtggttgcttagtgctggggaggctggggagatctgatagcaaaagggtatggcggtttctttttgtattgatgaaaaatgttttaaagttgactgttgtgatagttacatatatctgttactatgctagaaagcattgaaattcacacttaaaatgggaaaattgtatggagaaaaaattgaaaaggttgtttacctaataggtgttttagaagaaaacagcaaaaaattattagcattccctagcaaaactttaaaaaccttagaacattttttggaaaaaaaaatttataattaaggtgcagtagttttaaaatgtaaaacgaaagtgttgattttgcccttggataattgttagcgaaaagagaaaaacaggacttaattttttttgtactaagaattagtgtaaattttgttgtctacaagttaaatttattttcatagaaagttagttatagtatcaaaatcccggtcaaccttatttttatactactgtgcagttttgttaatatattaagtgactttaatgtaagttacccacttctggtgctagtttgtatgttaatttgtttttatcctgatacatataatcaggtagaattgggaattttattcagcctccgcgtcggggaacatagaataactctttattgactcaagactggaattttcagaaaagtttaaatttttattttttctagaattttcagaaaagtttaatagatctgagacatttttaaatcttttaatctttctagctatttgtgaatatgcttttcttccttttaaataaatataatagctggtatgtaagaaagctattgatgcatatttttatttggatatcttattgaactcttaattggaataattttcagtttgatttatttatttattttttttaattaattaattaatttatttattttttgagatggagtctcactctgtcacccggctggagtgcagtggtttgatctcggctcactgcaacctctgcctcccaggttcaagtgattctcctgcctcagcctcccgagtatctgggactacaggcatgtgccaccacccccagctaatttttgtagttttagtagagacggggtttcaccatgttggccaggatggtcttgatctcttgcccttgtgatccgcctgccttggcctcccaaagtgctgggattacaggggtgagccaccatgcccagcccagtttgatttatttttgttttctagttaaccatttatactacttgccaataatgataatccttgtcaatgactatacttgtatttcaaattaatgtcttattttattggcttaaacttccaaacaatgttaaataatagagaagacaaatagtctttttaaaagaaaaaagtaaatatttctctccttcttacatacataggctggattctagtgacatttataacgaattgaaagaaacatatcctaattatcttcctctgtacgttgcacgacttcatcaattggatgctgaaaaggttagacatgttcattctgatatatcttattttgtttgtaattatataagtttgtgttttgaggaaaagtgcattatctttctcttctgttcttgctaactaaaacatgttttctcaaattgaatgttgtgttaagctgttttcatgaaggttattataagacctagccactactgtgagtttagtttaggattcttgctcatgcttggtcaatgagattagtaatagagaagataccttaacgattgttttcatgaccttaacctaaagggcaaggggcagaacgtagtaatcctggccagatggaaatctgaacgccttcactgaaagaattcctactttgcattaactttgttaatgattctcatttgtgagagttggccatagttctagtctgtcatgacatggaccagttctcattattcatcaaagcagtgggaaagtgctgtcctaatcagttgaaaatcatcaagggtttagagtgaaccagagggtatttaaaggagatttcttaaaagactttaacaagagagaagcaaattgttgggaacatcatggtaatcacagttagactgttgattataatgtttactctcatctttgtgtttttcatgatggatcagaaagaaatggtttcatcagctagggctttctttttttttcctgtgttcaggtagtgtgcaactagagtaatgacaatagccaatcacatttctagaatcttaagaaatacagaaaaggagttacctttgttaaaaaaaaaactttacatttttatgaagtttatattttgcttactctcaccattgtactccagcagggaatgtaaataaggtatttttattatgcatctgagctcaagttttatagagataccagcaattagaaaaatcacagtaggagatagcagggagcccctgggctacaagtcaattacatagtttactcacactgcagttgtaggtctcatggttgagacagcagaagtgaaattgctttcgtatactgattgatatacctattttttattatttcttttttcctctccaggaacgaatgaaaagacttaatgaaattgttgatgcggcaaatgctgttatttctcatatagatcaaacagccctagcagtttatattgcaatgaagactgatcccaggcctgatgcagctactataaaaaagtacctaaccagtaaataatctttcttgcatctcatttcctagttaacttgtttaaaaagtagggactaatattatagaggatattgcttttctgatgtttgttatatccttataatgggaattatcactatttggatactcccctccttagaaattttaaaataattttgtccaatctttttaagagtaagcccaagaaaagtagtttgccttctctactgttaagtgctgtcaaggtagagggatttgaatatctgtgatcaagcagtccaaccacttgagggtttatgtgaattggaccatatcaggaagacaaaaattaacaatctataaaataatttttaaaatgtttattgtccagtaacatgaaaaacctaatatttggtttgtaataattacatgacaaacctaatacgtggtttgtagtgaaataaatgataataaaattaggttaaaactatctggcaacttttatgaaactggttttatagtattagggagaataggaggagagaatttatagttttgcctttataaaacctaatgctgtgtgtaaatagagaagcttccctgggtttatgagtggttggtatggttccttccatgcaagtgtgatttccgtatgttggtgtaattaatggtccagtgactctgaaccaagctgccatttggtcactttcacccttccatgaactcttaaaccatcacctcatggtagctctcccagtgtcagttacttgtttatcacttttgtttatttttgacttacaggatcattaactaggtagaaatatcctgattcttttgtggttattataactaataaaccaaaactattcaggctacctgaaaatactaaattttccttaaaaattttctcagtttcagtcagtatttttttctacataaaatacttggattccaaactgctagaattctttccattatatcatttatattgatactataggatcttatgaatcttacaagcaataattttcaagtgggatagaatatatttaaaattgcttctttggccactattattaccttttcatatttttcaaaagaatagtctcaaaacattgccattttgttgttgttgttaataataacagaaaatacagccaccatttattaagtgccgattatgtataagggactattgagggcattttaaatacattgttttatttaaatttagtcttccaaacaacatggaaggcaggggcctttgtatcccccttttaaggaagagaaaactgaagttcagagagtttagatgacttggcccaggtgccactgctaggaagttggaaagcacatagtcaaatcaggatctgcctccacagccaatgccctttcttttctctgtatattcttctcccttcttgagaaggttaacataactcagtattatctcacagaaaaaggagcatcgtctgcctcccacccatcctcattgtgttcctttctgtctcagggtgatcattgttaatcttattgcaagaggaggctggccttggtcactttaaaactgtcttccacagatcaccagtgataaccagttgctaaaaagaatggcccattttgagtcttctttgagctctctgcagcccccgacattaactatcccatatactttctagcttttgttattttttacattttgtgaaaataatatgattttctcaaactcgggtgttacatgaaataacacatatggttttctcagttttaccatccacagaggaaactcaatctcagcttacagtgagccataaactaatacgatattagttttgttttcttattggtctttatcactgtttttaatctctttttttttttttttttttttttttagtttctactctttggagattactagacattgactatcatggctattgaaataagctgggataaaactagaaaagaagccataaaactttgtaaaaacgctaagagtggagctgctttaagtttttagcgacactgggtcaacttgtttatccttgtaattaaagaatttctatttctctccaggcctttgctttggcctgactgaaatagactctgaccaggttgtgtttggacagaagacagtattcagagttgaaatattatacaagatgctatcaggaaatacttagcatttcttacagatgtcatctatgggcaagtagcagccaacttaagcattaatttctcatttccatgcaaaattgctttctcttaaatcagtaacatcaaaaattgtaaaatgccattttctaatcttaaaaaatattaacttttagttaatatcatgttttagttaaatttaaactgcacttatttaggcattaaaatactgattccaattaagttgcttcctaaaatgtagctattatcttgatggatacctaactagatttgatttcaaggtccttattgagcaaatacttcatgtaaggcatcactgacaaggacttaaaacatgagcaagatagtctctactcttatgaaacttatcatctaatatagaagatgaaattgccagataggaaattattaagagataatgaaatacaagtatttttaaataaatatttcaaattgtaaaagcctgtagaaagaaaagctgactttcacctgagtggaaaaagcctcatgtactataaaggtattcaatctcagccagtcagtacaaaacctaaggagaggaaaggaatactccagatatgtagaatttagattacgtgataagaggatgctaaaatagaaagggatcttacagctaatttaacccaggtctgacaaatgcagattacctgtgtcacccccaggttgccttctgatttctgcatcattccagcccttctctgggcagccaggatccatcaggcagcatttgccgagtctgccctgcagactctggccgagcgacggatgaaaggagtgctcagacacaggtatccagtgaaagagtgggctaggggactgccagcactaagggccaaagagagttagcagtccccctgagccagcgacgctcacatttatttagtagagatttaatgacaaaggcttggagcaaacacaatttgtgggtaataaacattgtcgacccccaagtagagagcagtcctgcacatgaatgatcaaaggttggtttttggagacaggagtagtcaaatttgtctagcgcaaatgatcaaaggttggtttttggagacaggagtaaacaaatttatctagataagttcctttacattcccttgttatctgccttttgctccctggctccagataagagaatttggctgccttcagccagatcctctttcaaagcttttgcaaaacctcccagccttccaagaaggtttgcatctttccctctaacttttacctaccactctgaccaatttcctacatctccccattttctgtttttttgcatcaggttttgttgattgaagagtacagatgtgtgcagcaactggtttgtctggcgtagtggttactgcttgtattccagctttgcatcctagaattagtaaataacataagacaaaatgagtataatcagtaacattcttttccaatcaaggagtgacatgtagtgtttcttggcacctcagtccaatgtgtgctgttactaaggaaccccactgagggtatgttacccccttccagccaagcagttactttattggaggctgggaaggtggtgtctgcccaggtaacagggcagaagaaaggcaaatctaaatgatgatcccaatagcgtgtagcaggtatgggttgcaggcagagtgagagaataagaagggttaatacccaaaagagttgcagtgtacaacggaaagcatagcaaggaacaaattatctggagtgaatggtgtctatgtccagagcaggattcattcagccttctgagttttcttcaacatctcccaggtaatgtctggggtttgtgtcgtctgaagaagctgcatcatccagggctatgggtcccacagggtcattttcttcatttctggtaccgggttgggtcctagccacgctatggtatggtttgatgcctcgtgctggaatccaaagaggacctgagggggtgtgaacacaagcatgtcttcttcccagtgttaacaattcagttgaaccgcaccatacattactgtttatatctttccataaaactgcaggtttatgtcttgagaggttttagcaaaatgctcttctatagctgattgaaatttatcgtttagattttaaaaagtaagggtaaataaggcttctgccagtagtgttgcagggtccttactcatattcacttttttgttgttttctgagcatatttttaagggtggattggacacgttctactgtggcctgtccttgggggttgtgagggatgcctgtggattgttggatgttccacatatgacaaaattgctgaaattttgagctggcataagctggaccaatatcagttttaatttttgtgggccgctccataaatgcaaaagttaaaagaagatgtttaataacatattgagcagactttccaggaagagcatgtatgctaattaggtgagaattggtatcaacggatgcatgtacatatcctagttttccaaatttagggatgtgtgtaacatctgtttgccataactgattaggttctagttctctagggttaacacctgttgaaggaggggacatgcgtgtgagctggcaatttgggcattgcaggataatttgtttagtctttgggtaagttgaaatcgtttagataaatttgtccaattttggtggaaacattgatgcgaatgggtggcttggtcaagcagtgatgtcataacctgcaggtctgcttgatcattgccataagctagggggccaggcagtgagctgtgggcccaaatgtatgtaataaaaataggatgtgtacattgatccaccgattgctgaaatcaaagaaaaactgcacacagggtgggcttgagagtggacttaataagggctgtttcaaggttctgcaataaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataaccacttttccatttttaccagagccgtcaataaaaagcattaaagaattaggtattgtgggtgggggggtgtggcggtgaaccacttttgtaggcataactacaggagtactagataataactgaagtagtttattggcaggaagggcatgttctatatggcctttgtaatcagagagtgctatttgcaggtctagagataagggcaagactgctttgaattgctttttacttaaaggacttccgatgacatcacggtcataacctagcaactgattgcatcatctgcggcctaaatagatggttttactaactagctgggtacagggagatagagttttagttctggtatgtgagcaaaaaactcattttaggaagcatagccctggggacatctgtcctattaatcctgttggggaatgcttagtaggaaaaacaaacaattgaactgaatattgaatatcgtgggtctgtgcaatcctgttgcctctgaaaaatagcatgctctatttcctcaatttccctttttgctgcaggagttaaatacctgggagagtctagggctgtattgccctttaggatagaaacaggttttgtaatgtatcagttatgcccaaggtggggtgaagccagttaatatctcctagtaatttctgataatcatttaatgtgtgtaagttgctagtatttaactttttaaggtcttactgaccggtaagttagaatgtatccacgatatttctaaggagaagacaattgtactttttcaggtgctatgattaaacctcttaactgtgtattctttacgacagaggcatatagacttacaagtcctggctccgttggagctgctagtaaaatatcatccataaaatgaataatcttgcaattaggaaagtcttttctaatggggagcaaagcctgatttacatgatactgacacagtattccttgaggaagtactttccaatgaaattggcgagctggcctttattgataactggtattttaaacacaaatttttctctgtcctgttctgcaaggggaatagtataaaagcagtcgtttaagtcaataagactataggtcaaactacaggaattgccgctggggaagggaggccctgttgtaggggcctcataggttgcaaattagcattgatagcccgtaagtcatgcaaaagtctccatttgccagactttttgggaatgaggaaaatgggcaaattccaagggctgtttgacagttgtatatggctggcttttaattgttcctcagctaattcatgggctctttgtaatttctctccctttaaaggtcactgttctacctaaataagattttgagagagcctcatcaggggtaggggagaaacaacagtggccattattagaaagagatctgcagagtgacctcaaccctcttgtaaatgggctagcggctccgttttctttaatgcttttccttatctctttataagcgttaaaagtaacgggttcatacacctgattgtgttgtcaattttgcgttaccaggcaggccaagagctccccttctaatgccgcttgcctaagacagggtcccatagctgtagcatattccttgtcttttctccaatttattggaggacggggctcaggcaaaacctccgtttcctctttgttatctttgcccggtaacagcggggctgagggagaagggggaggaaccatgggttatgggaaacaacagtttgcattaggtcccttaattgagcctgcgaaaccgagcctccactagctttaagcagctgtttcattacttttatatactgttgctgttgagctgataactgttgtcccatgatgaaaccctagcctgaacaattccctcgaacttggaaatcccaagcgggcaccagtgacttactgactgcgcagtctcttcaccttcattttcgagggttccattgtgatccattgcagcgttcctctcatggggcaccacctgccaagtctgtccctcagactatggccgagtgacagatgaaaggaaaggagtactcagacacaggtatccagtgaaacagcaggctagggactgccggcactaggggccgaagagagttagcagtccccctaagccagtgatgctcgcatttatttagtacagaattaatgacaaaagcttggagcaaacacaatttgtgggtaacaaacattgtcgaccccccaagtagaaagcagtcctgcttgtgaatgatcagaggttgggttttggggacaggaggaaaccaatttatctagataagtttctttacattccattgttatctgccgtttgctctcaggctccggataagagaatttgactgccttcagccaaatcctctttcgaagcttttgcaaaacctcgcggccttccaagaaggtttgcatctttccctctaacttttacccaccaccctgaccaatctacaagtatcagcctgggtgtggaaacctgccttgtcaacccattgctgttccaagcccctttctccttcacaaaatcaggatagtagttgtgcccgacaccttggattgttggaaggcataagcaaaggactgctgagaagacatttaaggatggcacctggcatctaagaggagggggaaggagggtggatcaggcaatggcaagccatgcagatgccccacagcttggaagtcccaaaagtctacttgtaaatccttttcttcttaattccagtgtaaacaagcagtacccagaaacatctctacaaaaaggcagtgaaagttggttcttcaagctttgaggcactgtgctgagaagcactgagggatcttttaggcatagtttcatttacattgcaaatgtattggggttggtaattgccctctttgatgaactctgccagtgtgaaggaatttctctactacccacattgcctccctgcccactttcaaggtacaggatcaaatgggctttgaacctctgagaataccccggtcttgggcaatgtttcagcagcggcattttctatggtacttagcgttcatgttccctgccatgcggcctcttagattaacaggactccttggtgcgcaggattaatgtgggtgagcccttgagccttcaagttgttgggttgatggctgtctttcctactgcggatccttgttgatggtacagtcccggcagttttcacatgctacacatttcactctgagtctttcagagtcactcttagctgttagtttgttccacagctaagtgcctcaatcatcatcattttctcagtacttttagtcctcattgttttcacgtgtatctgacataagttggacagaatgcctcaaataagcacacattctagagactaacacttttccctggagtgtaggtggtggttgtatttcattcagcaatgatttattgagtttccattctgtgccgggcattgtcctaggcacgtggaatgcattgaagaaaacaaagatgtctgccctggatcaaggcaatgtgccgtagtgattaagagcacagattacagatttctactgctaagcttagaatcctggatctgccacttcctaactggaggaccttgaacaaattgcatagtctctttgggccacagtttcttcctttgcaacatggcagtaattaatagtctcttactcagaattgttttgaatgtgaatgaattaacatgttaaaatgctgagacagttgctggcacattcagagtaaagcattacatttatttgtcctagtcatgaactgaaagttttaagacataacctctgggtatacacatagacaaatgtgtaatgattactatttataagaaaactgaaaactcaaaagtcgtttacctgattaagagttatatagctaaaaaaatttagaatagtgattaacctttcaactctgttgcttctggcattccgtttcaaccaggtgcagctaccctaactcatttaatctatatgtgtaatatagtagctcatttgatgtttattaataaggcatcatatttgatgtacaatacaattgtacgtacctggatatacagtatttctgcattataaatcttaggcaaaagaatacatgaatttaaattcagataagaatttacttttaaagacattttactgatatctgaaatattttttaatttgctgtacagtgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggtaacgtttctgcttcttgtttcagcaaagttcttggggttacctcacagacctctcttgtgccccattgctggttaaaagaggaagaagataaatggaaagaatctacgctgggctctgaatatgacatgtttagcctagtacttcatgtttgtctcacctttttttaaaaaacattattttatggtactgcaaactggctgttaaaccacaataattttaaaaacagtttgagaatatgtgtagtaggcttttagttaaaccagttatgtatgtagctaaattaagaaagtcttctagaaaatgccttcaggcccacccttctctagttatatgctaatttgttggtggtaggagattgggggcaggttgaggagacatactggttagttgttacttattttcctcaaaactcttgaatttctcagtaattatcatcttgatttgtagctaatcagttttaaaacccaattcataaaagcatcgttgatgaacttttttggattttggttacaaaaacattttaaatctcttttagctctctactataattcttgcaatagcgtttatacaagttattaatcttcttttcctgtggaaataaaataaagtaaatggagtcagtaggattcccctcgcgtatcacagaccatcattttgttttagtagacaggtgcttgttctcagaattaactggtaatttgcagtaaagaaccctggaagtgggaagaaaattcttatatggttcagatttttccaacacagtacagtggtgcatttaaagaaggtactcagttactcagttatatttgggaaactgaaggagccagtattgcagcagaggtcaggaatttgaatctgaaattagagcccttgagtttggctcctgcctctaccacttttatgtatgaccttaggcaacttacaaaattttgataccttagtttcttatctacacgacctgccttaggctgtgatgaatgagtattaagtacatgcaaagtccccaacaatatttgctgttattgcaaacaattattgaaggcctatgtgccaaacactacttactactggaaacataaagatgaataagaacctgctttctgtctttgaggaatgtaacagagattgacaaacacttgatgaacatataataaaattgttatagatcattctatttttgcaatactactactatattaggggctatgcattctattacctgtttactgtgtttactgtgtctatggcaacaattgttaaatactttagttgcctttacaatacaaatcagtgtcaggattttctttgagtacattctccacattccaaagtagagaccaaaaatatatataaatgattataagtatatttgacagatgcagtaattacaggtaaaaacttgtaccaaagaaaccatgtttatataatctaatacttgtttttttacttctatcctcatttgcaattttggcattttttatttctatcctgatttgcatctttgtaattatttatgttagctctggtttcttgtgcatgaagaggtatttttaagtggatttccacggctaataatttctcatattagttttcttcccaaaaaacagatggttcattctgtggaatactcagctcttttgaagacaccaattttctttttcaaagtttttaaaaatgtactctatgtaccatattcatttcaaaagctacacttctgttaaagccttaattttatggttaaagctaatgccttaaaatgtaaattattttataaacaagctttatcatgttttacattgtaggttttgacatttgcatataaacatgcattagtaaataaaatgtatgggagaggccttaaatttgcaactaaacttgtggaagaaaaaccaacaaaagaaaactggaaaaattgtattcaagtaagtgatatttaaaatgtcactgttaagcatcactttgatattgcatagtgacaagataactagaaaggattaggactgtgatatagcaatactggttttattgtgaccagttattacagtaattagcgtaatatgaactatagaataaatatatgagagacagtcaataagctatttaaattttaaaaacacttttcactgctatccaaaaaactgatactagcctcaaatgttttcaacaagggcaaatgcattttgaattttgtaaccgtagaagccagtttttctttatgaaggaaacaaatccttttaaaggcatgttgcctcaactctaaaatggttcaacttctggagtttatatttgattttattcttcatttgagatggtaggcatttttaaaattatcttaccatatacaatattatgtgcagagaaattttatagttgaggtttctgcacaagttagttgtcaagtaaaaaaatttagctgatttctacagaagttactttagtctgacctcgtctttgaacatgcttaattggtttatgcctaaaggatacgtgaaggcaggggagtttggtggtgccagattcagctaaagggcaagtccaggttaattatactttatatgtaaggtaccctttggatgtaaaactgatcagtaggttcctctgaaaatgtttgataattagagtaagctatattcatatttactcttagagctttttgtttaccttcaccagtcagtccaaattgtaagacattttaaattagctcctccagatctttgactagattaagagaactctttctggagccaggtgttgatatgtctaatgtggttctcatcatgtggaatctgatccgtgagcacttaggtttgtaaagccagtgatccctgccgacgttcacatcagggagtgtttcttaacttgtctgccctccactctgccccccccgctgcctgttctccacacagcagctggaaaagatgccttttgacacctgctgttgaatctccatcacatttggaataaaatccaaactctccccagtggtccataaggcccctgcctacctctccagacttatttcatatcacacttgcccatacaaactctgcttctgccacaccagcatctctgcttagcacaaacagccacaccttttcctaccaaaggaccttagcactaactactctggctggatggaatgtctttcccagattttcgcacagatttcttgtcattcaaactcaactggagtatcacctccatagagatcctttcttaaccatctaactccccagttagtttatattgtgtcaaatattatttctactgtacacctgataaatatcttattacttgtttattcatttattaatttgcttattatttgcttttcctgaaagtgggaggtgaatttgttcagtgctgttttcccagtgtttgacatgatagttactcagaaaaaatgaatgaaaggaacttaggttggtaggaaggaaaggaacaagtaagttggaaggaagaagggaggaacacaggttaataggaaagagggaaaaggacagttggtagggataatgatgagaacaataggttggttggtaggaaagttggttgatagtaagaaaagttggttggtgggaaggaggatcaatgggtgggtgacggttggtggaaggaaggttctatatgctactaccttactgttactatttaatacagaatttattctaaatactgagcttaaaaatctgtcacttcctttataataatatattattgtattttgttgtagctgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaa

SEQ ID NO: 2835 - DNA, 50897 bp, Homo sapiens
  source 1..50897: mol_type = genomic DNA
ttctgtctttaaagaggtgatttatttaacaggaaacaaagaaaaaggtatcaacagtaataatttttctgagcactgagctgagaaatagctagtctaatactttgattgtagccatgtactgagacctctttgaacaatctagaagttaaaatagatttgaaaccagtcactaaaatttaaaattacatttaaaattctaaattagtcatcaaatattaggtaagaacctaaccttgcattccacaaacccacccctcaaatcggtgtaagtctgaataaagcctttgggctaagaggttatttttactaagtcagccctaccccacttccaccccaaaaatatctaaagatgaatgcctgaggaccagcataacatctaaatcaaccgagtgttaatcttattgtcagtgctctcaaatagttgttacaattcctttgatgggccgggcgtggtggctcatgcctgtaatcccagcaatttgggaggccgaggcggatggatcacgaggtcaggagatcaagaccatcctggctaacacggtgaaaccccgtctctactaaaaatacaaaaaattagccgggcatggtggcaggtgcctgtagtcacagctactcgagaggctgaggcaggagaatcgcttgaacccgggaggtggaggttgcagtgagctgtgattgcaccactgcactctagcctgggtgacagagcgagactacgtctcaaaaaaaaaaaaaaaaaaatgctttgatgttggtggtcatcggatctcatagaaatttcaggggccaagcttttgtcacttggccaagtgcgtgtgtgtgtgtatgtgtgcgtgtgtgtgtgtgtgtctgtgtgtactttttggtttgtttttttgctaccagtgctaccagctgtaacactttaatgactctttgtggaacaccagggaccactgctcatcaaccacctggggtaagaagagtggaaggaatgagtggttcagagcttaggacaggtctctgaagggaggaagggttaataacatcacattgctaagtctttgcaaactagaaacatttcagagtaattgctgatgtcattttatttacaaacgggtgtcgaatccttaatgatggtgtcacctcagactaaaaaagataatgaaaaaagagaaagaagacttgaagtttgtgtttgggtgttttccaggttatccaaatatgaaagtcagttctaccaggtctcaaaactacggaactaatgttacatgtcagaaagtcttacaaatgagtacttatgttatgctagtttttcttctcttttcctattttttaaagaacaaagacattcgtctcacccagtagacatctaagttataaagtaaatgaaactagtgttctttgcaatgcattagcaatgtttcttatttatagttgacaagtatttgtcctttccctgtgctacatataagagctggactgggctgggcgtggtggctcccatctgtaatcctagcactttgggaggccaaggcaggtgaatcacttgagcccaggaattcgagactagcctggacaacatggcaaaaccctgtctctacaaaaaatacaaaaattaaccaagcatgttggtgcacacctatagtccctgctacttgggaggctgaagtgtaagggtcacctgagcccggcaaggtcaaagctgcagtgagctgagactgtgtcactgtactgcagcctgggaaagagtgagaccctgtctcaaaaaaaagaaaaaaaaaacaaaacggtggactgtcttgtagcacaagtgagccttgtttaagaggctagtagataaagaagggaagcagtagcttgcagccccaaaaagtcttcattgtcttagtagcttgggccataattaaagccatcccacctttatagtttacgtagatttgatacatgtatacatattttatatatggatatgtgtatgtgttctttttctggagaccaggtaaacaagatatatagatacagatagatatccaaaattatcaacctgagggtattgttgaagtttttttttttttttttttttttgagacggagtctcactctattgcccaggctggagtgcagtggcgcaatctcggctcactgcaagctccgcctcccgggttgacaccattttcctgcctcagcctccccagtagctgggactacaggcgcctgccaccacgcccggctattttttttgtatttttagtagagatggagtttcaccgtgttagccaggatggtcttgatctcctgacctcatgatccgcctgcctcagcctcccaaagtgctgggattacaggcgtgagaagatattttttaaaagaggaaaatgttggctgggtgtggtggctcacacctgtaatcccagcactttgggaggccgaggtgggcggatcacaaggtcaggagttcgagaccagtctggccaatatgaaaccctgtctctactaaaaatacaaaaattagctgggcatggtggcaggcgcctataggtctagctacttgggaggttgaggcagaagaatcacttgaacccaggaggcgcaggttgcagtgagccaagattgcagcactgcactccagcctggacgacagagcgagactctgtctcaaacaaaaaaaaagaagaagaaaatgtctctgttaagaaaatgtaaatttgtcctctgagagacataattatgaaaatgaaaactcagtcactcctcaaaagagtatttagaatttaggtcctagacttcaaatcttttagagtgattagagatgcttttgtccatgtcattttataaatgagtccctggaatctaagaaaagttaaaggacttgctaaaggtcatacagctaattggtggtagaaccaaaattagaacacagactacaattctagcctacatcccccaacacttcatacacatatgcaaatatttttacctatgtagtcagatcctgagaaccataatcatactatttagaatcatggctgtatgctatataaagttgttttgttaaaaatgggtgtttttatttgtttgtttgttttttgagacggagtctcgctctgtctcccaagctagagtgcagtgacatgatctcggctcactgcaacctctgcctcccgggttcaagtgattctcctgcctcagcctcccgagtagctgggattacaggtgcacaccaccatgcccggctaacttttttgtaattttagcagagatggggtttcaccatgttggccaggctggtctcaaactcctgacctcaaatgatctgcctgccttagcttcccaaagtgctgggattacaggtgtgagtcactgcgcccagcctaaaaatctttattgcaagaataaagcttccatgattatggttaaaaagggttgtttaactagctggctttaatccattaatacagagtggtctgttatatttatctaatattatatctaagcagctttgttgatgtccctggaagcaactgcccatatcattataaattatatgtatctcctttgagataagtaaaacataatcttacaaaagagtaaacattttattatttgtacatgaatcagtttggtctgaggatacacaagcatctggctaactcataaaagtagcctgaagtgattgataggagagtgtttgtagtcatttccatttgctgccacatcccttacattatctacttgctaagcactgagaggcccagaatggacacatcaaactgtcaggaggaacatatgggacactggcacctgcaatggtttttttaaaagcagagaatgcagagcagtcacagactccacttcaaagccagggtgtgtggaggtctccggggaagagctctgcacaacaggtttcctgggggccagagggcctctcggggaggaacagaaaaaaaccagccaggagtgctaccgaccagcctcagccagaatgctgtcagaacaaggccccaaacatggcctggcctcagtgatctggggatgaacggtgtcacaagggaaccacctgaagggtgggcagaggcccccgtggaggagccacatactcttcctctctcagcagccgcagcaggatgttttttttattcttgggccagctgtagacatgagtgttctgaagccaggtgggcacatgctcctatgggaggcagaatgacaggagcaaaggtcattagagaaaaacctggatgccagatcccaggctcagttcccaaacatttctggctttccctacatgggcgtttcctaccaaactatcctgggagttgtgctgttttgcttttggaaaggtttagcatgtgaaatgttcttggcttcgggtacaagctgtatatctcattataaaaaccacatgtgcacagcattttctgtcagtctcccagactacctaccctttgcatttcaacttgcttttcaccaccctcacataaaaggggtaggacagaggtcacacagagtgatgtgaattcccctgtgacttcagaagaagtatgccagggccgtaggcttaaatcaattcattactctttcactccagccccaggtctggcctgcagtagaaggagcccatcagacctcagtgatcaggcagaggcagaaactgttagccagggatcctgggggtgcagtgtcagactgccctcatggagtggatgttctggtggggagaggcagataataagtaaatggatagtgtgttcaacagtgatgtatgctgtggagaagaattaaacaagaaaggggacagggagtgctggggcaagggtgaaagatttgcagttttaaacggggtgcttaggagaggtctcactgagaaaatgagcaaagacctaaaagagtggaagaagcaagctctgtggttgtctgggtccaggcagataggagagtcagtgcgaaggccctgtggagggagtgtgttgggtctgttcacaagcaacaaggccactgtgagtagagcagagtgagtaggtgcagaggtctggaagtagaaggggctgtatcggatagtgccctgtaggccaccataaggcctttgcttttgagtctaactcctagggactataggacgggacttctctaggtattgtgcttagaagcagcacctgctgcatggcaggcatcatactgagtactgaggatgcccaaatgaaaaggacgcagggactgccttgaggacttcaaatcttaggatgaaagcaaaatgtcaacaaatgattttctagtcaatggtgtaccaaggggacaggtggtgagagcggcctgtgctgggctcaggtaatacgggcattgtctgaaggagatttaaaaataataacaaaaccaatgaaaatttggtctattttgtatatcgccatgctccaataattctcaacaattattcccagtaccctcaacccaaacacataccattgacccaaggtgctagaattaagcacccttaagaaagggacaatgaaatatatcagcatgaaggtaaagaggtgtcagggcagggcgcagtggctcacgcctgtaatcccagcactggggaggctgaggagagtggattacctgaggtcaggagttcaagaccagcctggccaacatggtgaaaccctgtctctactaaacatacaaaaattagctgggcgtggtggcgagcacctataaccccagctacttgggaggctgaggcaggagaattgcttgaacctgggaggtggaggttgcagtgagctgagattgcaccactgcactccagcctgggcaacagagcaagaccctgtctcaaaaaaaaaaaacactttgggaggcccaggcaggtggatcacgaggtcaagagaacaagaccatcctggccaacatggtgaaaccccatctccactaaaaatacaaaaattagctgggcatagtagcacatgcctgtagtcccagatagtcgggaggctgaggcaggagaatcgcttgaaccctggaggcagaggttgcagtgagccgagatcacaccactacactccagcctgatgacagagcaagactccgtctcaaaacaaacaaccaaaagaggtgtcggggaggctagagagattgggtgatataagggtaagtaagagttcactaggcaggcaagttagggaagggcattgcaagcagacggaacagaaaaggcaaaggcacagagacaaaagaacacagcatgtgtgagggcatgctgaaatggtccagggtgaccagagcacacagcatctacagagggtgatgagagaaaactacgcaaggggacacagtcctcttctgagaggcctcatagatcgtgctaagaaaggtggatatgatcttgtagtcaatgggaaaacggcacaaaatttgtaagctaccaagaaacagatcagacctacattttggatgttcctctttgatggcagaggagaggatggctagcacaaggtcaaagtggagatgagaccagtaaggagactcatcagtaagtgacagcagtgagaccctgggcaaaggcagcgcagggaggatagaaaggtgtgccatcgcacaggctgtgcaccatacagcctgaggtgtcccgttcccataaactggagcctccctcatccagggcaggggtctcagtgcagtcttgacatctgaggatccctccagggtgaaacagggcctgagtttagggtgctgtggtctgattctcaacatgtttactccaccactgccttccctttgccaagcatggaatgtggcctcaggtggttttgcccccattctccaaacttgctggcagacccttctggtgtgaaaagcctcatatgaatcacggcaaagttcactcaggtaactatagatttaattcctgtaatcattagctttgagagctgaactatgtgcaatgaaatgcctccctggaacagccagcaaaaaccatacacatcttgacttttatgtacaagagataagaagtatgacatgaaccttctctttttctttcttgagttaaaacagaaactacatctttgtgtgcaacggttctttgaacaattaggacagcagtgatcctatcagatagctttaaaaccctcctgattcatactgctgaactgagtggtacaacttgttgatctttctggtaacattgttatctctaaggattgataaagaattgatggcagacatggtggttcatatctgtaatcccagcactttgggaggctgaggcaggcagatcacctgaggtcaggagttcaagaccagcctggccaacatggtgaaaccccatctctactaaaaataaaaaaaattagccaggcttggtggcagggacctgtaatcccagctacttgggaagctgaagcaggagaatcacttgaacccaggaggcagaggttgcagtgagccaaggtcacgccattgcactccaggctgggcaacacagcgagactccatctcaaaaaaaaaaaaaaagaaaagaaagaaaaaaagaatggacaaggttttccatttaaaatcccagatggcaaagcaaaccaaagattgaattatgaggattttgtttctttgtttgtttaccttcttagcatttgggaagagcacagggatgaatctgaaattcatgcttccttgttttatgaactcaatctgcatctgaaaccaaacaaatgtgaaggtttaatttcaggaatgaggatgaggagttaatggtacccataatcatgcacgtccacatggcatttttattctgatttccatacttgagtgccacacacttaacattttaaggcctccccattacacatctattccattcactcatcagtcgtttattggaggcctgttagaagtcacattctatgtcagactttgggttttaaggattaggataccttccagggtatgctggaactggcttgcagcagctcacaaaagcttgttgtgtgcatctcttcctaattctgtgttcagtgacttcacactgatagcttgaaattggcgatggtattggagagtatttataccatggaaataggtaagtgctacaaatcaggagagccagcttagcagaacaccacagatacagtccctatcttcacaaagccagcagtctagtgagcaggcagaaagggaaattaccaaccagagtgccgggtgaaaagtattaacaattgctctagaagcccagaatgggggccatccattctacatcagagattggaaggacagttacaaaagagggttcatttgggcactgaaagaaaagattttggtcaagtagggaaaacagaggcagaggcaacagcatgagcaaatgtctggaggtgtgaaagtgtgttgatgtggttgggaccagctactaatgcactgtgactagagcacaagatgggcttggcagagaggggatgtcaattgcgaagagctccatctgccaggctttaggttcctcacaccagttccaatatgctctgacactgtggtagcccaagaagatttagctaccaagaactctctcaaaaatcagaattttcaataggaggggagttagagtcttccaaatcctgtgaccagcacaaagctttcagtcatctgatgagaaggagacgaggaattatgtgtttccaaccatttcatcttccaattcatttttataactgagaagttttcattgtgcatggaaataacagaacagagaagaaagtgacagtggtgatagctggttattgaaatcaccatagaaacccctcataaacacacactctcacatagttgcatacgcacacacacacacacacgatcacacaacacacacaaatcctccacaaggtgttttttcggaaccacctctctctaaaaaccataagataacaccaagaacatattttaaaatgacccaagtactgtgcagctagaagcacccaccacaccagcaccgagtacacatgaaaggaaggggatggggtgcataagttacaagtgaagcactgagttttgtttgacttctaggactccgtatactgtgaagtttggcttgtgcactaggctgcccagcctgtggaggggccagccagcagcagtgcatttttattttctctcacccttccagaaactgagtttctgtaaactaattcactgtatgatgcagttactcatcagtacctctgcactacctctgtcatggccaagttcttgttgttccagggttttctgttgcctagaggggtgcaggaagtcagccaggcagtcaggaaggcacttctgtgtctgacctcttcgaccccttctatgatgagtaagggcccaagacattgtggcccaagaaaccaagtttggcgacagtttggttccagttggtacagtcagacaagctctgaggccaagctgtgtattactgcctggctacaccacacacccacagagctagacaggtttccttaggaactggctgaggcctcgagcccttcccacgcaccagctgtcagcttctgggactggcaggttcctagagatgcagacaggacattgggtgctctgaggccatgcagacatgcatcagacaaccaagggccggcagcaccccgagccagccatgaccttttcaggcagtttactcccaggaatgatacctttccggggcactgtacaagggctgtgagactggttgagaccagaagaggagggagccttatctcctgactccctggcctcactttttaacctcatcaccttgcctcggctcttccttcagtttggttgtgagctcacgtgagtggtctgcacttggtggaaagggagacagagaccatgaagactcagatggggaatacccaccctcctactttcccacgctgctgacccacaggacagacctgggacctacatctgcttcccctgaggtaaagctgtgtgccccgagacagcctgactgtgccctccccatcttcccatcttagtgacactctatgcccattccaggtgccttccccctcatgaagtgttagagctgaaatggagcttatcagttctagtccagtgattttccaagcctttttaaatctcagaatccttggtcaacaaacaagcctgagaagtacagaccagctctggctgaggtaggggtgggaggcgcagacccagcccctcctccagcacatatgggcacccactgggaactccacaggacagcctgaaagtcacaagtgtagcaccgcctcctagtcaagcagaaactgtctcacagcgtctctataatcacggggagaaggaggattcgtagcccataaaacagccagttccaacgctgggtgattgtttcggtcagaatgttctagttttatcccatgctggacaagtttaatatcctaaatgtctcccacttatttgaatataaccaggccccatagttccccacctgtcatgagctaagaacactcccttcccttgtttgagcatctgatatgcaccagatattttgaaaacattatttcatttcatcttcacgacaatcctgtaagtattagtgacccattttgtgaatagggacattgaggcacaaagagtttaagcagtggggccacggtcacacagcctgtacatgaggaagccaactttaaccaggcccacatgatgcaacagcaggtgtccctttcactacgccacctgcctttctgaaaaggtagggcacagaacatgatacagctgcaggggccagccctcctcaccaccccgtctcctgcctcctaggacttcatagttgctggtaaacagccaagccagcagagcacgtctttccagaatcttggatcctagagatgacagattgctctccccttgcaactgataggaacaactgagtcccagaggtgcagggacttgcccacagtccctaaggtagatggagccagaaccaacagctcctctcctgacatggcaagcctggagctcttcacccagcatcatgctgccttcagctggtctctggggaagaatgggacttccctggacaaggtatccatccccaggggacagtgaggtgttgtgatcccctccccactcaccattcgatgaatgtacttagtatgtaagccatgctcatcctcgtccagctgcgactcagcgccttccacgtcctgtttgtatttggggctgattgctacgattatcatcacggtcttctgttaatgagagggagaaaggcatgtttatggaagtgtaccagcaggactgtgggcattctctgacacacggggtggagggccaggctcattctccatagaaagagaagcactggcccccactcaggcagactcttatctctgcttctcccttctgtctccagcccagccccaccttgaacatgcagagcaaatggctcagagaggggctctctcaaatagatgtgcttttgcctaccattttccacaaccatcactaataaacctctaatgaaagcccgaatcactgagtgagtctgtgtcgtggcaaaaaggcactgcaacaccaacagtaagaagcaccctccctccctccagctggttctgagctgccagtcactgcactcgactgccctgtcttctgcgtgtacacattagcacagtcagtaggaacagacccttcagcacaaagcaaacatcaggctgcagacaaaaggaaaagtgcaacaccccagcctgctgagactcccgtcccccactggctccctccaaaagaagcagccgacacggacacgctggcagcaatcaatttcgatcttgttaaagcacaacgtgtcccagtggccggtatagattctgtcagtggagaacaaatcacggggctgcacgtgggcacctcgggggtggtgtgctgtgcagcctgcgaggctgcctaggaaacctcttcagcccaattctacaaaacacttggggtggcctcagattaaattgaattctgctgctctctccccactctccgccttcatttccttctttcctattctcgtcaaaagattgtttcctctgattgttatcaaccacctgtgtctggtttgaccgttatttcctgcctgtgcatgtccaagagggcgactccgtccttcctttccaagtctttgcacggcttccaacaagggaggctttgttggggctttctcagcttcagacttaggtgggtatgccagggtttctttaataaaacaacttcataagctcattgtctttctcaccagaaaacaaactctggtttttggaatgtacttacatccctaaggtagcgctccatccatttaatgatatcaatgcctcggattctatcctcaaatatgtcaatctgcaaaaaaaaagatgtgggagttggcccttaatgagaggttctctcaagatgcagagcagaagaaaacacaatactatatacatttaaagctccaaaacttaactaatgctttttgcaagaaggagcacataggtctaaaaaacaaaatataattttctgaaaatattccctatttcaacattagtaggcatttaagtagttaatgttatgtccataattaggatattgtgatacacatcaaaatatatctatggctacacaataatcaggtttttaaaaatctgagggacacggtataccactaagttggatataagccagcaatatacatatattatatatctgtaatttagacatttgaaaggcaaacataattctggaacattttaatggatgtgtggcatacaagtaactgagatacaattgtggtgctttacttgcattagtgaggtcattattatggtattatgtacagtttcaatctatatgtttcaaaaggattgtatgaaacttggagcagagccaaggaacagtcacaaaaacaattactgaaacggtagggaagaggtttatgatgaaagtcagaagtagaactcttaggccttgaaaagactgatatttactatcagcattcaagtttttgaagggatattttaaaaggagaaagatcagttattttttattttataagaaaccaaataagaaggcccttcttgggctcaggcttatactgcagagtgtgtgtgtgtgtgtgtgtgtgtgtgtgtgtgtgtgtgtgtgtgtgtgtgtgtgtgtacgtgcacgtgtgtgtttacgagatgctcttgatgggaagagggattatatactggaatgggtgactcagggagagtgtccctggggaggggttacgtgattcagctgcactgctcccagattacttgtcctaaatgtcattccaggccaggcacgatggctcatgcctataatcccagcacttgggaggccgtggcaggcagatcacttgaaaagccatccatgatccatccatgatccagcctcgccatccatgatccagcctcgcctctcttttcctcacatatcctgtctactttactccccacattggagtcccctgtaccctaaaggcacagcacaaacccccctgctctgtgaatccttcccacatgccaatctcctcctcttcctcacttcacctaactctaccccattgtgaccactaatgatactggacaattaacacgtatgataacattcttttattcaggacatgtttcatttatgtctgctgtgtctcttcaacctgatgctaagcctcctacggaaagagaccatgccctgtgtataccgaactatcacatacatagagtacagagttcagaatatgtgtctttacatgaaaaatggaatggctgttattttggtttagatgactcctgttttcaaatgtgtgatggccaacgactactcttgagaacgcttttgtagctttctgagactgtgtcactaatccattgctattatatgggagagaagcaatatagtgtcagggttgagaagaaacggacagcttgggttctgtcttggctttgccacttcccacctgcatgactttggaaatgttactaaaactctctaaatcttatcttcacttgtaatatgtagttaataaactgacttcctacggtggttgtgagaactaaaatgagttaacatggaaaaggcctatcataatgccaggcaggaaataagcactcagtaaatggtgataattggccgggcgtggtggctcacgcctgtaatcccagcactttgggaggctgaggggggcagatcacttgaggttaggagtgtgagaccagcctggcaaacatggtgaaaacccgtctctactaaaaatacaaaaaaaaattagctgagcttggtggcaggtgcctgtaatcccagttactcaggaggctcaggcaggaaaattgcttgagcctgggaggcagaggttgcagtgagccgagatcgtgccactgcaccctagcctgggcaacagagcaagaccccgtctcaaaaaaaattaaataaataaaaaatagtgattattgttattatccaagcactctaaattattcccagctactgtagtggacatcctgggtggtgcaatgagctggatatcttccatttgtttctccaagtctctcccaaagtccatagctcctgttatgatcattcctccacacagctactattatgggctgaattgtgttcccaaaattcctatgttgaagccctatctccctaccctacctcagaatgtgactgtatttggagacaggacctttaaagaagtaattaggataaaaagaggtgatatgtatgggccctaatccaacagaactggtgtccatagaagacgagattagaacacagacgtgtccacacagaggagagaccatgtgaggacagaaggagaagacagcctcaggatgaaatgaaccctgctgaaaccttgatcttggacttccagactccagaactgtgagaaaataaatttctacgcttaagccacccaatcggtagtactttataggaatcctagcaaactaatatagccatcctcttcatcttccagtaagaattccttctttgactctttagacctaggggcagtaacaactccctgcttttgctagtgccagaatactgcactatccccaataaaattggactctctaaaacctacccaaagctttgtaataggccccttattacactctccttaaattactcattaagtgtttcattccactaaggggatctagatgtgtcaataataacttagctgtccaggaccgggctctgtgatttctaccacaagtcttcatagagatgagggtcagggacagatttaaattctgcctatgtggcccctggttgtgaagataaacaaacaaaacctaagctctcctccaggggcaatcagtatgtgtctttggaaatgacaaaaagtaagatcttttctgaaatgctggccttatgtcttagtatttatttatattacagacctggtcttgttatattgcccaggctggcctccaactcctgggctcaagtgatcctcccacctctgcctcccaagtagctgggactacaggcacgcaccaccacacccagtgtaatttgattttatgtcacagttgccacagtgctttctttttttcttttttttggagacagagtcttgctctgttgcccaggctggattggagtgcagtggtgtgatgccggcttactacaacttccacctcccaggttcaagcaattcttgtgcctcagcctcccaagtagctgggactacaggcgcacaccaccatgccaacttttttttctttttttttttttttgagacagagccttgctctgtcacccaggctggagtgcagtggcgagatctcggctcactgcaaccttcacctccagggttcaagcaattctcctgcctcagcctcccaagtagctgggactacagaaatgtgccaccacactcggctaatttttttgtattttttgtagagatagggtttcactatgttgtccaggctggtcttgaactcctgacctcaggtgatctgcccgcctcagccttacagagtgctggtattacaggtgtgagccactgcgcctggccatagtttgtattttagtcgtgatggggtttccccatgttgcctaggctcgtcccgaactcctgagctcaggcaatttgtctgccttggcctcccaaagtgctaggattacaggcatgagccaccacgcctggctgctatagtgctttcttataccagaaatgagaaagggaaatattagtctctatataattatggagttggattgtataagttgtatgcattttttaaaaaagaactttcattttcattttttagaaaattgtcttggccgagtgcagtgactcacacctgtaatcccagcactttgggaggccaaggttggcagatcatgaggtcaggagttcgagaccagcctggccaacatagtgaaaccccatctctactaaaaatacacacacaaaaaaattagctgggcatggtggtgggcacctgtaatcctagctacttgagaggctgaacctaggaggcagaggttgcagtgagccaagatcacaccactgcacaccagcccaggcaacagttctagactctgtctcaaaaaaaaaaaaaaaattatcttatagaataaagaaagcttcaaataaaaactcctgttaaacaatactaaataacttttaaaattgatatttagttactaagtatccctctttacccatagacatttatattcatagatatttcccttaatttttcaccactctctagaattcactagaaaaggcctagaagagggctctggaaaggaaaagaagttatctcagtgtttgaggaaagccagtcccctgagtagcatcatgtggtactttatttatcatagagaaaaatttacatggctttaagctgtactgtgtcaagggactgcagggggacaggggcagtgtgtgtttcctgagatttctggagccaagatcacagtgggcttgcagggctgggtgaggtcagcctcccctggaactggattagaccagccccaaacctggccagtatcacccatccagaagcatcactgcgtcaaggtatgaaaatggcagctgtgcgcaatgggggattcaggctgcaggattctacttcaaacctcataacccagtgcagaacaaaaggtccttgttaaataagcaggtgaccatggtgaagcctgcagcttcctgcatcatgggaaactcagacaaagtgggcatgattggtgagaaaggacaaaggtacaaagtgcagcaagagcccggcgtttccttcaggccaggggccgctgcatatgtggtcagcattagcactgatcttgctgttcagaggtacttggggtcactcaaacagcatacaggaaaaaaatgctggagacttcagatagcttaaaatctagaaaattattacctaaatctataagcattcaatgcataatcacataaatcaaataatatcatttaaaacaccaacagctattacactttttcttctgctgcttttctctccattgtactcactataactgttcagttatctatttggacaaaatacttactgcagtttggaagccatttaccaacaaaaagttcacgaatttcaccacctccatagctgtgtccatcgaataagtgataaagactttccctaagagaaaatttttacatttattagaaactgatcaaattattctattgtaaacaaacttctaaattatatgcaatatcttttgtccttctagaataataagaggaaaccttgggcttggggtgctctaagagcttatgcctacgttgtatgctgtcctcagggcacagctcctcaggcccaaaatgccagtgggtctgtccaagggagtgcagactgctcagcgtgaatggaaatcagagcgacagaggagagcactggcaggctcagacaagcctaaggaaatccaccacccagaatccgcgagcccttaagatcaggcatgactagtttcttagagacacttggcactgtgcccaaggaatactctcccagcaggcaaagaagctaaaacttgctaagggaccacccagcagtgtcttcttttgatctcctgatgctctctgctgccctgaaatctcgctcttctgacaatagcaagtgggaggagagtgagaaactggttccccgctcccttcttccccgcaatccactcacttttgcagaaaggccagcaagtttggagtagaccaaagcacagctcagatatgttagtaaaaaaacacttcagcagcttgaagaagagacactgcctctgggcagtccaacatcacagactccatcactcatccctgggtcagcttagagcagcagacagtacagtttggataagctttacccagtcaggatgaaccagtgttttctcaggctaaagtcttggggaaattgtctgactagcattttaatgtgaaagctgaataattactttgtgttggcttttagtctggaatggaccacttaaatctcaggaagcccttggggcagaagatggagaagaaaggggggctggagagaaaatacgagtctgtatctacactgaggttttttgaaacacacctcccaaatggaagtgtgtataatggtcatattaactcacttaagcagccagatatatagatggcactcaattttcttctgaacacctaacattcacccaattgttacgtatttgaggacttcctttatagattatggtaagatatatatgatctatagattgatatcaggactataatgtatgtggggcagcatctgttctccagaaatgctcaaaattaaaatgattaagatcttaagaaagtgttcagaaataaaatgttttgaatgaaaacagcaatgaatcattgtcatagagagctttcagagttgtcaatgactaaacagcacagatcccccaaaaggaattagcagatgcaaaaggctttgtttcaggtttggttcaaagaggttcccagatttggaaaatgcatattagaattacctgagcttctctagcaagcacatcatataataatttcacaagtagtggctgttttcttaagatttctggaaattactgtcctgactgaccttaatatgagaacattttggtgatatttcaacatttctggttctggcagcaaaatgtggaaaaagaatcatcaccttacgcttagttgaatgtttctttaaataaaaggcttagtttgcatttggttgtgatgcagtatggagaatgtgagaccgttttttccaaacaagattgctcattcctacaggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagaggtaagcagtttttgagtgttactagtggtgtcagaatcactaaaaacattcatacaaaatgctggttactttttaagcaaaaagcaaaaaagtgcattttattttactgtgtacatgagaaatagctgaggttatgaggccaggtacagtggctcacgcctgtaatcctagcactttgggaggccaaggcgggtggatcactcgaatccagcagtttgagaccagcctgggcaacatggcaaaaccccgtctctagtaaaagtataagcaaattagctggttgtggtggtatgcacctgtaaccccagctatttgggaggctgaggtgggagaatcacctgaccccaggaggttgaggctgcagttagccatgatcacaccaccgcactcccgcctaggcaacaggagtgagaccctgtcttaaaaaaaaggaaaatcttcgagattagggacgagtgatcatccagccatcacaaagtataagacctcacaagaagaaggagtggccgggtgcggtggctcacatctgtaatcccagcactgtgggaggccgaggcaggtggatcacgaggtgaagagatcgagaccatcctggccaacatggggaaaccccgtctctactaaaaatacaaaaaattagctgggtgtggtagtgggcacctgtagtcccagctactcgggaggctgaggcaggagaatggggtgaacctgggaggcggagcttgcagtgagctgagatcgcaccactgcactccagcctgggcaacagagcgagactccgtctcaaaaaaaaaaaaaaaaaaaaagaggaaggagagaacaatgttgcaaacaacttacgcaattcttctggcaaattgcttgtttttagagttcctctggctggagggttgctagggggtctaggcacagcagctggggacggaggctggggaacctgtggtctcagctctgcagggcactccaaggactccccaggagcaccagctctattaggtggctggtgatgtggctggtccctagaaaggaatacatttacagtcaattttcattctttacaaaggcaaaccttcagggacagaaagacttttagaactatgggaagatcccagtgggctctctctcctctgcctctatttcttaactgagacagaaggaagaggggagctccatggagttgtagtcaataagcgtttcagctggctgccacatgtgagggcctgtgctctgactccaaagagggaagcaggatttgatttctctattcaagatttgtttaattggaaaaacaagtctcatgcacagggcagacaaggtcaccaacaaaacaaagtagtatgacaggtgacacagatggttgatgttataggcattcagataaaaagacatgacttttagctcataataggtaacatttaattatgtatcaaaaggtaaagagggccatgtagatttagaagtatttgtactgttgacatataaatggaaatctgattttgaagaccctttaaagaagttgctaccatattagatagcatctttattattttcgttgccagtattcccacgagcattctgctgagatgaacaatcagatgacctcgtgtgagatttggaggagagaaggaaatggagagcatgcgtctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccgccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaattttaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttgcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgtgttttgtttgttttttagtttttgagacagagtctcactctgtcacccaggctggagtgcagtggcacaatcacggctcactgcagccatgacctcttgtgctcaggcagttctcctgcctcagcctccttagtagctggaaccacaggtatgtgccaccacacccggctaatttttgtatttttttgtagagatgggttttcgctatgttgcccaggctggtctcaaattcctgggctcaaacaatccacccacctctgcctcccaaagtgctgggattacaggtgtgagccaccaagcccagcctagctcctctacctgaacttatttttcattatcctaaagtgataaaatagatcaagaagatcagaacaggcttaaattgatgctataaaaccaattactctgtattatctttgcaactcttttgtaagtctaaaattgtttgaaaataaaagtttattttaaaaattactattctctttcctattcaacacaaaacttatttcataaagatgcttacattttgtttatttccctggaattttagatatttcttctgttagagtgcctatcctgctataaaatcacattttacctaattccattgtttaaactccatgtatttatggtttagaaaaataagggatctggcccagcacggtggctaacacccgtaatcccagcactttgggaggctgatgtgggtggatcacttgaggccaggagtttgaaaccagcctgggcaacaaagtgagaccccttctctgcaaaaaataaaaaaattagctgggtgtggtagcgggcgtctgtagttccagctactcttgggaggctgaggttggaagatggcttgagtgcaggaggcgaaggtttcagtgagtcgagatctcgccactgcactccaccctaagtgacagagtcagatcctgtcccaaaagaaagagagaaaaaaagagatctgtcttgaaagaaaatatgagggtttgtgggcttctgagcaaaagagaaagcaggcatgtgcctcttcaccattgttaataaagtgggctttttttctttccatgaaatgttcaaactaattaccgctttctgtatttctgaaaaatccactctaataggaacttcatattttactctatgctgtaaaaacagaatctagttttacagtggtatataaaagttgcttttgagcaaaagtaaacatttaatctactttcttccaaatattgtcataaatgaggaagctccatttacatgagttttacctatatattttagatccataaattaagagaaaaggaaagtccaaagagaataagggaaaaaaaatgattaaagaggcagggcacagtggctcatgcctgcaatcccagcactttgggaggccgaggcgggcagatcacaaggtcatgagttcgagactagcctggcctatatggtgaaaccccgtgtctactaaaaatacaaaaattagctagacgtgatggcgcgcagctacccaggaggctaaggcaggagaatagcttgaacccaggaggcggaggttgcagtgagccaagatcataccactgcactccagcctggacgacagagcaaggctccatctcaaaaaaaaaaaaaaaaaaaaaaaagattgaagagttagacaactgaagtcatgaaaatacggagttaagcataggagagacctaataatggtactcaacatgtatgaatgtttttattacaaaagaaaataataggccaggcacagtggctcatgcctgtaataccagcactttggaaggccaaggtgggtggatcacttgagcccaggagttcaagaccagctgggcaacatagggagatcccttcactacaaaatatacaaaagttagctgggcatggtggcgcatgcttctagtcccagctacttaggaggctgaggtgggaggatcgcttgaacctgtaaggtagaggttgcagtgagtcaagtttgcaccactgcactccagcctgggtgacagagcaaaaccctgtctcaaaaaaagaaaagaacaggtaattttaaattttgatggaaaattaattgaatttaacattttaaagtaagaaataggcttaaacaggaacagacactagacatataaagagttggctaacagtggaagtcagtcgtagtaaaatcaaaaatctattttgtggactaaaaattcagatgatctgaaaataaaagaaaggggtgtgacttggagaacatctgaagagcctttccttcaagagaatttcgactagtcactagtggctttctatgtctgataaagagatccttgtcaaccagcttccgtttcctcctgacctgaaaagtctatattgggcattccactatgtgacttgctcactaacgtgggttagcaaacctatagagaattctgttacatcttcattgcattggcataattcctttccatgttaaaaatgcctgaaggttgggcctgtcatacttactggtgccttggaagccccggaaaggagcagtctctctgtgcgggcctctcttcgtggtcccaggggctgggataattcaggataaccttctgcacagggtgcaggcctctcacactggctccaggcaggggctgcccaggcagagccggctggatcacttgctggtaggctgctcgagggtagtcatggccatctgtaggtgaagacaacaaagacaacagggaacatcaactctagctccttcgtgtgaaaggagtcataagctccatgctcatttgtgtcttgatcccagctgaggggtccagatatctgttaccacctctgtgatgtttgccgtatttctctactgttaattacttgagtgttttcacgaaattcacttttttttgtcctaaataaaaacatctgcgaaatcaccagtttggtattccagctggagagctcaaaaaacttttcaaaaaactctacacaggctcctcttttcgtaagatacttaggaaaatccaaccatgaagaacctctttcacaccaccattcctaccacaatttccttcatgtcccgaacccaaggctaggaaaaattatctgtatgatagatatagaatcactgctctgtattttcctcccccaagtggacatacacgtgcatgtgcacacacacgtgcgcgcacacacacaccccactctcctcttaagaagaggtaaatgaatgaaaacttggctcatcctcctgggaactagccaaccaactggcaataccctccaactcccttggtcctctcctgctacagcctacgtgcacttggagccagggctgcttgaagagggctgggctcagagcaaagccagagctggcagtgacttatgtgaatgtgcaacctgggagaaagtgggtcccagccaggaccaggagcaggagggtccccagggaagggcagcctgctgctgccagagttaagcataggagagacctaatgcttaatcacgcaaaagaatagaactaaaagcccagaggagagatgcagggaaccaagtaagggtgagagggaagggctctgagggaatggcccaggcccaaagggggtaaggtgttgggaaatacgagagatgcaagaggactgaagtgagccacatggtagccctgcaagatgagcaatgagcacctcctagtgatccaagcactgcccctcctacccacataagcagtaagacgatccaggaggaggcgtaactagttaggacaagaaggaaggtgttttgttttgttttttaaaaatcctcattgatcttaaaattattttgattcttttaagatcaaccctcattgatcttaaaattattttgctgattataaatgtaataatcaagtttgcctgccatgtagataggatacatatatggatgtacagcaaaataaaactggcaagtaaacaaaaaagtgactgataggttgaaaccaaaatgagaagctgagaatgtggataaaaattgattcttaaggccaggcgtggtggctcacacctgtaatcccagcactttgggtggccgaggcagacagatcacctgagttcaggagttcgagaccagcctggccaacatggtaaaaccccatctctactacaaatacaaaaattagctgggtgtgatggcgcgcacctgtaaccccagctactcaggaagctgaggcaggagaaacccttgaacttgggaggcagaggctgcagtgagctgagattgtgccattgaactccagcctgggcaacagggcaagactccgtctcaaaaacaaaaaaaagaactgtattcttagcttggcaaagcagtcaggagccatctacgttttcaaaggaacattcaggggaatgatggcctcaagtacagaacaagagataaataatgtgcacgttcactagtgtggcctcctccaggttcccagtgcctagactcaggaaactgtttgggtgacctggcgatgtgcccaagctagtctctcaagtgtggtcagattccctggactcaatctattattgtctcctttgacccatgtcaccacctgggtccttccagtcatgcttcttctggcaaaagtgaccatgcccctccatcccagactgtctcctggcaggaccccatgacccttgccctgatattgcttaggcctggtcatgacaagtagtaggggtttaaagagggggaggaggagaaacagatctgcctagatctatccctgcacctggatgacaaaggagactgggacttgaagggactgttctcagaatggaagacaggcccacagagactcctatggtctaggacaaggtctactgcacaggcttcaccttggcagccttctcagggcagggcggatatattccagggggtccagatcaccagttgcagtttcagggcaacagagcaagtcactactgctcctttccctcagtttaaaaaatagcaaaaaatgccactgctatcaggtccccaggtaggggccagccctgcttttcaatgagccttgcatgagcagaccctttacaaacccagctgtagctagaaccgtcttggtggactgcacttacaatccaccctgctagatcaggttcccgcccctgtagatcttgcctcccactacactctcactggcccactaagctctggcttcattttgaatatcccaaacttgtcctctcctttgggatcctgagtttgccaccctctttgtccagaatgtttttgccctagattttcacagactgacttcttgccattcagagctcagcccaaatatcacctgtccaaagagtcctgcctcttcacccagttactttatcccattccctattttgctttcttcgtagttcctatcatgggtttgcataagtaagcatgacttttacctgtcaacttcttgcctgccttccctactagaatataagctctgtgaaagcatggactgtgtcctcttaccaccatgtctccaaggatagtactggcacccaggggatgctcaatagatgaatgaatgaaggctcaatagttacaaagccaacttacagaaaaagagaagccatttaggactgcacaatctattaatactttctagggcacaggtctcctagaccaggggctcccaactcccaggccacaggctggtatcagtccattgcctgttaggaaccaggccacacagtaggaggtaaacagtgggtgagtaagtgaagctctgtctgtatttacaaccactccccatcacttgcattaccgcctgagctctgcctcctgtcagatcagcagcagattctcacaggagtgcaaaccctattgtgaactgcgcacatgagggatctaggctgcacgctccttatgagaatccaaggcctgatgatctgtcactgtcttccatcacccccagatctagctgcaggaaaacaagctcagggctcccactgattctacattataatgagttgtataattatttcattatatattacaatgtaacaataatagaaataaagtgcacaataaatgtaatgcacttgaatcatccccaaaccatccccatccccagtccatggaaaaattgtcttccatgaaactggtccctagtgccaaaaaagttggggaccactgccctagactgtcttaattctcttctgctgtccatttgttttgggggttttttggtttaatcggtgtctccctccagaagtaggaaggagaaacacaaggtaaaagaggagaaactttgccagtggccttaaaagcctttatgaggaaaaagctgaaagtatcttgagaagtttttaatgtttgaagccatttttcttcctatatccattaatgaatggctaatattgttttatttgctttaaaaggactaccaagctctaatcatagggtttatttcttttccagaaagcggatgttggtgctgttaatcaaaagcctttgaatcaaggtcatatgatttctaacagattatttccctcacaacatgtctttgtctcacagcaacaaatcatatcattaaaatcaccaaggcatgtgggctaagtgtttgattagctgtaactttcatttcagaaacggccacctgtggtaaaaagttatgccagtttatgtgagcagatgaaaatgatacacctcatcaatttttaaaattagggtactgacaatatagtcctccatgctgtccttttattgttgaaaacaaaggaaaactgagtatcagtggatcagtaagaaatgagtgttcccttttgtaagtggaatctgaccagctttgtctggaatttgactggttgtatggaaaaggttcctaaataggctggacacgcctgtaatcctagcactttgggaggcctaggtgggtggatctcttgagcccaggagtttaagaccagcctgagcaacaaggtgaaatcccatctctacaaaaaaataccaaaaaaaaaaaagaaacaagaaaagttgctaaataaaaactatgtttatcaagtaaatgaccatcatttcactgctaaagttttaatcatttttttccaattactatgacgaaggcttgccaatttacttgggtactatacatgtaaaataatggctaacatttattgatcacttgctacatgtcaagtactgttctaagttccatattgagaattatagagttcaattttccattttcataaagaagtttaactcagaataaaaatccagattcctcaccatggcccatccagccttcatcttctagcacaccattctctccttgctcactctgctaggccccactgacttgcttttggtatcttaatgacatcaagctccttgcttccttagctccttgcttccttgaccttctcatcctttaggtttcagctcagatgtctacttaaagagattctctggtcaacctgtctattaatgtctgttccaacaaccagttacttcccttatagcacttataatttgtcattctgtttctgacttctacttcttatccatctctccagtagactgtgaattccatgaaaacaaggacggtgtataactatttgctgaataaattgataagtggatggacaggttctgtttccaaatttcattgactcccttctttgcttccctcccaggccaaaaaaaaaaaaatggcttttccaaggcttcacattacaaagactctactcatgattaaggctcactcctttccccaggaagtagagaacagatttctttttattcattcaacaaatatttattgaacctcgatggccaggcacttggtgaacaaagataaataggatacagttcccttgggattagctcaaaataaatggagagagaaagagaaaatctatgtgtctgtgggtgtctgtttttaaacacaaacccacactagttagtgtgtgagaaggggagacatatgagtcgacagccacctacttgagaatccctgttcagaaatagcttccctgcggacttgtccccaatgcctacagttccatcaagagagttaattctgtaggagagggaaggtggatgatgtgatagacaaatgatttgctagcatggtaactcctcagttcagaggcagtgttaatcacaaagcaaaaatgaaaatcttgcacaatcacaaatgggcgcccaggactgtatgttatttgtcaatcctgtgatcttcttggcctgagtacacacgatcttcatgttactgagcttttaccatttggaatatgtaaaccaaatcctaaatgaggttttccatttatcagtcacaacatgcaacatttttcttccttattaagaattaaaagagtttatgagagagaaataaaatctgattttcaagttgtcaaaaaaaatcgtgatataatgcaatcagtttagccaggaaacaaaatggccaatataaactgttgcaggaactcccacagctgtaagcagctgtcgttcctgaaaggcaactccttctttatcatttcttccatctggtttattttttgtgcatgcattctagcatacaaataatccctccccttttttttttttggtccacaggtacaattgtacacatgtacctgtaattttattctattcagtctccttggtagagaaagcaataattttataataaaatgagggctctctagacttaattctctctcttttcccaatatatttgcatcatgagtttcatttgattgcacagccatgaactccatgctggcgaccttcagtggaaggattcggaggcagcaggaggccgacttctccagggggtggggtgaggagaaaacgtagacttattccctttcttatttccacctactttgaaaactttttttttttacatgaaaggggcgaccaataaccatttttgctttaacttgcaaaaagcttagatatgccatttgcatggtgatcattatttatttatatattcattaatgggtaaggaagtaatgctcttctaaagctgagtagagccacgtagccatggtttccaactgcacaagcatcccttaggtgaacagctcttttgaagtggttttgttagcaattaagtgcagttatagccctgacatgaaactaagcatttgtacacctgccatgaatgcttaaaatctgtgccagtgagtgggatctggaagtagaggagcaccctgcagaactgggctacaggatgcttttaaataataacaataataactaaaagctgttagtattgagggcttaccaccagccagccactttcctagtgcctttaatacattatctcatttaatcctcacagcaaccttcgtgggactcattgctgctggaggcctcataaatattctagggctacaatgccctgcaaaaaacccatcagcactggcaaccctgaccctcttctctgtggttagatgggagccagggccaagggacatgcaaggtgaattggggcgagcttgccttctatatgtgctgtttccctttgttcttttcagtttttactcatttcttaattatagaagtaatacctgtttgctatttttatttttatgttttctatgtgtttttgtttttgtttttaagactgagtctcattctgttgaccaggctggagtgcagtggcgcgatctcagctcactgcaacctccaccttccgggttcaagtgattctcatgcctcagcctccccgagtagctgggattacaggtgcccaccaccatggctggctaatttttgtatttttagtagacaacatttcaccatattggccaggctggtcttgaactcctgacctcaagtgatctgccctcctctgcctcccaaggtgttgggattacaggtgtgagccactgcacccggccgtttgctatttttaaaaatcaacaaaagtatatgaaattagaaggaaaatatacctgtctcctcttaattccctgctcccctccccaccaagatcaccactagatccttctagacttaatatgtatatataaacctatatagtttttaaaaaataaacatggatgggatcatcactgcagctcttgcctttcaacttaatctttttgatgtcagaatgtgtattcagtgcaacatgggcctagtagtccatagtatacataaatcacaaatgacttatctggccccttattgataggcattgtaattgtttttgtttttactctaatgcaacaatgctttaataaacattcttgttcttgtatttgtatatgcttgtttaatgtttctataggacagattcctataagtgaaactgctgggccaaagaggaagcacatataaaactgtgatagtgaaattgccttctgggagattgcaccaatttacactcctatcaagagtgattgggaatattcatttctctctaactccactaacactggatgttgtccaaagtttttatttttgcacaactaatcaaggaaaaggtatctttaagaattttgcacttcttaaatctaatgatattgagcttggtttaattttcatattggctatttgtgtatcttctgtgaattattcccctctcctatccccattctctcccctctgcctttcaacacctcttttcgccccaaggatcctagatgtctctccccaaccccctaacagaaggaaataatacagagagcaaggggatggtgaaatgatgaaagaaagcaggtcctggggcaatagggacaaaaagtgttcccagtcaggagtgtttgccttttaaaggagcctgccccaatgggacaacgctcacctccaaagactggattgccaatggcgctgtttcagctccaacaacaggaaaagtattttccgtgggaagtattttccagaaggtcctgggaccttcattataacattgagtcagtgctttttttgtctatcacaatgaggctttcccttgttagtagtcagagtcagctgcttgggactgtatcacaaagccttaagtattcacagttcttcgcattaatctaaggagttaatcggaagtgcagttaaaaacatatgtatgcaatgcttgccatagcattgcttattggatcagaaaactggaaactattttaaatgtccaacaataaagaataggttcataacaatttggtagatgcgtctgatgaaatacaatgaagcagttttaaatgattctggaataagtactcaatgtcactgaaaactattttaattttagattaaaaatatatgcaaagaaaaaaacactgaaaattgatatgtcaaaaccctaataaggaattctatttgggtggcagaaatatgaaaactttttcttttcttttttgaacttctgggcatattttaattttgggagtgaccaaatattataatgatcagaaaaattatcttttttttttttttttttgagatggagtctcactgtgtcatcgcccaggtgcagtctcggctcactgtaacctctgcctcccaggttcaggcaattcttgtgcctcagtctcccgagtagctgggattacaggcgcccgccacaacaactggctaattctttttgtatttttagcagagacagtgtttcaccatgttggccaggctagtctcaaacttctgatctcaagtgatccacccaccttggcctcccaaagtgctgggattacaaagtggggtgagccaccgtgcctggtgaaaacttacctttaaatacagataacagaatgttaaaaagtagtttatggtattattctcacaaattactccttttaaacctggcaatcactgagaaatacagccttgaccttgccaacattcagttctcagtgattcatacttaagggaatccaccaccacacccaccctatgactgggcgcttagagcaggggtggcatccatgcactcccactctgttgacttcccagcatttatacaccacgtcccagttttaggcatcagaggctctttctcccgctccagcccaaggccccattctccttacaccctcctgcttccccagcccctgccctcattcctgatctcacactcattcttacctatttcttccaagcatcttctaagttacatttctctatctcctctttgtttttttcttttttgagttatgaattactgtgttgctctcttcactttaggaagctttatacttagtatacatgtactaatatgtaaattatggttgattacagcatttgtaattatttctataatttattttaaagctgcgcatcaggcctttggtcaggcacttcttacactctgaactactttctgtccagtgtttatttgctaagaaaaatatcaggcctcacagccctgtgtttcatctgtaaagcccttttgttattttccagtggcctcagcggagatttaacatcaagaatggtagtaggaaaaaaaaaatggtgatagaaccttttatctcaacctaagacttatcactttcagagatgcttcctgcactgatacatattattatttcggaagtagtttattgagagtctagtatgtgccagacactgtgcttaaatcctggggaattatgaattgaaagtacacgtttgcatttgcagatgcataaaaacttgcagtctagaaggagaggagacacgtacataattagatgccatgctggtgttaggtgtcccaacagggccagagcaggagggagacagaggccctgaaggagaacgtgatctggggaggtttccagagggacacttgagctaagtctcaaaaaatgtgtatgatggtggttgcataactctgtaaatatactaaaacttattgaattttttatttaaaatgggttaagggtaaaccttgcagtatgtatattagatctcgataaagcagtttttttaaaaggtgtattgaaactgggtcaaacacaccagaaggggaagaacatccccaagagagagaagagcctggcaaacgcatggagatgtgaaccatcgcgacaagtagggggactgccagtcttagagtggctggaatgtagggtagctgtggatggctcaagtgtccaaaaggatttaagcagcaaaatcacagaaacaacttcattttcatgtaatggcccgaatcccagagtctcaatgacattctgggcaccttctggttttttgttttgttttgctttgtttttgactaaaagccctttctctgccaagtctaagatggggaagaaagatgacgagaaggaagaacccatatgcccaaagattagaacaaaaaatacattttctagaaatcattttggtcatctctctgcttctaggcaggtttgttaaactaacccagacagaggaacccattttgtccttaaaggtccctagagaaggagactccaagtgggacaggctttaggctaagaaaaagcattctctgcaggccctttgcaaatccagccacacatggaaagcccctaagagaagcagaatgccctccctgcattctgacctgttcatgccagcctagtgacacgaagcattgatgtgaggcccttgtttcttcagtcacccagcccagaatgcccagaggaggtaaagatcacttacatggcacctggtgatcgggacttccaggacaatggtaatgatagttccatggagcatgtggggaaagattgggaggcagcatctgtgcacatgctggatacctctgaggttcaaactgagggaactccctggacctgagaggtctggggaggtcctgggggtaacacacggaggtgaggggcaggggcctttccagctgcctgatgcccaggacatcctggggctgggaatcatatcccgtgtctatggttggcagatccaggcctgctcggttcctgtgaggctggggccgttgcaccatctcctggctaccgcccaaggagtctgctgaggcattaggtaaactttggtctgatttgtctgagtcatggccagtgtcaggagaagccgctgaaagctgagataccagccattgattacgtttttccataaatgaaaactgatgctctgcagggagggctccaaccacagactcagacgcaggctcgctgactgcagagcacccagaagggaaagctttgcccaggcctgggtgtctcctgcagaaactgtcttcactgtcctccagaacttgagtgcgcaggcaggtgacctgccgggatacaggccgctggtgatttgcaagtttcagggttgagtgagcttgagaaaagtctccggaggaattgtgaagcattgtgggtgcagacaagctgttgggtgccatgttccttatatttggagcaggtggttctgattcctcttccggggaatattctgggattggtttcagcaactgacttgggtatggttctgattcatcaacctccacaggaatgcttcggttcattctagtttctggaacaagagaaaacatgctatagccttagaagacagataaattcttggagtcctcactttatgaccttaagggacctcattcaagatgtggtttaaattaacagtgagacaccaatgtgcttgcaaagccctaatcacataaaattgtttacttatcctccaggcaaaagcactaatgcttattaagatattttatctggaaggcaattcaaagaatgtgattggaccatcctgtggtagaaatcattcaccagcaaggggaaaacacagatgaaaatcaactgccaagtattgaggaaagagaaattatcataatgtgggctgcttcgtgtgtgcttggaatacatgaagaaataaatcttagtaactgatatggaatgatctctaagatatattgagttttttttaaaagccaggcgcagagcagtgtgcatactatgctgctattttgtgtaaaaaacgagaggagaatgtgtgtttctgtgtgcatatctgcttgtatatgtataaaccgtgtggaggatatacagacattgctacactggttgcctttgaggatggaattaagctgggggagaggagtgggaggaagttttcaccttttaaacttttataattttgttccatttgactatttcctaattttaaaaaataaaagtgtttttttttaagcaaagaaagcaagcccaagtttaaaacacattgaaaaaaggtcagagtgacattttctacctaattttaggtcatttggaggacttaattccctctgggcactatgcctgcaacaaaggtagccatgaccatctggtttgtgatgtagttgaaccagcaaggctcgctaaactagaccttagcctgcagagcatttatccaacgggccgggcaatattgcttttagctgtaagaagaactcttaattcacctaacacaatgagaaagaaaaccagtctcctctcatcattaaactgattgagatgatgccttgactgcaggggcaggaagaacgcagtccagaggactgcacaggagcaactgggggtttgcaggaggctgcagagcaggtgtcgtaaaagagcaagcaagtgaaaaagaagaaatcccagagggttattctatgcaaggctagtacacagcatacttcaaataccagagagagaaaagggattatgtctggatttaaaaattcctactttggatccatgtcgcatttcaaccacattcactgagggctcactgtgcctaaagtcagtttacataaattatgttctaaaacaagtttcggagagcatgaattcactttctcttgcaccttgtacccaatccaatgggatcaggacagcatgcattttgaaatgctcccctttcacacagatggggccagcagttttccaccaaatatacttaacagcctacagaaagatacctctccactccctgccaaatgaatgctctttgacagtcttctcccacttggtatcaaacttacccacctgctgcacaacgacccttgctctgttttctgacgcaacagaaaactcaacttctaacttccggctggccttccctcctccctccgtctctccctttccctgtccttgtccttttcaggctgtgtatgtcctctgctcattggctctgcagaaaaggagacctcatcagctaaagtgatcagaccttataaaaatgaacaagagcctacccaaaaaacctgtaaataaatatcgcaactttttattatttaaaaaatgtttggccgggcgcagtggctcgggcctgtaatcccagcactttgggaggctgaggcgggtggatcacctgaggtcaggtattcgagactagcctggctaacatggcaaaaccccctttctactagaagtacaaaaattagctgggcgtggtggcatgtgcctgtaatcccagctactcaggaggctgaggcaggagaatcgcttgaacctgggaggtggaggttgcagtgagctgagattgcgccactgcattccagcctcagcgacaagagcgagactccatctccaaaaaaaaaaaaaatgctcaccattttttccctttctttcttgcaatttttccacagttatgaaattggatgtgccacacaacatgctcttcagccggtcagaaaacgaaaatattttttcaaggcctggctgactgttgtgtcatcgtctacatgcacttgtgggcacacagctgaatgggaggcaaagagatgcaaaaagtgagctgagtggcaggaggactaattcctgtcctctctttattgccatgggatttgctttcaatcctcactcttcaggtacaactatttccattctcactgggttttccagtgtgagtaccttagaagcgcttttctacctaaagaaaaaaaaagttgcaaattctactcttctagctgaggagccatctgggggcttggaggaggctttaaaaaaagtgatgagggcagtcatctcacataaactggaaatctgaggtcatcctctggtgggaattcttcagttaaaactgctctggggctgggcgtggtggctcacacctgtaaccccagcactttgcaggctgaggcaggaggattacttgaccccaagagttcaagaccagccttggcaatataatgagaccctgtctctacaaaaaattaaacaaattagccaggtgcggtggcgtgagcctgtagtcccagctacttgggaggctgaggtgagaggtcacttgagccctggaggtgtccagcctgcagtgagccgagatcgtgccatggcactccagcctgagtgacagagcaagaacctgtctcaaaaaataaaaataattttttaaaaaactggtctggccaggcgcggtggctaatgcctatagtcccaacactttggaaggccaaggtgggtggatcacctgaggtcaggagttcaagactagcctggccaacatggtgaaaccctgtctctactaaaagtacaaaaattagctgggtatggtggcaggcacctgtaaccccggctacttgggagactgaggctgaagaatcgattaagcctgggaggcggaggttgcagtgagctgagatcacaactgttgtaccccagcctgggcaacaggagcgaaactctgtctcaaaagaaaataaaataaactggtctgaaaaggaacacatggcttttgagtatttagtaaataaacctggcatggcaagaaacaacttctaataaaactatggaattaataatctttaaaaaacaaaatggaccctggtgtttcaaacatgtcactatcaaatactcaaaacagcagataattacagaactcaactatgtgtccaactcaatgctgtgtatcccccttctgactatacgcccaactgaaatagttttattactttttaaataaccacaagtgatacaaacttcaagaggtaccaaagggtatgcatgccgggcgccgtgactcacgcctgtaatcccagcactttgggaggccaaggcgggcagatcgcaaagtcaggagttcgagaccagcctggccaacatggtgaaaccccgcctctactaaaaatacaaaaattagccgggcatgatggcaggcacctgtaatcccagctactccagaggctgaggcaggagaattgcttgaacccgggaggcggaggttgcggtgagccgagatcgtgccactgcactccagcctgggtgacacagcgagactctgtctcaaaaaaaaaaaaaaaaaggaggtatgcagtgagagataatcacagtaatttctgaagacacagaaaacattcttcctaccttcaagttgctgtgatccagcctaagagaggaaactaagtaacatgcagaaaacccacgaccggcgtcccagggccttcgtgcttgtcgctccctcttcatggaacacccttcccccacacagctgcatggctggcttcctttctccttcaggtctttccttggctgtcacctcagggaggtctccctggtcgcactccctaaaatgtttacactctcctctcattcccatctcccttccctgctttaccttcttatccagcagttattactgtcttatatattacccaaatgtatatgatatacacaaatatctaataatctcttatttgctcattgcctctcccttctcccagaatataaacttcctaagggtgcaattttctcttttctttttctttgtgatacgggggtcttgctctgtcacccaggctggagagcagtacctagatcatggttcactgcagcctcaaactcctgggctcaagtgatcctcccacctcagtctcccaagtagctaggactacaggcgcacgccatcatgcctaatttttctgttttttctgagacggagtcttgctctgtcacccaggttggagtgcagtggcacaatctcggctcactgcaacctctgcctcccgggttcaagcgattctcatgcctcagcctcccgagtagctgtgattacaggtgtgcgccactgcgtctggctaatttttgtatttttagtagagacagagtttcaccacgttggccagactggtctcaaactcctgacctcaggtgatccgcccgcttcggcctcccaaagtgctgggattacaggtgtgagccactgcgccagtcggtgtgcctgacttttaaaatttttttgtagagatgaggtctcactatgctacccaaactggtattgaactctttacctcaagcagtcctcccacctcagcctcccaaagtgctgggattataagtgagccaccacgcctggcctgggggcatgatttttgactgttctgtttacagctatattctcaacacctagaactgcacctggcacatagtaggtgctcaataaagattcactgaatgaataaatagttgatgcctatttcagagaggggacagacaggtccatgtagccggatcagtgacaatgagaatgttgtcaacaacaatgttgggtagcaaggagtatctggtgggcctggtcctcagagttcttaaaattatgccacgtgggtgacccttccctcttctttttttttcctctccagaacatttattaagtgcccactatgtgtcaagcacccaagttaggtctgggccatgcccaaaggtcctgcccatgggcaggattgaccacaacccttacttgcagaataaaggtgatgccatcagccagtgtaatgggagcatctgctcttagattccaggcagggagttgctggtctttgtgcctctgcagagctccacctagaactgaaaagggtggggcacgcctgccactaccacacaggccccctccagccccagacccctgtctgaactggcagaaagtgggcaaccctgccaactctcctgaggcagtcatagagaacaattacaaatgccacatcagggggccacagacagattaatgggttatgtcaaggatggcagttttatctgttttgtctttaatgtccatagtgtaaaaatactaaacattaaaaagcaatcactcagtatctcaccattgtatttttaaaatacaaagaaaaccattcagcagagggtgagagcatgtaccctgggtaagcacgagtgggcatgaactggggacagaggtgagtcctggggacatataactggatggaacagctgtgcatgtgagcctggttcttgcttgttctgacccgacccatttttctgtttttcctttttttttccaggctttctccatatttacgtgcttgtaactctggcatgacctttgctccagtctctaccagagggcggtgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccaatacagagcccaggccccacacccagggcctctgagtatttttgtttattgtatgtaaaatactagtgtatttttgtttaagtctcacaggtaaacaggttctctcatactttgccaagggaaatgtgatctgtgcaatttggcaataactatcagaattttaaaagcttatgccctttgacctagtaatttcacttctaagaatttcccctgcagagatatgtatatcttgtatgaaatgaagaggctacgaagacaggcaacgccgcagtgtttataatagcgaagaccagacacaacccacatgtctaaaggttctgatttttaaaactgtagtatatctgtacaatgagcactccacatcctttaagaatgaggaagggctgtgtgaactgaaatggaactatctctaagatttattaagttaaaaaaattcaagagtagcacagtgtgtagggtatgccatcatttgtatgatataaggtcgtatatctgccatctcaaatgaggaacagtggttgcctctgggaagggaattggatggctaggaatggggtaggaaagaggtttgcttttcagaacattttatactatttaagttttgtaacaagtgcatctattttgacttaaaagataaaaaatgaaaaggaaaggctccactagtgattctgatgctcacaaagattaagaaccaatgcgaatgaggaactcatgacaccgcccaggagacagtgaacatatctcttcaaatatcaaaaacctttcagcagagggtgagaacatgtgcctggggtaagcatgggtgggcatgagctgggtacagaggtgattcccagggacatacaactaccttgccctcctgggatcaggtcttcctcccaccttagcctcccatattgttgggaccacaggcatgcaccaccacacctggttaattttttttttttttttttttttgtagcgacagagtctcgccatgttgcctaggctggtctcgaactcctgggctcaggcaatccttctgcctcgtccttccaaagtgctgagattacaggcatgagccactgcacccagcctgacagtagcttttaatctctggactctcatcaccgtttggactgtgagctgtggttctagctcttggatctgatgggcatcttccctcaaatatgtcagtttctctctccaggtcccttgctttgtcttcctttttgcctcctcgggcctgatacctttctctgggcttctctactctgccccgagctgcctagttttgcgaataatgtcacatccagatgtcagcagccctgatgtccatgtgacaatgctcccttgctgtccatgtgacaatgctcccttggtgtcccagtgacagattttcccatgcttcaccctctctcttttttaatttttttttctgtacacagctctcagtcaagccccttgagctgcctccaactgtttgctcatgtctgttcccagcaatcttttcctcttttagcacaatcttccttaacttactagttttttgaaacagagcctattagtcttcacagcgctacctttctgatctcagagttcaccaaaaagcttttcctcccatcatgcctgcctccctttcttcaggtccgttagagtccaccgtggcctgtgtgggaagcaagtctctcccagggcacacatgaacagacttcatgcccacatccacagtgaacagtggcttctgccttccagatgggcttaccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaaactttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaaaccagcccatgttttttttttttttctgtcgttgtcattgttttggtttttgtttttttgtttcttcagataagatggtttctctaagcacatgtgtgatccctaattcagccacagccacggagtgaaggagaggaaggggtagaaaggaaaaaccaagagaggaagaggaagggagagaaaggaaggaaggagaacggaagagaagtaaggaaagtggggaaacgctgaaggatttttttgtatttgccttttattggtgtaggagagacacttatttacttgtaatttgtatgtagtgctgggtatgagaaggggcagttggaagagaagggaaagaatgaatataggtgaaaggtaagagtgtcatagggtaagctgggaggccaggaagagtttggacagacagctcagagtaggaagagagttcagagcggggagggagacctgttgactctgggaaggggaaagggaaaaaacactggcatcctgactgcagggaaacaatgaggcagcggagagcaagtatccctcattgctgagggagctgccaagaccccaggcagcctcagtctgtggggtgcggcctgtggggtgcgaggagaggggcacaggctgggagctccggtcagtcctggccctcctaaagggcttgagttcagctgccttatcagggaaccaagccaaaccagcacagacctaaggatcaccccatggatggaagcccacccttcttcagccagtctacaactcctggtatccgggaaggtctgtgcacacacaaggtgtgcacacacacacacacacacacacacacaaggcgtgcacacacagctacagagtgagctgagtagtcacagccaagcacatgtgtgcttctaggaggcctgctgggcacgggaggcaaagaccataagtgggagaaaggacagcctgagtttcatgaactaaaaatatcttggtgacaacgcattgggaagaaacaggagaggcccggggggcagcttcttgattccagtcctcagacactttctcatggaaaaatccttcagactgcaggattgttttgataaggaaatgtgatcaaacattaggggtcatttcattggatctgaaaggaatttaaagttgaatatgcctcatctgtgttcactcttttttttctgcagcagttgcctgcaattcatatatgtttttagaagctaatttaaaattgcctgcagaagaaaaatgatttgaattcaggatattcctgagatttccattctacaacgtgtaaaacaaagatttcatttagacaaactaccccaccataatctttctgaatgcctgttgaagaatgcctgcagatatgactgtcttctcctcttctttttcttttcagagcatttgaaagtcactaactccttaatcccaggagaagcaggctttaacatttcctgtctctacaccttccaaaaatgagtaaccctgagttaagaacctttctatccgacatgttggtacattactcagacctcacttctgtttaacccaccccatgcaaggaacagagcagagtaactacattatccatcttttgatgctccatcatggagtgactggtagctgcagcagcagattaagaatgactgtggtgtgtggcctttaaggattagagcgaggctggcaagtgcacaacagttagcctgctttcagataatggtgcatcgttgtttgaaaataaaatcaggaactcattgcaggtgaaatatcttgaaattcctgtcctttcatcccaggggaatagagagaaatgcctaaaaacatgacacggactacaccaggacatcccacagaaaccaaaagtcctgcaccagcccatcccagtcagctagggcctgtttgaactgtattgatggcaagtaattgccaaaaagaaacaatgacaatttttttttaagtcacggtctggaaaaagttaaggattctgtgtatccgccatctaataatgtctctaatcacagtcatcacccttacatggtattaggatgtgtttcatagtttcccttcccctcccattaaaggccccacacacagtgactggtccagctgaggagtggtttccaggtccagctacagcagtaactctggcttctggagctgggcttgtctgccagttctctggcctgccttgactctgtggacaatagcacagactatccttcctgggtaacccaaatgggacatgaactaattcgagaaactccctgttttctcctatttggctagagccagtaataaggcctcaattccaggcagccctcccgcagagacacgtgtctcccagcctttcgccctgactgctgctttacctcttgccttgagagcagacgagtgaaacagaaatcaaagcagttgacatggaaggggggtgagcacctactaggcatttggtagcatgctggattctgggaggtagaaaaatatcaggaaacaaagtcctttcctcaagggggtaaccaactggtagtgggaggtaaaattaaaatatgtgaataatcggtaaacaaaacaagtcttgaagaccacccattaccactacccctctgggactatcctggctttgttttataagggaatttgacacactcatgttagatcaccaccccccatcaatttactgatgaagaaatccaggcttagtggagtcagagtgaattgcctaagtcatggaaccacaagaagtgaagaacttgaaaccaagtttcttgtccttttaaaaaatttggcctcttgttctcctgttcctttaaaaaaaaaaaaatccccctattctaagataccatcttgaacttgaaagtcacaagaagcttgattagcttctaagatcaagttctggcatttctcccccttgttcccaaaggctccgtccagcgccaggctgggagggctggagggcggctgcggagaggggccgggaggcggctcacagccagcacagagctcagcagaacttcctggcccaaaaatgtgctgttgatttttttcccccctgcacgaaacaaggattgagaaaactgccactgacgtgttctggggctgaaagccaattacttaatctttgccatccctggctctctctttggagaagtggggcttgaattcttgagagaaacttgtggggacactaagtacccaaacgaatggttcccaggcagctccgagctgtccccgtgtgcgagcctcctctcctcaaagggttaacccggcggggctcgctggcctgaaatactatactagcaacacatccttgcagcacaaacttcactgtcattttctcagctaagatggtctctgtgcgaacaagttaaaggaggggagacgaacacagaggaaagtagaggcagaatgtttcagtaaaggagaaacagcgtgctttgggaaataggtcagaggtgaagaaataagaccaggcaagtggcaactccgaataacttaccttagatccaccacggacagacagactgggcccggagggtagtcggctctcggcggcttctcgtctccctccaccttctccgggcccaggtaagtagaagaacaggctctgaagcaggaagtggaagctgtatgcaaatttctacggagcctaggaagcctctgctcaaaatctccctgtgggcagtgaatcaacggctgaggagtcactttatttcttaaaacagaaacctccttcattcatgagaaagggccagtgaccaattaggcggcatttttgttttcgccacccagctaagaagctgcccaggagtgggcagaacctcagtgtagtcgcagtgccctcgcctgggagggtgtctccgggaggagattgaactcgaatgttaagaattagtaatcattagcagctccaaaggaggggattgtgggcagataatggggaagaagagggagtcgagcttcttccacctcctctaactgcttaaaacatcagcatt

SEQ ID NO: 2836 - DNA, 11983 bp, Homo sapiens
  source 1..11983: mol_type = genomic DNA
ttctgtctttaaagaggtgatttatttaacaggaaacaaagaaaaaggtatcaacagtaataatttttctgagcactgagctgagaaatagctagtctaatactttgattgtagccatgtactgagacctctttgaacaatctagaagttaaaatagatttgaaaccagtcactaaaatttaaaattacatttaaaattctaaattagtcatcaaatattaggtaagaacctaaccttgcattccacaaacccacccctcaaatcggtgtaagtctgaataaagcctttgggctaagaggttatttttactaagtcagccctaccccacttccaccccaaaaatatctaaagatgaatgcctgaggaccagcataacatctaaatcaaccgagtgttaatcttattgtcagtgctctcaaatagttgttacaattcctttgatgggccgggcgtggtggctcatgcctgtaatcccagcaatttgggaggccgaggcggatggatcacgaggtcaggagatcaagaccatcctggctaacacggtgaaaccccgtctctactaaaaatacaaaaaattagccgggcatggtggcaggtgcctgtagtcacagctactcgagaggctgaggcaggagaatcgcttgaacccgggaggtggaggttgcagtgagctgtgattgcaccactgcactctagcctgggtgacagagcgagactacgtctcaaaaaaaaaaaaaaaaaaatgctttgatgttggtggtcatcggatctcatagaaatttcaggggccaagcttttgtcacttggccaagtgcgtgtgtgtgtgtatgtgtgcgtgtgtgtgtgtgtgtctgtgtgtactttttggtttgtttttttgctaccagtgctaccagctgtaacactttaatgactctttgtggaacaccagggaccactgctcatcaaccacctggggtaagaagagtggaaggaatgagtggttcagagcttaggacaggtctctgaagggaggaagggttaataacatcacattgctaagtctttgcaaactagaaacatttcagagtaattgctgatgtcattttatttacaaacgggtgtcgaatccttaatgatggtgtcacctcagactaaaaaagataatgaaaaaagagaaagaagacttgaagtttgtgtttgggtgttttccaggttatccaaatatgaaagtcagttctaccaggtctcaaaactacggaactaatgttacatgtcagaaagtcttacaaatgagtacttatgttatgctagtttttcttctcttttcctattttttaaagaacaaagacattcgtctcacccagtagacatctaagttataaagtaaatgaaactagtgttctttgcaatgcattagcaatgtttcttatttatagttgacaagtatttgtcctttccctgtgctacatataagagctggactgggctgggcgtggtggctcccatctgtaatcctagcactttgggaggccaaggcaggtgaatcacttgagcccaggaattcgagactagcctggacaacatggcaaaaccctgtctctacaaaaaatacaaaaattaaccaagcatgttggtgcacacctatagtccctgctacttgggaggctgaagtgtaagggtcacctgagcccggcaaggtcaaagctgcagtgagctgagactgtgtcactgtactgcagcctgggaaagagtgagaccctgtctcaaaaaaaagaaaaaaaaaacaaaacggtggactgtcttgtagcacaagtgagccttgtttaagaggctagtagataaagaagggaagcagtagcttgcagccccaaaaagtcttcattgtcttagtagcttgggccataattaaagccatcccacctttatagtttacgtagatttgatacatgtatacatattttatatatggatatgtgtatgtgttctttttctggagaccaggtaaacaagatatatagatacagatagatatccaaaattatcaacctgagggtattgttgaagtttttttttttttttttttttttgagacggagtctcactctattgcccaggctggagtgcagtggcgcaatctcggctcactgcaagctccgcctcccgggttgacaccattttcctgcctcagcctccccagtagctgggactacaggcgcctgccaccacgcccggctattttttttgtatttttagtagagatggagtttcaccgtgttagccaggatggtcttgatctcctgacctcatgatccgcctgcctcagcctcccaaagtgctgggattacaggcgtgagaagatattttttaaaagaggaaaatgttggctgggtgtggtggctcacacctgtaatcccagcactttgggaggccgaggtgggcggatcacaaggtcaggagttcgagaccagtctggccaatatgaaaccctgtctctactaaaaatacaaaaattagctgggcatggtggcaggcgcctataggtctagctacttgggaggttgaggcagaagaatcacttgaacccaggaggcgcaggttgcagtgagccaagattgcagcactgcactccagcctggacgacagagcgagactctgtctcaaacaaaaaaaaagaagaagaaaatgtctctgttaagaaaatgtaaatttgtcctctgagagacataattatgaaaatgaaaactcagtcactcctcaaaagagtatttagaatttaggtcctagacttcaaatcttttagagtgattagagatgcttttgtccatgtcattttataaatgagtccctggaatctaagaaaagttaaaggacttgctaaaggtcatacagctaattggtggtagaaccaaaattagaacacagactacaattctagcctacatcccccaacacttcatacacatatgcaaatatttttacctatgtagtcagatcctgagaaccataatcatactatttagaatcatggctgtatgctatataaagttgttttgttaaaaatgggtgtttttatttgtttgtttgttttttgagacggagtctcgctctgtctcccaagctagagtgcagtgacatgatctcggctcactgcaacctctgcctcccgggttcaagtgattctcctgcctcagcctcccgagtagctgggattacaggtgcacaccaccatgcccggctaacttttttgtaattttagcagagatggggtttcaccatgttggccaggctggtctcaaactcctgacctcaaatgatctgcctgccttagcttcccaaagtgctgggattacaggtgtgagtcactgcgcccagcctaaaaatctttattgcaagaataaagcttccatgattatggttaaaaagggttgtttaactagctggctttaatccattaatacagagtggtctgttatatttatctaatattatatctaagcagctttgttgatgtccctggaagcaactgcccatatcattataaattatatgtatctcctttgagataagtaaaacataatcttacaaaagagtaaacattttattatttgtacatgaatcagtttggtctgaggatacacaagcatctggctaactcataaaagtagcctgaagtgattgataggagagtgtttgtagtcatttccatttgctgccacatcccttacattatctacttgctaagcactgagaggcccagaatggacacatcaaactgtcaggaggaacatatgggacactggcacctgcaatggtttttttaaaagcagagaatgcagagcagtcacagactccacttcaaagccagggtgtgtggaggtctccggggaagagctctgcacaacaggtttcctgggggccagagggcctctcggggaggaacagaaaaaaaccagccaggagtgctaccgaccagcctcagccagaatgctgtcagaacaaggccccaaacatggcctggcctcagtgatctggggatgaacggtgtcacaagggaaccacctgaagggtgggcagaggcccccgtggaggagccacatactcttcctctctcagcagccgcagcaggatgttttttttattcttgggccagctgtagacatgagtgttctgaagccaggtgggcacatgctcctatgggaggcagaatgacaggagcaaaggtcattagagaaaaacctggatgccagatcccaggctcagttcccaaacatttctggctttccctacatgggcgtttcctaccaaactatcctgggagttgtgctgttttgcttttggaaaggtttagcatgtgaaatgttcttggcttcgggtacaagctgtatatctcattataaaaaccacatgtgcacagcattttctgtcagtctcccagactacctaccctttgcatttcaacttgcttttcaccaccctcacataaaaggggtaggacagaggtcacacagagtgatgtgaattcccctgtgacttcagaagaagtatgccagggccgtaggcttaaatcaattcattactctttcactccagccccaggtctggcctgcagtagaaggagcccatcagacctcagtgatcaggcagaggcagaaactgttagccagggatcctgggggtgcagtgtcagactgccctcatggagtggatgttctggtggggagaggcagataataagtaaatggatagtgtgttcaacagtgatgtatgctgtggagaagaattaaacaagaaaggggacagggagtgctggggcaagggtgaaagatttgcagttttaaacggggtgcttaggagaggtctcactgagaaaatgagcaaagacctaaaagagtggaagaagcaagctctgtggttgtctgggtccaggcagataggagagtcagtgcgaaggccctgtggagggagtgtgttgggtctgttcacaagcaacaaggccactgtgagtagagcagagtgagtaggtgcagaggtctggaagtagaaggggctgtatcggatagtgccctgtaggccaccataaggcctttgcttttgagtctaactcctagggactataggacgggacttctctaggtattgtgcttagaagcagcacctgctgcatggcaggcatcatactgagtactgaggatgcccaaatgaaaaggacgcagggactgccttgaggacttcaaatcttaggatgaaagcaaaatgtcaacaaatgattttctagtcaatggtgtaccaaggggacaggtggtgagagcggcctgtgctgggctcaggtaatacgggcattgtctgaaggagatttaaaaataataacaaaaccaatgaaaatttggtctattttgtatatcgccatgctccaataattctcaacaattattcccagtaccctcaacccaaacacataccattgacccaaggtgctagaattaagcacccttaagaaagggacaatgaaatatatcagcatgaaggtaaagaggtgtcagggcagggcgcagtggctcacgcctgtaatcccagcactggggaggctgaggagagtggattacctgaggtcaggagttcaagaccagcctggccaacatggtgaaaccctgtctctactaaacatacaaaaattagctgggcgtggtggcgagcacctataaccccagctacttgggaggctgaggcaggagaattgcttgaacctgggaggtggaggttgcagtgagctgagattgcaccactgcactccagcctgggcaacagagcaagaccctgtctcaaaaaaaaaaaacactttgggaggcccaggcaggtggatcacgaggtcaagagaacaagaccatcctggccaacatggtgaaaccccatctccactaaaaatacaaaaattagctgggcatagtagcacatgcctgtagtcccagatagtcgggaggctgaggcaggagaatcgcttgaaccctggaggcagaggttgcagtgagccgagatcacaccactacactccagcctgatgacagagcaagactccgtctcaaaacaaacaaccaaaagaggtgtcggggaggctagagagattgggtgatataagggtaagtaagagttcactaggcaggcaagttagggaagggcattgcaagcagacggaacagaaaaggcaaaggcacagagacaaaagaacacagcatgtgtgagggcatgctgaaatggtccagggtgaccagagcacacagcatctacagagggtgatgagagaaaactacgcaaggggacacagtcctcttctgagaggcctcatagatcgtgctaagaaaggtggatatgatcttgtagtcaatgggaaaacggcacaaaatttgtaagctaccaagaaacagatcagacctacattttggatgttcctctttgatggcagaggagaggatggctagcacaaggtcaaagtggagatgagaccagtaaggagactcatcagtaagtgacagcagtgagaccctgggcaaaggcagcgcagggaggatagaaaggtgtgccatcgcacaggctgtgcaccatacagcctgaggtgtcccgttcccataaactggagcctccctcatccagggcaggggtctcagtgcagtcttgacatctgaggatccctccagggtgaaacagggcctgagtttagggtgctgtggtctgattctcaacatgtttactccaccactgccttccctttgccaagcatggaatgtggcctcaggtggttttgcccccattctccaaacttgctggcagacccttctggtgtgaaaagcctcatatgaatcacggcaaagttcactcaggtaactatagatttaattcctgtaatcattagctttgagagctgaactatgtgcaatgaaatgcctccctggaacagccagcaaaaaccatacacatcttgacttttatgtacaagagataagaagtatgacatgaaccttctctttttctttcttgagttaaaacagaaactacatctttgtgtgcaacggttctttgaacaattaggacagcagtgatcctatcagatagctttaaaaccctcctgattcatactgctgaactgagtggtacaacttgttgatctttctggtaacattgttatctctaaggattgataaagaattgatggcagacatggtggttcatatctgtaatcccagcactttgggaggctgaggcaggcagatcacctgaggtcaggagttcaagaccagcctggccaacatggtgaaaccccatctctactaaaaataaaaaaaattagccaggcttggtggcagggacctgtaatcccagctacttgggaagctgaagcaggagaatcacttgaacccaggaggcagaggttgcagtgagccaaggtcacgccattgcactccaggctgggcaacacagcgagactccatctcaaaaaaaaaaaaaaagaaaagaaagaaaaaaagaatggacaaggttttccatttaaaatcccagatggcaaagcaaaccaaagattgaattatgaggattttgtttctttgtttgtttaccttcttagcatttgggaagagcacagggatgaatctgaaattcatgcttccttgttttatgaactcaatctgcatctgaaaccaaacaaatgtgaaggtttaatttcaggaatgaggatgaggagttaatggtacccataatcatgcacgtccacatggcatttttattctgatttccatacttgagtgccacacacttaacattttaaggcctccccattacacatctattccattcactcatcagtcgtttattggaggcctgttagaagtcacattctatgtcagactttgggttttaaggattaggataccttccagggtatgctggaactggcttgcagcagctcacaaaagcttgttgtgtgcatctcttcctaattctgtgttcagtgacttcacactgatagcttgaaattggcgatggtattggagagtatttataccatggaaataggtaagtgctacaaatcaggagagccagcttagcagaacaccacagatacagtccctatcttcacaaagccagcagtctagtgagcaggcagaaagggaaattaccaaccagagtgccgggtgaaaagtattaacaattgctctagaagcccagaatgggggccatccattctacatcagagattggaaggacagttacaaaagagggttcatttgggcactgaaagaaaagattttggtcaagtagggaaaacagaggcagaggcaacagcatgagcaaatgtctggaggtgtgaaagtgtgttgatgtggttgggaccagctactaatgcactgtgactagagcacaagatgggcttggcagagaggggatgtcaattgcgaagagctccatctgccaggctttaggttcctcacaccagttccaatatgctctgacactgtggtagcccaagaagatttagctaccaagaactctctcaaaaatcagaattttcaataggaggggagttagagtcttccaaatcctgtgaccagcacaaagctttcagtcatctgatgagaaggagacgaggaattatgtgtttccaaccatttcatcttccaattcatttttataactgagaagttttcattgtgcatggaaataacagaacagagaagaaagtgacagtggtgatagctggttattgaaatcaccatagaaacccctcataaacacacactctcacatagttgcatacgcacacacacacacacacgatcacacaacacacacaaatcctccacaaggtgttttttcggaaccacctctctctaaaaaccataagataacaccaagaacatattttaaaatgacccaagtactgtgcagctagaagcacccaccacaccagcaccgagtacacatgaaaggaaggggatggggtgcataagttacaagtgaagcactgagttttgtttgacttctaggactccgtatactgtgaagtttggcttgtgcactaggctgcccagcctgtggaggggccagccagcagcagtgcatttttattttctctcacccttccagaaactgagtttctgtaaactaattcactgtatgatgcagttactcatcagtacctctgcactacctctgtcatggccaagttcttgttgttccagggttttctgttgcctagaggggtgcaggaagtcagccaggcagtcaggaaggcacttctgtgtctgacctcttcgaccccttctatgatgagtaagggcccaagacattgtggcccaagaaaccaagtttggcgacagtttggttccagttggtacagtcagacaagctctgaggccaagctgtgtattactgcctggctacaccacacacccacagagctagacaggtttccttaggaactggctgaggcctcgagcccttcccacgcaccagctgtcagcttctgggactggcaggttcctagagatgcagacaggacattgggtgctctgaggccatgcagacatgcatcagacaaccaagggccggcagcaccccgagccagccatgaccttttcaggcagtttactcccaggaatgatacctttccggggcactgtacaagggctgtgagactggttgagaccagaagaggagggagccttatctcctgactccctggcctcactttttaacctcatcaccttgcctcggctcttccttcagtttggttgtgagctcacgtgagtggtctgcacttggtggaaagggagacagagaccatgaagactcagatggggaatacccaccctcctactttcccacgctgctgacccacaggacagacctgggacctacatctgcttcccctgaggtaaagctgtgtgccccgagacagcctgactgtgccctccccatcttcccatcttagtgacactctatgcccattccaggtgccttccccctcatgaagtgttagagctgaaatggagcttatcagttctagtccagtgattttccaagcctttttaaatctcagaatccttggtcaacaaacaagcctgagaagtacagaccagctctggctgaggtaggggtgggaggcgcagacccagcccctcctccagcacatatgggcacccactgggaactccacaggacagcctgaaagtcacaagtgtagcaccgcctcctagtcaagcagaaactgtctcacagcgtctctataatcacggggagaaggaggattcgtagcccataaaacagccagttccaacgctgggtgattgtttcggtcagaatgttctagttttatcccatgctggacaagtttaatatcctaaatgtctcccacttatttgaatataaccaggccccatagttccccacctgtcatgagctaagaacactcccttcccttgtttgagcatctgatatgcaccagatattttgaaaacattatttcatttcatcttcacgacaatcctgtaagtattagtgacccattttgtgaatagggacattgaggcacaaagagtttaagcagtggggccacggtcacacagcctgtacatgaggaagccaactttaaccaggcccacatgatgcaacagcaggtgtccctttcactacgccacctgcctttctgaaaaggtagggcacagaacatgatacagctgcaggggccagccctcctcaccaccccgtctcctgcctcctaggacttcatagttgctggtaaacagccaagccagcagagcacgtctttccagaatcttggatcctagagatgacagattgctctccccttgcaactgataggaacaactgagtcccagaggtgcagggacttgcccacagtccctaaggtagatggagccagaaccaacagctcctctcctgacatggcaagcctggagctcttcacccagcatcatgctgccttcagctggtctctggggaagaatgggacttccctggacaaggtatccatccccaggggacagtgaggtgttgtgatcccctccccactcaccattcgatgaatgtacttagtatgtaagccatgctcatcctcgtccagctgcgactcagcgccttccacgtcctgtttgtatttggggctgattgctacgattatcatcacggtcttctgttaatgagagggagaaaggcatgtttatggaagtgtaccagcaggactgtgggcattctctgacacacggggtggagggccaggctcattctccatagaaagagaagcactggcccccactcaggcagactcttatctctgcttctcccttctgtctccagcccagccccaccttgaacatgcagagcaaatggctcagagaggggctctctcaaatagatgtgcttttgcctaccattttccacaaccatcactaataaacctctaatgaaagcccgaatcactgagtgagtctgtgtcgtggcaaaaaggcactgcaacaccaacagtaagaagcaccctccctccctccagctggttctgagctgccagtcactgcactcgactgccctgtcttctgcgtgtacacattagcacagtcagtaggaacagacccttcagcacaaagcaaacatcaggctgcagacaaaaggaaaagtgcaacaccccagcctgctgagactcccgtcccccactggctccctccaaaagaagcagccgacacggacacgctggcagcaatcaatttcgatcttgttaaagcacaacgtgtcccagtggccggtatagattctgtcagtggagaacaaatcacggggctgcacgtgggcacctcgggggtggtgtgctgtgcagcctgcgaggctgcctaggaaacctcttcagcccaattctacaaaacacttggggtggcctcagattaaattgaattctgctgctctctccccactctccgccttcatttccttctttcctat

SEQ ID NO: 2837 - DNA, 50897 bp, Homo sapiens; identical to SEQ ID NO: 2835
  source 1..50897: mol_type = genomic DNA

SEQ ID NO: 2838 - DNA, 50897 bp, Homo sapiens; identical to SEQ ID NO: 2835
  source 1..50897: mol_type = genomic DNA

SEQ ID NO: 2839 - DNA, 26140 bp, Homo sapiens
  source 1..26140: mol_type = genomic DNA
tatacttatgattagttttattataaaggatacaaatcagctccacaagccaaggaagacacagggaaaggtctggaagggtcttgagcacagtgctcccatgccccctcttcgtggaattagggcacactgccctgccggcatagccacagcttcaccacccaggaagctatgctgagctttagtgtccagagtttttattagggtttcatgatgtactgattaaagcactggccagatgattaaactcagcctccagtcccccgccccataggtcaggctgactcaaagcctcaaacctctaatcacatggtcagtctgtctggtgaccagccccagctctgagtcatcccaccttttagcataagctcaggtgtgatcccatggcctcacaaataacaaagacactcctattaccctggaaatgtcaaggactgaaagtctccctcccaggaagcagggacaaaggccagttcaattctttagacaacctccaatccacacctcctggaactcctaccccaattgaaacaaggataaaatccactgaacatggagggcccattgctggcctgaactatttttgtttcttttttttttttaaagctttttattatagacattttcaaacatatacaacagtaaaatgaataatataatgaaccctcacacctccatccctagtaactgattatccgtgtgtggcttactctttgatcgatactctcctgctttcccctagcccccacagttagactgtcccgcagcaaagcccagacagacatcctatcggtctgagaattccttatcaaaagcttcccgaagaggaactctatatagggcaggactaagtgtgctggctataggtctgcagaaatctcaacccttgggagcccttgggtggggcctgggcaggtccctgggcagtagccgtctgtagtgggcggctcatctgctgacaacagtatgacgaacaaatagcattttgtacccgcactacaatgcaggagaacgccaaacaccgctttattgcattcaaaccttctaaggcacgtcagccagccctggccttgtctacagccatgattatctccttaaagagttaactctaaaaaaatattaagctcaagaaataacagctcaaatactcctaactaattaaaatcaatagtgagaggcagaatacggtaaaagataacatattagtattattgatcacagatcaatttcagagtacttaaaacaggaataatcagctaccacatcttgaaaaatacaaagacttgatcctaaccttttatttatcatgccacacggactgagacagtccccagtacctgggtctaggagagttattttatgtttgtgtttctgggaatttccgatacttcccagtgtatcagagtgttcccctcacacatgctagcaggcatctccccactaatggaatagcaagagtggtgaacagagcgatcctctactttctcatcatattctgcaaaatgagaagtcagatggatacaaaggttcctccaactctaggactccagggttgtgtggcggccctgcaaggctaggttatgtaaggtctcaccattgcaaacagaatggttcaagacagcaaggatgcactcctcaatttacaactccaaagcaccttgcacagagcttggctttggttacctacttgactctcttttaaacagagggtcttatgcttccctatcctgagctgcacatttgccagggaagtggcctcactgttgccctcatttctgcagaagagagccagagcaggagccatggatttatctctggcattctactcctccaagcccagctgtttcccaagtattaattggtttcagacaaggctttcgtttcagaaaatcaatgaagatgcttttgatcatcttcaaaagcagagaagaatcaccaaagaacttttcttccaagtagtaaaggaataaaacttctaaggaccacatatcacctattgcagggatgtctttcctacaaagattattgctctcccgaggaactgaaaatccttgttaggagatgacaccgatcaggtatgtacctgcatgtcaggtgtgtagctgtcaggaatatcaagtgttctgagcctgcctagagtgccctagagttccagcacgaggcctgagatgcattacattctcaaatatccatatgaaaaggtctggggtctctagttccccaatggtgacttcttttcatattataggaagcctgacaggagctctcctctaagcaaagcccagagttggactcatttcactataagaggctaaattcctcatactcacatcctgacaacattaggctataaggagcttggggaaaatccagccatccattcactcccgccccttagtggactgggttattttcaccacacagaaacactgcagggaaaatagccacttgtgtgaccctctttagctctttccctccctccctgatcaatgtgagcttatataattggcttaaatgaggaagtcagtagaaggggctagggccagccccaggctctgactcacgcaagggccagtgctgggtctgcagcctgtggccagggatgaacaggaatgttcctgttccccatgaggtttgctaaaagacccctttggtggtaggttgacaccccagcaagtggcctagcatggtccgaggcagccgcatagcctgtctgcatgatagcaggcttcagggatccagcttagctggaggcttgactgtgctagcctcggtggtacctgcactgtcattccatatgtcacaatccagggaagagaggctatcaccgagaagagttgtcagtaagaaggcaggacactctaacacgagcaaacccaccaggcttctgttgatccagggcagcatccccctcgcctggcagagttccttgccccacagccaaggctatgggaagcaaggcctccagcaaagctcatggctgccaccaaagcatctctgccaagatgcttcttatgatacttaggaaggatttccacccaaactggatcagggtcaccatgaccctgaatcacaaatccaacacaggctgattccaatcatggtttgaagctttagctgaaaagtttgctgtttgaaaaccatcaatgtgggggcgatgggtgtgcagggtaggaagggaacgcactattttccagtggaggaagagggtatgcctctttaggaaactgttctgggtagagactgctgtgggtgtttcctcaagcacagataataaccaggagatcaagccccaacatgcgggtaatggagtttatgtaacattgaaactcaatgactttggaactttaaaaacatctatagtaagaattcaaaacaccaagatctgaaggctaccccagagagcaaaggggcagccttcagatccaagtggcccaagacagaacctacagtagctatggattttctctaagaggaatcgggcactcatgacttcacttcccagagctctgcccagctgcccagcagcctggagatttccagaacaatggggagtaggtcaccctgccctgataggcaccagggggtggaaacgcctcctcgcccacaacacaatcactctcacccctttcctggctaaatcccacctcccaccctcccgccagctcccctcccatgctcccaatccttgggacctcttggggaattatccaaggagagttctgcctgctgtattttcactagggtcttgggacttctgcaggcagtcagcccaagtgcctacagcctgcctacttgggggagcagatggagagtgtggcaccagcagaaaatacccagaaagccgggtacaaagcctcagtaaagtccaccctgaacttatacatcaggtggaccttgtcggcaacagcgaagaagatgacaaagccgtggtcacagttgagaagcacgcccacccgcgtggccttggtggagggcagggttttctccacgttattgtgccaggcagagatcttggtgttgaaccactccacgcaccaggaggcgctgttgcggccgagcctgctttctgggccctgccggttcatgcttccgtagcagatgcctaccccacagaagttgttcttctgcagctccacctcccagtagtggatccccttcttgtagcagtgcaggcccagcacctgagagcagtatgtgaacctctggggatgcggccggtagttctgaggcatctcagccacagaagctactgtatagcactctgacagagccactttgttgtgggcggtgttgtagtccaggatgactttaatgtaatctgagaaaacatcaccccaaggaattaattacaaggggcccaaagtgctcttttagacctttgccaaagtggtactatttattcactagttttatccatccatgcacccatctacccattggtccatccatccactcatctatccatctgtctgtctattcatccatctatctgtctatccatgtatccatcaatccatccatgtatccatccatccatctatccatctacccatgtatccatatacccatctatctacctatctatccattcttccattcatccatctatccacttatctatccatccttctgcctttccatttatccattcattcattcattaatctatccacttatctatccatctgtccatttatccatccacccatctatccacccatccattattcatcagctcatctatccatccattcatccatccattctgtccagccagccagccatctatcatctatcagtcatccgtatgtctgtccattcatccatccaaaaccatttaccaggcacctgactgacaccagattctggcacaagatgcacaaccatgaaccagagagacaaggtgccgggcctcatggagttcacactccaacaagcaaggcaagtccatcagtaacaacaccatgagactcacactctgccaaaagggtaagcacacactgtagggacacagagacaaggcaactgatgctacagttggggaacatttcactggcaggctggaattggagccaagtaacagaagatgagaactagacagaggagaacagagagagaaaagctgttccagacagagggaacagtgagagtgaagccacggagtgccaaggggattcgcatgtgctgggatcggggaagctgggtggctgggaacacagatgcagcaggagaagggaaacatgttggggctagaaagggaagggcttaggaggctagactttaactggtgggcagcagggagccaagcgaggcactcatttgctaggtggctcagggcatgacacttttcactggagcccgagtttcccccaaggcaaaatgaataagctgggggtggaaaaggccctaagttgatagaattttactttccctgtttatgcggctgccacagagtgcacagcagctcctgaaagacgtggctcagcaccgccgctagcagcttgggcaagagttagctgcagcccagggctggtctgggcctctcttggggggcagggacagcggagggctacaagaaggccagccctgaaaaagcaagggacccacagatccccaccaagcctgctgcagctgcttatgataaaggaagggctatatttttcagtgattggctttggcctccacatggaagtgggtaccactggcaggtgctgcctggagtgttgcacgtgggtgcagaagaaacaagaagacggaaagtgggagggccctaggcctggccttgacaacggaactccacccacttccaggttggacgagcttgcaaaggaggggtggatggaaacccaggggggtatagcagctcaagcggcaaggggagagagtgtcagaaggaggaggaatgccactgacaggtgaagctaaataaaagctgaaaggcgtccctggattttgtgacacggagtaccctgatgacctcagagctgcctgggtcaagggcaggacagaggtcagaatgcagtggcacgaggattagacttcaggctcccacctcggccccacattgcaaccctgggcagccaaacaccaacattctgaatgaaccagtctgggggacagcctgggcatcggggattttaaaaagctccccaggattccaacacgcagccacagttgagagccaccaatgtagaaaatctgcagagctgcttttccccaactgtcctcaaaaggatcatggaggaaatgagctaaacatacagctttccgtgcttgcctgagtctgatcttgtagggctagaacagggcccaggaatttggtttttggggttttttgtttgtttgtttgttttttaagacagagtctcgctctgttgcccagactggagtgcagtggcacaatctcggctcactgcaacctccacctcccaagttcaagtgattctcgtgcctcagcctcccaagtagctgggattataggcatgtgccaccacgcccggctaattttttgtatttttagtagagatggggttttgccatgttggccaggctggtcttgaactcctgacctcaggtgatccacctgcctcgggctcccaaagtgctgggattacaggcatgagccaccgcacccagctagtaatttgtatttttaacaagcattcgggtgaaagggaggcaggaaacagagctgcagctgagacagttttgctaggtttgtttttgtgatttggagagatgtaaacgtgctacagataggcaagcctaggtagagatgctgagggtgaagagatgggaatggaaaggcctaagagagagcagaagattccagagagcgtgtggggagcagactccagagcccagggccagggggtcttgggaaaggggccaggaggcgaggaagggggcacagtagatgcagatgcgatgtcaataacagagcagggggagccccttctacagtgtctgtctttttcgtgaagcagaaggtgggcgggacagggagaaggatggagctatggccagtgggaagtcttgggaatggtggctctggagagtggtggggaggagacaggagatgcagggcaggcatgccggcaacgggacgcccggtgaaggccggtgaccgcaatcgccctgccttctctgcagaggacatgcaggcgccgacccacagagaaaggtgagctcaattgggccagactagacggcaagagggagagtcaaaggaccgattgtgaaatctgagctagttaggaaaagtaaagaaaggcactgatgactgggagaaaataagggagcaacaaagtagaggacaagtgaaggggagtggctgatatagccggccagctggcctcacagagagctgcacagagcggcgcaggagagacagaaccagtggaaccgcgcaccagccccgaagctactcacactccaggagctcaggtctggacttggccaggaaggtctccagcaccttggccttgagagatgttgagttcggatgtgagctggtggctttggctgcagctgggagaggaaacagagagtgatttgcagaacaaactcagagtggacaccccaaagctccttgcccatgataacttaccctccaagccagcttgttttaaatccactaactgttccggggctccaaacgtgggaagcttgctgggtaaggcagggacaggggctgggggtaaggaaagggaaatatgatacagagcaacgggatggcctctactcccttccacactgattaagagccacttctacaaacacacgcctgaacagcaggacaacacaggggaaaacagacaaggctaaagtcaccttattcatctcacttatgcttgtcctcccctccagcctcaggcctgctgccattacagaatggaatcatatagaacccatcacagaaccctgatgagagaggtcgactctcactaccagcatttagttctgtgctcgggcagtctcaagaaacgaacagttgcagaaatgcataacttacgaggtttcttggatttcttttcctcttctgcaaaagaaagttttcagatttaatttcttttaaggcacaacacaatgacattttcaaaataataacattcatgtgcatgaatttgacccagacaaataaaaggatgttttaatttgaaaaacagaaggagtcagcaggcaaaatgaatctatagtgatagaaaccagcatgagcggtcgtgggggcggggactgactaataaggagcatgaaggaattttctggagaaagggaaattctttatcttgatttgaacaatggtaacacatgtatgcatttgtcaaaatagatctaactgcacatttaagatttactgcagggaaaaaagagatttactgcaggtaaattatatttccataaaggaaaaaacacaaaaaccaaatagggaatcagaaaaaaaaaaatgcttgccaagggctgggcgcatggtggctcatgcctggaatcccagcaatttgggaggccaaggtgcaggaaccacttgatctcaagcgttagaaactagcatgggcaacatggggaaaccccatctctacaaaattacaaaaaaaaaaaaaaagaaaaaactagccaggcctagtggcacacacctgtagtcccagctacttgggaggtgaggcagaagaattgcttgagcccaggaggatgaggctgcagtgagctgtgttcttgccactgcactccagcctcagcaacaaaatgagaccctgtctcaaaaaaaaaaaaaaatgcttgccaagtcttttaaaaatatctggagtgtctacctacaggaactgagtttggctaaaatagtcgttctcaaagtctggtgcccaagccagctgcagtgacatcaccagagaacccctaagaaatgcaaattattggtcaggcactgtagcttactcctgtaatcccagcaatttgggaggctgaggtaggaggattgcttgaggccaggagttcaagatcagcctggacaacatatcaatatcctgtctctacaaaaaaaaaaaaattgttttaattagcctggcttagtggcacatgcctacagtcctaactcctcaagaggctaaggtaggaggatcacttgagcccaggagttcgaggctgcaatgagttctgttcgcaccactgcactccagcctaggcaaaagagcgagactctgtctcttaaaaaatagtaaatgcaaattcttgggccccaagccagagccactgaatcataaaggctgggggtgagacccagcaatctgtgatgtacaagccctccaggtgagtccaaagtccactcaagtgggctagaagatcccagcttccttctttgccaccttccacaacactggaacaaaaaggggcgtttttgaaatcatatccctgcccacctgcaggacacctgacattacagataagccctgctctctcctattaccctctccctcccccagacccccatcacaccacaaagcccccttgctaccgcttctcctacttcgaagtcacatcactcacagtcgctcactctcccatttcctccccttctgccactttcccacccactccctgtggaccagcatcttgggaggcccaggctgtgacatcaatctagggcacaggcacctccctcatcacctacccttagacatctctctgcactgggactactccataccccctcccctatttccccatttcagcctagaggagccttgattcattcccgaactttattctccagggtgtcattctgctgtgacatgaggacctcacctcactggggaacacacctgcctgctggccggcatccctacctcattcatactaagggaggagctttcagaggaaggtgactggggaaggacacaggtcaacagtacctttccacttcctctttcactcctcttttcacacaaagtacccttcgaggttttccggcccagctaagggctccctcctccatctgcaccaggcatcccagccctgactctgttccattcggggaccgataccacactctgcctgctacaggtgacctgaacactaagcacaagcaacaacaacaaagagcaagccctggctctctcatccccccaacaccagcagtgtgcagccagccctcctgggttcacaccaacttttcagggaagcaatgacagctaacatttcagtggtatatggacatgtcagtggtatatgaacatgtcagcggtatatgggcatgtcagcggtatatggacatctcagcgatatatgaacatgtcagcggtatatggacatgtcagcagtatatggacatctcagcggtatatggacatgtcagcagtatatgaacatctcagcggtatatggacatgtcagcggtatatggacatctcagtggtatatggacatctcagtggtatatggacatctcagtggtatatggctcataaagagctctcacaatcagtgtcccctcatcactcagaatcatcctgtggcctcgatatcactattgtccacatttgcagaacaggaccactcttctcctcaacccccatgtcaatggcaggtgcctgcccaatgagggggatagtacccctaggagggcaaaaatggatccttgggggagggggagtaaaaaagattactctttttatgtgtaaaagcacaaacataaacagttatgcagtagatgggtggtattaaaatttcatgggttgtaattaggaaaaaaattttctcaaatggttctggggatgagcaggaggagggtaacagtgagaaaccaaaaaaaaaaaaacagttgagaaacatggtaatagcagaagcccattacaacccagagacttaacactgctgagatgccaaggaggtttagcctccacccttcctggaccgccatcagtctccttgcccaaggctctgcccaaggacttgggtatagtaaatatttctcaaaacaagccagcctcaggcatcttgctgttccaggcagcccaaacgtgcaatgctgatggacagcggagcttctgccacagccctacagccccccgcagtggggactgccaccaacttctttcccactgaggtccaggccccacagtgactcgggatgggccggaagtgacttggccagagcctggggaggccacagccatgctgttgccatggagacaggggtggggctacttactggagaccttcttcacagggcgtgtggatttgtgtgtggacgctgggtcatgctctccagggtcacctgtgtcagagaagaagggctcagtgtgtgcggctcctctcactgaccctagcagccagctttgccatgggtcggtgggcaggcagagggtttacacagacagccatttcctccgaccttccccatcccatcgcttacaagagctacaaacaaggtgatctaagaaccagtttggtgtattcccttttttctctgactttttaaaatgtagcaagggccaagtcttttttccaccagcacccagctctgtggcctctgagacttctctgagctttggtttcttcgagcacacaatggggatgacttcaccttgctcatggttgatgtgactcctgaatgagatcaaggtcatgtagcggaggctgggtcaacacttgttcctttcccactattctttctctcccctcctcccacataccagccacctatagctttgcccccacgcagcacttccacaatggggctgcaccgccaccgatttcagaagcccttctgcaaggacactcggcaggccaagctgagattcaagcccaatcttggactacacaacagagatttactatgggccaggctctgtgctaggcactagggaaatagcgttgaagaaaaatcagacaggccaggcacagtggctcaagcctgtaatcccaatgatttgggaggccaaggcaggagcatcacttgaagccaggagctcaagatcagtctggacaacttagcgagaccctggctctacaaaaaaaattttttaggctgggcccggtggctcacgcctgtaatcccagcattttgggaggctgaggcaggcagattacttgaggtcgagagttcaagactagcctgaccaaagtagtgaaaccatgtctctattaaaaatacaaaaattagccaggtgtggtggcacatgcctgtaatcccagctactcaggaggctgaggcaggagaaatgcttgaacctgggtggcagaggttgcagtgagcagagattgggccattgcactccagcctgggtgacagagcgagactccgtctcaaaaaaaaaaaaatttttttttaattagccgggcatgatggtgtgtatctatagtcctagctagtcgggaggctgaggcagagggatcacttaatcccaggagtttgaggttacagtgaactataatcacgccattgcattccggcctgggcgacagagcaagatcctgaataaataaataaataagccgcagcccctgacctcacagagatcacaacctaatgagggagatatacggggatcccaaggaagaatgcgatactacccatgcaagagtcccaagaggatgacaaggaccctgggcccagtctgaggagtgggagcagtggcaggggaggctggctataaatgtaatgttttgctgatctttgaagggtgagaggagttaattagtgaagacggtggagttcaagccttctggagagtggggaagagcaaacacaaaggccctgtagcaggaagttttgcatatttgaggaactgaatgcagagagatgcaccagaggagagtggggggcgccttggggctggagagagaccaacagggcttgacctggcatctagaccagggtcaagggtttggtctgcatcagggagtaataggaagcctagtgagagggcaaagcagaataggtcccaggacatgagctctgcatcatgaaaatccctctctggctgcagcggcagatgcagagggtttaggaagctgctacagtcatggggcgacaggtgatggcaatggagaacaggcaagcagtgctaggatcagcagactgagtcaggagattgaaagaagtgaaatttggcaatggattggatatggggtgatgaaaagggggtgtcaaagaggaattctagatttctcccccaaacgggccattcccccaccaaacacaataacaagccctagcttattcaaaacccatccaagttggcctcaagatcacaggccaaaagagcctatctgtccagaaagtccaagcattaacatcaagtccccaaaaatgctttaggaaagatcctaaaatgtcaggatgaagcagactccccaccagcctccagacagagggcggatgtttcaggagccctgaaactcaggccccagtgctcgggatcacgccccaatctcccatcccaaaacatttaggggacccatcgggttgcagggttccacagggggcagcatagggggctgctaaggtcacctgaactgggggtgggctcctggagccgcccgatgcactgcttcagctcgtttttgaggtctatggtgctctggtggatgccttttatcagcttgtggttcagttccacctcggggatgtagactggctttgttgagattcctcgcagttttgatgctttctggaacatgccagggggttagtgcaggcagctctggtgaaacggggacctgggctcagtcctcaccaaccccaggaggctctcccctatgcccaagagtgctaagtccaattggccttctcaaattacaggccagaggtcaccaggagtttaaatgacacttgaagacacagtaatctggagctggaggggaccccagaggtcactcatcttacagatggggaaactgaggtctagacatggcaggaactccaccagctaggggcacagacacagctgggactgagatcttccgatcccccaggacaatgttctttccacttttccagctaaaggtggaaaagcacaggaaactcaggaccaccccaatcctaggggaacagctctaatcacacattctggtaacagacagggacatctcaagggatgtggattgcagccagggaatatcttatgggaagggagggtcttcctggaagtcccaaactttgagaaaaatagggttgtacagtatcaagaagcctagatgtgcactcagatccttcgagagctcggggcagctgctccaacagacaggaatgaacacttgggatgaaacttaacgccatccagactaggcacgcatcaggcctcagtgcacagagacaaggttcccattcactcctgcactgtctccccaccccctgatctgaacaaggaatctgggtctttcaggtatagctgcaggtcactcaatcaatggggcacaccactatatgccaagcactctgctatgtgctggtcagattggcaggaggatgaatgggggtaataagagatgggcttacagtcaaaacagccatgaaaaaatgcacatctgaaacaacatcacccaatgttactgtagaaacagtgtggcatgcttgggaacaccgatacggcatggcaatgggatccaaggccctggaaggatacgactcactaggcaagaatgcccagcatggcatcccacccacacccactgtgtctggggaacagtgagtgcatagggcatgagccagggatggatgatatgagatgagactgctggcacaggcggggcccagtcacctaggaccctgcaggccatgttaagggacatgaggccagaaacagcagggggcccatgctttagacagatactttgatacagtctggatgtttgtcccctccaaatctcatgttggaatgtgattcccagtgttggaggtggggcagggtgggaggtgttcgtgtcgtgggggtggattccccatgcaccgcttggtgccctccccatggtaacaggtgagttcttgcacaaactggttgtttaacggaggctggcacttcctcctctgtctcttgttccctctctaaccctgtgacatgcctgctcccagcttcaccttctgccatgagtaaaagcttccttcctcaccaaaggcctaactaaaagccaaacagatgctggtgccatgcttgtacaacctgtagaactgtgagccaaataaacctcttttctttataaattactcagtctggttgggcgcagtggctcacacctgtaatctcagcactttgggaggccgaggtgggtggatcacctgaggtcaggagttcgagaccagcctggccaacatggtgaaatctcgtctctactaaaaatacaaaattagctgggcatggtggcgtgcgcctgtaatcccagctactcaggaggctgaggcaggaggatcacttgagcctgggggcagaggtttcagtgagcaagatcacaccactacactccagcctgagcaacaagagtgaaactccatctcaaaataaatacataaaataaataaataactcagtcttaggtactcctttatagcaatgcaaaagggactactaacacacacttccaggagctgctggaggaaggatgggaggaagaggtggagtgtgagtggcaggcaacgttctaagatggccctcaagcccccgaccccgactgatgtacataccctatagtatgccctccccttcagtatcggcaggacggtgaatgaaataggatatcactcctgtgattaggttatgtcatgtggcaaagggggtggaatattgctggtgtaattagcatctcaaatcaattgattttgagttcatcaaagggcaattatctggggtgggcctgacttaatcaggtaaaagaccttaaaagagggattgcatctttctagaggagaaattctcatgctggccttgaagaagtcagctatcaatctgagagacagccagcaggaaattgcggggggcctcagtcctacaaccataaggaactaaattctgccaacaaccacatgagcctggaagacaaccctgagctccaaaggaaacagcctggccatccctcgcagactgtagcctggtgagaccctatgcaggccacccataaagccatgtccagattcctgagccagagaaactctgagagaataaatatgtgttttttgaagcccctacatttgtggtaagttgttgcccagctcagaaaactaatacagcgtgtgtctcagggatgcttccagtgacctcttccagtctcccgctccttgagggccctatcatcaacagcatgacatcaggcaaaaaaaaaaaaaaaacattcaacaatgccttgtggcgacctacctccagaaactcgaactcatccctcttggtcaggctctgttcaatctcctccttcaaggtctggatctcactcttcttcttgaggagaatctgataaatggtgtcaaacttgctgttgaccctcttctcctcttcctttatcttccttgtcgaggtggtctctgaggcgtccaagagagccttcatttccgtgtattcttgttgtagctgctccacctttctgtttgcagtcatctgagagggccaaggtaagaggatgcccgtcaaaggggcaaaagtgctaaggctgcagccccaagcatgggtgagatgtggagttccaggaactcttacctgtactttgtgggagaacaaaccactgtggggagcaacttggcaatatctaataaatttggaggtgctcataggctatgactcggcaactccagtcctaggaatatgtgctacaaaaaattgcagccacctgcccctgagacatgcataagaatgttcacaggcagcattgtctgaagtagcaaaaacctggaatcaacctgaacatccatcagaagaagacttgaagcaaagactgggagctattcataggatggaatattaaacagttatgaaaattaataaactggagctatgcctggataaatctccatgagagaaaaacaacttgcagaagaagatccaccatatgatgctctttcaataaagcttagaaacaaacagaatggctatatgcacaaagaaacgcatgggaatgaataaataaattcaggagagtggttacttctggaagagaggaagagggatagaataagggagaaacagatgggaggggctgcatcgatgatattttatttcttaagctaaaggtggttcatgggcaatttttaaaaataaaagtcagcaagagatcaagaccattctggccaacatggtgaaaccccatctctactaaaaatacaaaaattagctggttgtggcagcgcgcacctgtagtcccagctactcaggaggctgagggaggagaatcgcttgaacccaggaggcagaggttacagtgagccgagatcgtgccactgcactccagcctgggagacacagcgagacgctatctcaaaaaaataaaataaaataaaacaaaacaaaaagtcaggatgcagctctggaaaatttctagagaatatcatgctctaggattgtactttccaataacatagccacttgctacatgtggctactgagcacttgaaatgtggttagtccaaactgagacttgccatgagtgtaaaatacatactggctttcaagggtttcacaccaaaaaaaggaatgtaaaatatcttaaaacttttaaattgatgatatgttgaaagaataatatttaagatataccaaattaaataaactataatattaaaattaatctcagtcaagtgcagtgattcatgctcataatcccagcaccttgggagaccgaggcaggaggatcgcttgaggccaggagttcaagaccagcctgggcaacatagacagactgtttctctacaaaaataaaaataaaaaaattagatggactgtattcctggagagtgggggtggtgaaggggagtaggctcagtcaggaagattacttgagcccaggagttcaaagctgcagtgagctatgattgttccactgcactccagcctgggtgatagagtgagacctgtcctaaaaaagatagataaataaaatacaataaatctcatgtactattcaaattaacttaaaatgacatctgcactcctactgtatttctgctggacagcactgctttagtagctgcaattttgtttcacatcttgggtagcctcaatagctgctatggtttgaatgtctcctccaaagctcatgctgagatttaattgccactgaggtgattagatcacgagggctctgccctcatgaatggattcatattcttatcacagggtttgacctccttcttcctgtcccgctctcctgccttccatccttccgctatggatgatcctcaccagatgctggaagcatgctcttggacctctcaggctccagaactttgagccaaataaacttctcttctttgcaaatacccagtctgtggtattccgttatagcagcagaaaacagactaagacaatagctcagaatcaaacataacaaagagaaaaacacacaagaaggacagtagactggaaaagaggaattcaagtatttcttcgccaatattttttttttttgagatgaagtttcactcttgtcacccaggctgaagtgcaatgacatgacctcggctcactgcaacctctgcctcccgggttcaagtaattatcctacctcagcctcctgagtagctggaactataggcatgcaccaccacgcccggctaattttttgtatttttagtagagatggggtttcgccatgttggccaggctggtcttgaactgctgacctcaggtgatccatgcgtctcggcctcccaaagtgctgggattacaggcgtgagccattgcgcccagccttctttgccaatctttcactgtgcaacttctaatgtgactacaagtgtcccccagtgttcattttcccttttttccttttggtaagagaacatccctggagtttcatctgggcgtgtggctactcagactacatttcccagcctcccctgcagctagactaggcgatgtgacaaaactccttccagtgacccatgcccaggagtgatatgtgcaacactgtgtcacttgtgtaaaggaaaattgcttgttgtcctccacctcctttttgtccctttgtcacaggctagaacaaagatgtaatggtaacccagcttcaaccaaagaggctgggacaataccttgtggaatagtagggtaataagaagggagaacccttaatccctgaatgatcacatgaacccttagtctgggttactcatgtgtgggtttggactgtcagttggtaaaataaacttcaatcatatttaagcctctgaattctggtgtatctttgttacagcagtatagcctgccctctaacaaatacaggtactttcacgtgcattctttcatttgtctcacagtcatcttcagaaagaacttgtgattccattgtgcaaattgggaaacgaaggttcaaagatctgtcaacatgaccaaagcaacataaactagtatgtgacagagctggtattctaacctagatctcatctaatgaaaccataactgctgcaataaaactggtgctgcagctctgaaaaagggtaaaaatctgatctttccatttaaaagcaatttaaacgtatcgaaaatctgaaaaacagggggaacaaaaccattcctaatttaccactccaacacttccactatgatccttctataatattccctttcagtttctttccatgctctctgtaatgggttgaatgctgggcccccaaaagacatgtccatataccagaacctgtgactgtaatcttacttaggaaagaggtctttgcagatgcaattaaagatcttgagattcgatcatcatagattacctaggtgctccctaaatccaatgacaagggttcttattggagatggaagacactaagggaagaagagacaggtatgtgaagacagaggcagagatcagagtgatgcagtcaaaagccaaggaatgcctgagccaccagaaactgtaagaagcaaagaagggttctcccctagagacttcgggagtgtggccacgccaacatcttgattttggacttctggcctccagaactctgccagaatacatttctgttgttgtaagccaccaagtttctggcaatttgtcacagtagccctatgaaactaatatacttcctttttgtaaatagatgcaaccctatgagctatatacttttgcttcctctttttctcccactttatatcataaccatttttctgaattactactttttaatcctaatttataatgatttcccccacagttgggcttataggtaatttttggtttgggtttgcaaaggatctctctcagacacacagctgtctgcatgctttgcaaggttgatgtttcatcctgacactgtgagtgcacccaacaccagccttgtcatggtcagagccacgcccatcccgcgtggaagctgagcgaagccacagggcagggctggccttggagagccctgccactcacccgcacatcctgctgcctgtttctcacatcatccagtgctctcgacgccccgttgatctgactgtacatgacagttagtttgtgcctcagggtggcctgcagggaaaacaaatgaggttgagaatgcacctcttcagcccagccccaccagaagccatccctggaactatcccacaggatagattccttcctcttccactccacccaagtcttgccaccccaagtcctgtcacccgagtcttgcctgcttggagctttttgaagcattctaatacttactacttcccttcatccttttcagaggacagtacagaccagggttccagtcccaactcccagctgtgcaactgtgtccttcacctcagttttcttggacacaaaatagatacaactgtccccagctcacagggctattgggaggattaattgaaacaatgtaagtactcagcccaatgcctggatcttaggaaaaacatactaaatgccagcttatattattatgagtttttctctaattacccattttacagccaatgaaactcaagcaaggaggacagaaaggtggccaagctcacacaggaacagaacgagctgggacagctgcttcggtaatggcaggtggggccactcagaccaatcctcccactgcaaacagccaggaaagcagtccaaataatggggcagcggggagatctgctaaaagatgctggagagccaatcaagcagaggattaagaagtcaaggtccaggagaagggggaagggggcccagagagataagcctgatatctaggatgttctctccagaggcatctgccaatcccagaacaaggctgggagcctttgtcagcctcacagggcagggagacagaaatcagagtccaaggctcactgcagactgggaccaccaagggctgggaataagatgaatcagccagccaggcgcagtggctcatgcctgtaatcctagcactttaggaggcccaggcaggtggatcatttgctctcaggagttcgagaccagcttgggcaacatggcaaaaccctgtctctactaaaaatacaaaaattagccaggtgtggtggtgcacacctgtagtcccagctacttagggggctgaggcaggaggatcgcttgattccgggaggttgagcctgcagtgagctgagatggcatcactgcactccagcctgggtgacaaagtgagaccctgtctcaaaaaaaaaaaaaaaaagatgaagtagctcacaggggctgaagcccaggtgcaaatctgctcagtcctagccacctccagaaacaaaggcaaactgtatatgaaggaagctaatatcctcatctgatttcaattaattttcataatcaatatctgagtctcctacctccctgctcagatgaatactgcacagaaatgggaaggaaaatcaccaccaccataacagcagcagccagtatttattatgcacttactgtatgccaggcactgttctagtgctttacctgtattaacttacttaaagctaagaacaacactatgaggtaggaattacccagcctttacagacaaggacactgaggcacagaacaattaagtgacttgccccagctacactactagtaactggcacagctaagatcccgatattaaaatcatagacacatgcccaaactgagcatgctggagatttctagaaaaaaaaaatttccttcccgtaactagcaggctcaacatactctggctctctcttccacttcccagactcttcaactccacccaagatattctgggcggaacctgatcttgaatctagatttgaacaacccagtgacagtcacatgtaggggttggaggcagggaccaaggccacactaactcaatccgaaaagcccaagctgctcatgatgtttcaaacttgacctctgtgacactgcccttcgacctggcctctaacagtggccaagataaggtgtgggccaaagaccaggcctacatacatccggccttgctggcctcagagcaagaagagacctcagaacaccccaaggctgccaactgcttcactttcaagagctgctcatagcactacaccctgagccctatattttgaaagatttgatacaccattaatcaaacacatgcggcagtaccctcatcatgaatggtgcccacacgactccagaccaaaggaaagtgacccaaaaactttggtagcagcaataatcccctaatcaaaggcaaaggactttttgaaatcctgaggatcccttcacagactagagacttgggtcttccacatgggaggcaccagagtctcaagtccgaccccaccagtggccaaggcaacccagcccccgaggctaagggcattgcccagctgagactggctctgccaacagtgatgagcagcagtagcagggctcaaaaagcagacctgttataggactcagcaagtcaggacaggggggtaggtgttggcagaggaaggcctgttgttaggattaaacagcagagtttaggccaggctcctggctcacgcctgtaatcccagcacttcaggaggctgaagtgggaggatcccttgaggttgggagttcaagaccagcctggacaacatagtgagatcccgtctctacaaaaaatgttttaaaatattagctgggtgtggtggtgcgtgcttgtagtcctagctactcaggaggctgaggcaggaggatcacctgagtccagggtttaaggttatagtgagctatgatcatgctactgtagtccagcctgggtgactgagtgaaaacctgtctctaaaagaaaagattaaaaaatatatatatatgggccgggcgtggtggctcacgcttgtaatcccagcactttgggaggccgaggcgggtggatcacaagggcaggaattcgagaccagcctggccaacatggtgaaactcagtctctactaaaaatacaaaaattagctgggcatggtggcgcaggcctgtagtcccagctgctcgggaggttgaggcaggagaatcgcttgaactcgggaggtggaggttgcagtgagccgagaccgcaccactgcactccagcctggcgacagaacaagactccaactcaaaaaaaaaaaaaaattctgattttatagccaggccccatggtagcacacctgtagttccagctactcaggaggctaagatgggagaaggattgaggccaggagttcaagaccagcctgagcaacatagtgagatcccatctttacaaaagaattttttaaaacttagccaggtgtggtggctcacatttgtagtactacctactcaggaggctgaggcaagtggatcacctgagcccaggagtttgagattacagtgagctatgatcaccccactgtactccagcctgggtgacagagtaagatcctgtctctaaaagaagaaaaaaaaaagccaagtttagagccaggcacggtggcacacctgtagtcccagctactcaggaggctgagatgggaggatcccttgaggccggaagttcaagaacatcctaggcaacatagcaagaccctgtctctaaaagaaaagaaaaaaaaagccaagtttatatgctacacaaagctggatgcagacccccaactctgaccttgctcaggctactgtctcctctgacaacacgaagacgggtcttgttctccctgaaggtgctgtgagaatgaaatgaaatcaggccatgctttggatcttaggctgatgtaacaaaaggtggtttgatttcagcctctgctttgaggccacaaggggaaggtatgatccccaaaccacctaaaaacattgcagacctgaaaggcccttaggaatccacctagtcccacagcctcactatactggtgaggacccaggtccaggggccaaaccccatgctcaaagtcacacggccaggacggaggacactatggtgcaagagtgttggctctccctgtggctctgatccagtgattactgggacgctgcccaccctccctcttaggcctctaataacaacccttcctgatcacaggaactctccggcccaccaaaggcttttgcttacatgacctcaagcttcctggactgtttggtgctccggactctacggacctggatacgaggctggtccatgggaagaaatgcaaactatgaaatcgaaccaacccgggtcacaatgcctgcgtggctatttactgcattaggtcaggctaagttcatttctctggacctcagtatcctcaacagtaaaatgaaactaaatcatatccacctcctgggtgccaccaggacttcgtgagggaacagaggtaacctccaacgttcatagttgacattcaaaaccctctactaaacaccatcagatggtggggcgcagtggtgcacgcctttaaagacctcctagcactttaggaggtcgaggtgggcagatcgcttgagctcaggaattcgagaccagcctgggcaacatggcgaaacctcatctctacaaaaaattagcgagcctgtggtcccagctacttgggaggctgtggtcccagctactcttgaggctgaggtaggaggatcccttaagcccgggaagtcgaggctgcagtgagctgtgattccgccactgcactccagcttgggtgagagggacgagaccctgtctcaaaaaaataaaaataaacaccatcagacaatgacaggattatggcaagcaacctaacctgtcttcatggatgatgggaagggactatataatctcccatcccctttctactctgacattggagatgccccggcctcgaattcaggcccatctccccagggcgtccagagtgtggcagagaggcccccggtggcccctctgcaccacccatcaggccaggctgccctctgcacccagcaggccgttccctacctccaggtcggcgctggcctggctcagggacgcgggagagcaggtcttatgctccaccaggcagatgtggcagatgcactcgctgtgctcggggcagaaaaattcccgcagccgattgtgctgggaacatttgcggcgcaacaggtcgcgaacgggcggctgcagcgggtggtcctggaaggcggggctgtcgaagtgcggctgcaggtgctcctgacagaaggaggccatgcacaccaagcacgtcttcacggcggcctccttcaggcagtggtcgcaggccacctgggcattcgggctgggtgcagaggcgcgggcgggcggcgtccagacgtcggcgggtggctcccgggccaggtcggcctgcaggaactgctccaccacgttgcacagcaccgtgttcttgtgcagctgcggtcgcgcctggtagacggcgcggcactgcgggcacaggtatggcgagccctggactgcccacgtctcattcaggcacgacccgcagaagttgtggccgcacggagtggtgaccggctccttgaagggctccaggcagatggagcacgacagctcctcggccagggggcacagctctgccatggcgctcccaggggtcgggacacaactgctgcacccgcgctccgaggccgccgaggaaac

SEQ ID NO: 2840 - DNA, 124267 bp, Homo sapiens
  source 1..124267: mol_type = genomic DNA
ttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaatttaaaaaccactagtcatttgtctttttatttaaaggaaaggtaagttatttactgtttaaatttgtgcagatttcttcagaactggaaaataaaatcctgagatggacgttaagtttggaagcttggaacatttaaaaagaagatttgctaaatgctgctgtaacattattttaccccagaagagaggtatttagccttatacatgttctcttcattagctgaactgcgaggagagggagtggtgttataatcctaaaagaaaagaggaacccgacctgccaaggactaagcggtggtcatcaaatctcccaactacttcattcttagaactctgcatctaaccaagctttcccctttcgcttagcctctttgagtttcaagctagaagaaagtaaggaaatcatcagatgagctgtggtggaaagcctcccaaggactgctgataagtgagtaaaaggagacagagacaaaaaggacaatgtgggggagggaagtcacttacgacacctgcatctgaagggagggaactgaccttccaaacgagtcaaccttgtcaatacactgcactgttctcctgcctaccagtaaagaaggcctttacaattaattttacatagtttcaaaaatcttcaactcctaattccctaaattcattcagtccttggcatgactttatatagaaccaaatgaacaattgagaaaaaaaaggtgaagttttgaaagaaggacatatttgaaggggtttactgaagcagggaatgacagaaaaggaacattttgattagtaagtgttacacttgaaaaaattccctaaaatatagtattacttagatcaaaaggaacacctctttctgaaggagcagcacacagcaagacagaagggaaccactaggtacagtaaaatcatttgaacatcatagaaatttacccaagttaccaaattatcagaaacaactgtctgtactgacaagctgcataactgagcattcccccccacacccgccccctgttgctgtcagtgtgcatcatttcctttccttcttttgagatggagtttcattctgtcacccaggccggagtgcagtgacgtgatcttggctcaccacaacctctgcctcccaggttcaagcgattttcctgcctcaatctcccaagtagctgggattacaggcgcccgccaccacacccagctcattttattattattagtggaggtggggtttcaccatgttggccaggctggtctcgaactcctgacctcagatgatccaccctcccacctcggcctccctaagtgcatcattttctttttgattgcaagtttccatctgtcttttttttttttttttttcttttttgagacaagagtcctgctgtgtcaccctggctggagtgcagtggtgcaatctcggctcactgcaacctctgcctcccaggttcaagcaattcttgtgcctcagcctcccaggatgctgggattacaggcgtcggccaccacgcctggcttttgtgtttttagtagagacggggttttgccatgttggccagactggtcttgaacacctgacctcaagtgatctgcctgccttggcctccccaagtgctgggatttacaggtgtgagacaccacgcccagccccatctgtcatcttaacagcaattagtaaagaacactttttctattgtgctttagggaacctccttttgcttggcctaggaataaccttatggaagatcccttacttacatttaaaacaagtcacattcttttctgagagccccaactgttgaatatgtttagtaagaagcgctcttccctgggcagttggttgagcctgcctcttatgctgagctgtaggatgctgccccagtcacgcaacctccagatgaagtgtgtcctctcctcattgtgcaaacaagggccctcacacacaggttctatttgatttttataatcttgctttaggaccagggaaacaaatgtgaaaaactgtcaagaatgatacacatttggggaaaccattttccaaatgagtaactggagtttaactaaagatgatgaaaaagttgtccctgctagtcattacattgagtagtatgacagctacaggattaggggtggccaattaagccaaatcgagttgctacgggttcactaggtcaaatgaaacccagtgggaggtgagcctatgcagcagcctttcccaaatgcacaccaggagacactgactgacctgaaggtctcgggcaaggactctggcccgcagggtctgcagagcaggaatggaagggagactcccggtcaacatgccagccagagaaaaggattttagaaagagagcagcccgtactactgatgtcccaaactacactgtggctaatcttaccatttgctcttaagcatccctaagcagagttctaaaacttctataaatctagactatgaaggcatgtattggtagatgtgagaatgagaggtagaatgaggagaaatctaaaaatattaccacataaaaattcaaatgaatatgcaaaaaagaaaatagctcttggggttttctatttcccaaatttttctaatcttatcacctttataattcaaacatttaaaaaactagataaaaaaattaaaaatggctcattttctgaattctggttttaggattaattacactcatgttttacattcaataaaatgtgtgttttacatatatacatttttaaatcacagcacttccagcttccactccgggatgtaggggtagaaggagcatttcttctactcttacaatgcaaacgagccagatgaactataaattaggacattttttcgaatccattggaaagctgaggttgcagagtaaccaagtggcaccaaatggagaggggcagttgcctgcaaggggagagaagacattagcactagtttcgtagggtcgttgtaaacagacactggaaagaataggctagctaaaagtgatgattggtgaaggcagaatatgggctgcaggagtgttaagacccgggggcctgcagaaactaggggagtcgccctatcttgcaggctttttctttacaatctctaccaggggctcagaaaatactgtaaagagccctaagaagtgtcggctgtgacacacacccaggggagtatacagcggccttgggcatgggtaaaggaacttaccataccctttctctcatctcacagaacaaaagcaccctatgagggaaaaggagcacaaatactgttgccgtctggacactggtgaaaagtcactgcagcagagagaagggactatggaagaaaagccccatcccagaggagggggcagaaatatcactgggcccacaattagctgggaaggggcaagtaaacagagaccctcccaaacctagggacacagtgcctaaaactgcaacctaatccaagaacgccagcccctccccagcccccgttacacttcaagaaacagcagagtatttccaggaggaggacagcagagcaacggaagcagagagagagaccctcttggagacccagcacaaagcttctgagcctggaaactcagggtcagaaacacagtgctctggtatccaacaccaatcagaaatacaaggtatcatcacaggaactcgagaccactaaggataatcatagcaaatccaatcttgaaccaagcacaactcctaactactattagattggcataaaagtaattttggttcttgccattaaaaaatgcgaaaaccacaattacttttccaccagccataatatattaattcaacctctgccaacaaaggtcttagcagcaggaaaggcctccttactttcaggtgtaaaaactattcaccaaagtatcttgtcctatgtgagatgtgttgctattaacaaaatatatagagtcatatgaaaagccaagaagaaaacattctgaagatatgaaacattcatcagaaccagagtcagataacagagattttggaaatgagagagaattttaaataattattgttttgagaggccaaggtgggaggattgcctgaggtcatgagttcgagaccagcctggtcaacatggcgaaaccccgtctctactaaaaatacaaaaatcagccaggcgtggtggtgcacacctgtagtcccagctactcaggaggctgaggcaggagaatcgcttgaaccttggaggtggaggttgcagtgagctgagattgcaccactgcactccagcctgggtgacagagcgagactctctcaaaaaaataaaaaaaataaaattatgtttactatgtcaagaaaaatggtggatactatgcaagatcatatgggtgattacagcaaatcgatggaacctataattaaatattaatagaaatgtaagacatgaaaaatgccaaaacagagatgatgaatgccttcagttggctaatcagtaggctctaaactgctgaaaagaaaatcagtacatcttgaagataagttaaaaaaattaccttaactgaaacacaacagaaaaaaatgaagggaaaacaaaatcaacccagaacgtaatatacaaaagctgtgggacagtatctgtgtaaaatatgcacaactagaatcctagaaggagaagagaaagataatgggcagaagaaatattcgaagagataatggcttagagttttccaaaactaatgacagacacaaaaccacagataaaagaaactcagagaacatcaagcaaagctaggtgaggtgggtcacacctgtaaccccagcactttggttggctgaggtgggaggatagcttaaacttaggagttcaagaccagcctgggcaatgcagtgagaccccctctgaaaaaaaaaaattagctggacatggtgtgtggcttgtagtcccagctactcaggaggctgaggtgggaggattgcttgagcccaggagggttgaggctgcagtaagctgtgatcatgccactgctctccagcctgggtgacaaagcaagaccttgtctcaaaaaaaaaaaaaaaaaaaaaaaaaaaaaaggctaggcatggtagctcacacctataatcccagcactttaggaggccgaggcaagcagatcacttgaggccaggagcttgaaaccagcctggaaaacatggagaaaccctatctctactaaaaacacaaaaattagctaagcatggtggtgcacgcctgtaatcccagctactagggaggctgagacacaagaatcgtgtgaaccttggagatggaggttgtagtgagctgagatcgagccactgcactccagcccaggtgacagagtgggactctgtctcaaaagaaaaaaaaaaatcaaggctgggcccagtggctcatgcctgtaatcccagcactttgggaggctgaggcaggtggatcacaaggtcaggagttcaagaccagcctgaccaacctggtgaaaccctgtctctactaaaaatacaaaaattagctgggtgtggtggtgcgcacctgtaatcccagctactcaggagggtgaggcaggagaatcacttgaacccgggaggcagaggttgcagtgagtcgagatcatgccactgcactccagcctgggcaacagagtgaaactctgtctcaaaaaaaaaaaaaagaaagaaaggaaaaagaaaaaaaaaaatcagagcacaccaagcaaggtaaataccaaccacaccacacctaagaaaaagaagtttcctggccaggcacggtggctcacggctataatcccagcactttgggaggctgaggtgggcagatcaccaggtcaggagttcaagaccagcctggctaacatggtgaaaccccatttctactaaaaataaaaaaaaatgagctaggtgtggtggcgcacgcctgtaatcccagctactcaggaggctgaggcagaagaatcatttaaacccaggaggcggaggttgcagtgagctgagatcgcagtattgcactccagcctgggcaacaagagtgaaactctgtctcaaaaaaaaaaaaaaaaaagaaaaaagtttcctcctagttggttacactggtgaattctactaaacagttaaagaataaggccaggcagggtggctcatgcctgtaatcccagcaatttgggaggcgaaggtgggtggatcacatgaggtcaggagtttgagaccagcctggccaacatggtaaaaccttgtctctactaaaaatacaaaaattagctgcgcgtggtggcaggtgcctgtaatcccagctactcggaaggctgagacaggagaatcgcttcaacctgggaggtggaggttccagtgagccgagataaaaaaaaagtaataataaataaataccaccaattctacaccctcttttccagaaaatagaacactcattttatgaggtcagcattactctgacaccaaatcagatgacgacagaaaatttcagaccaggatcgctctgaatatagatggaaaagttctggcaaaatattagcaaaacaaataccattacacacctattagaatggctaaaaaatggctggttagctcagttggttagaagaaaaaccaaaaagaatggctaaaaaacttctggcagtgccaaatatttgtgagatgccactggaactctcatgtgctactgatgggaatgcagaatggtatgtcactgtggaggttgggcagcgtctcagtaaagactctacttaccatatgactcagtgcaatgagtgctgacaccaaccacccggagttaggtcaaactgtacaggttatgggcaaagtcttccacaagactgccctcattccagacacaagctccaagttccgggatcctgaggccaccctcacttctgatcagctgattacaaatttgggcgtatttgctatcctactcatgtttaataattgactagaacaactcacagaactcagaaatgcacttatgatcagagtttcattatgacaaaaggttacaaataaagccagctaaagggagagatacatagggtgaggcctgggagaggcccaaatgtgaaggccccttgacttcaggacaacttactctccaggcacactgatatatatatatataaatataaatatatatatatttatatttatatatatttatatatatataaatacatatgtaaatatatatatatatatatataaatacagagtactgtcaaccagggaaactcactcaagctttagtgtccagttttgagacggagtttcactctttttgcccaggctggagtgcgatggcacaatcttggttcacggcaacctccacctcccgggttcaagtgattcttctgcctcagtctcccaagtagttgggattacaggcatgcgccaccacgcctggctagttttgtatttttagtaaagatagggtttctccatgttggtcaggctggtctcgaactcccgacctcaggtaatctgccttcctcggcctcccaaagtgctgggattacaggcgtgagccactgtgcccggcaggtgtccagattttttactggaacttccttatgtaggcataacaatcattggcaatgagttgaactgggctatcacatggttcagagctccaactgtctaatgacacccacagcatttctggtgtagccagccccgatcctgagtcatctcattagcatacactagcaaggcccaccataaataactcctaacacttgaggaatgccaaggatttagagggcacttcccaggaactaggacaaaggccagacaaattctctattgcacacccagcaatcctgtccctaggcatatatggtttggctgtgtccccacccaaatctcatcttgaattcccacatatcatgggagggacccagtgggaggtaattgaatcatgggggcaagactttcctgtgctgtttttgtaatactgaataagcctcatgagatctgatggttttataagggggagtttccctgcacaagctctcgtctgccaccacatgagatgtgccttttaccttttgccatgattgtgaggcctccccagccacgtggaactgtaagtccaataaacctctttcttttgtaaaatgcccagtctcgggtatatctttatcagcagcatgaaaacagactaatacagcatgtaacactctagagaataaaagcttacactcacacaaaaatctgtacccaaacgtttacaagagtctaatcaccctaaactagaaataacccaaatgggcaaatgaatgaacagtggtatatccacacagtggactactactgctcagcaataaaaaagaaggaggtgctgattcacacaagatgagtgaaacttaactgcactttgcgaagcgagaggtcaaactgtgatcccgtttacatgactctggaaaagcaaaaactaaaagggcagagaacagatcagatcagatcagatcagcggtagccaggagctgtggggaaggggggtggttacctataaagggccagcacaggggaatcttgggggtgactgaaatgttctgtatagtattgtggtggcggatacaagacatttgttgaaacccacagaactgtatgccagaaagactgaattttaatgtatgtaaatttacaaattaaccaggatatgtgggggaggacagaatgtagaccataacagatgaacctgttacaccaacgaagcacaaaatcacaatgaagggattttgtgaaagaacagaactaatgtaattttgaacctaaatatctttgaaaaaaatgttatgacacaatactgaaaagctaaagactaaaagaactgtatacaagcactgtattttaggtggtaaatctgttttttgtagggcatagcctggaatccacaggaggccaacggttctgaagctacttgtatattagggttgaacaagtacatacatatattgtagctaatgagagctaggcttctgtcagagaaaggcattataaataagagggaaggccagaatgaggcctctggagctgaactgttaccaatatagactcacagtcatagtgacacacacacacagatatgtacagaaatacacataaatgtgtgtatttgcatgagttaactatacagtcagccctctattatctttggtttctgcatccatggagtcaaccaacaatagacagaatttatttttaaaaaataataaaaaaaatagcacaataatttacatagcatttacattgtattaggtattacaggtaatccagagatgatttaaagtatctgggagatcaggcgtggtggctcacacctgtagtcccagctacctgagaggctgaggtgggaggattgcttgagcctaagacttcatagctgcagtaagctatgcacagctgcaccctagcctgggcaacagaatgagaccgtctcaaaacccaaaacaaagtatccaggaggatgtgcacaggttatatgcaaacactataccgttttatataggggacttgagcatctgtggactttggtatccacagggagtcttggaaccaatccctcacagatgctaaggaacagctgtctatatacattttctttctttctttttttttttttttgagacagagtttcgctcttgttgcccaggctggagtgcaaatggcacgatctcggctcactgcaacctccgcctcacgggtttaagcgattctcctgcctcagcctcctgagtagctgggattacaggcatgcgccatcacagccagctaattttgtatttttagtacagatggggtttctccatgttggtcaggttggtctcgaactcccgacctcaggtgatccacctgcctcagcctcccaaagtactgggattacaggcatgagccactgtgcccggccatacattttcttttttttgagacagtgtctcactctgtcacgcaggctgaagtgcagtagcacgattttggctcactgcaacctctacctcccaagctcaagtgatcctcccacctcagcctcccaagtagccgggaccacaggtgtgcaccaccacacccagccaatttacattttctatctatccattgagtgggactagaagcagtgacagtctaataataataaatatgtggcatccaaatctttgtttctagatagcattctccaataaaaagaaccatggttccttaggaagtggttaattccatggctggggtaggcatcttgtgatgtcagaaagcaaagaaatgcttaaaaaaaaaaaaaaagaagaatgagacatatgaaaagggcacaggagccaatctggaagagtttccaatggctaaaattagaacaagccaagctacaaaatattaacagtattgagtcataactcaaaaataaatatccatcatatatagatatataaagtagctgatataaataagtagctgaaattacaaaaatggggaagaagggacttttcctcacagcattctaacaaaaaacatagaagaaattagtgaattagaaaagtaccattaaaacattacagtaataattcccataggcaagatcgactactaggtgctaaaattcgtaagcaagagttttggctgggcgcagtggcacatgcctctatcgcagcacttttggaggctgagacgggagggtcacttgaacccaagaactcaagaactccatctctataaaaaatacaaaaattatcccagtgtgactgcgcatgcctgtagtcccagctacttaggaggctgaagtgggaggatcgcttaagcccagggggttgaggctgtatgagccaacatcgcaccactacagcatgggtaacaaagccagaccctgtcttccaaaaaaaaataataataataattaatagaaacaaggtatctgcatagtttcaaagtatctgccccaaatatttagtaattacaaagggggaaaacgtaaatctatagtaggaaatcctcacagacaccatcttaaccaagtaatctcaaggttaagttcaccaataaaaaagtatcaacatcagggctgggcgggcacagtggctcatgcttctaatccagcactttgggaggccgaggcgggtggatcacttgatgtcagagttcgagaccagcctagccaacatggtgaaaccccatctctactaaaatacaaaaattagccgggcgtggtggtgcatgcctgtaatcccagctatttgggaggctgaagcaggagaatggcttgaatcagggaggcagaggttgcagtcagctgagatcatgccactgcactccagcctggccgacagagtgagaacctgtctcaaaaaaaaaaaaaaaaaaatcagtatcaggccagcatcgcacctgcaatctagcctgcaatcaacctaccactttgggaggctgaggcagggggatcactttgagctcaggagttggaggccagcctggagtgaaaccccatctccacaaaaaatagaaaaattagccaggtgtgttggtggacacctactcaggaggcttaggtgggaggatcacttgagcctgggaagcagaggctgcagtgagccaagctggtgccactgcattctagcctgagcaacagagtgagactccatcaaaaaaaaaaaaaaagtatatatatatgtgtgtgtgtgtgtgtgtgtgtgtgtgtatgtatgtatatatatgtatatttatatatcaacatcatatcccccctgatgtgatgcactaagggccttcccaataatgcataacctcaatttaatataggaaagcatctgtcaaacccaaataagaagaacatttaataaaataacacatcctcttcaaaaatatcaaggtcatgaaagcaaggaaaggcggaagagctgtcatatactgaaggatcctgaggaaacatggtaacaaaatacaatgtgggatcctagaccggatcctagaacagaaaaagaacatttgtgaaataactggtgcgatctgaacaaattctgtagtttggtaaacaatattgcaaccaggattaacttcttagttttgatcactgttctgtgattatgtaaggcattaacaaaaggagaagctgggcagagggtatacggaaactcttgcacaattttttcaactcttttgcaaacctgaaattatctcaaaattaaaagctaaaaaaaaagaataatctttaggttttaaattattaggtatcagaatgttgggtctgctgcaagtgagataaagtggaaaaggcactagaccagcagttcaccccatccctgccagtggttttgaacctgaagagaatcatacaacctccctgaacctaaggctccatggccaaacaggtttgatacacaactcatctacctcaaaggttacttaaagatcaatgacacaagtagttaaagttgtccagaaaggacacgttcacagacaacacaagcattaatgtatctctagccctaagaaaactctattcaggagagattttccaggaatgaacttgagataaaatactaaatacagaagcaaggtaacagcagactgttcttcagcaaaaaaggaaaggttacaaaaataaaaataaaaaaacatgctgagggctctatcagggtacagaaagagcaagaaagtaggacaagcagagagtggagcaactggttcttctcctgtgcctcttccttccctctctgctacctaaaatttagcatagcagactacatcaaggaagagggaaaacagcggtgttcccgacatcaccaaggaactcagagcagctttagtatataaggtggcttggaaacgagggggaaactactttcctgtcctaaaagcaaacaggtctgaactaaaagctatcatctctgaagaaatcttttggcctttcaggtttattctaattttagaatgactgggatcgatgctaggcatcactcctcgccattagactaaacacaaactaatcaaatgtttggatcttctctacactactaatgaggcaatgagtagaaaagaaggggtttctggtcccaatttaataaacagcagaggcatattttctcaagttgattttattaacaaaaagtgcaaactattttgaacaaaagtaaactatgagtcacagcattcagcaagacatcagacacggaagagtgaacaatattcactaagtaaaatacagcagatgagatgtctctcacatgtatatttaattattcatgctttttcaatagtctcttagtcaactttcagtgtaatttccacaaatatatagcagctcaaacacaaatgcaggagcacaatggcaaagtttggcaactgttttgggctaattatgagtatgaaagaaaaccttatatcacagtttcacgttcatgtaagccactgtgcaacatgaatgaatctttaaatgtgttgacactgaaatcaatgtacaactaatgaaaataaagaagaaaagggggctttaaaatatttgttgcactacagtcgtatagtaagaggcagaaaaaaatgaaagaattttaaataatcttacacgtgtctacagggccaggaacgtaatgaatccatgttaacttaatttcatttaaaattacatttgtagaagtcacacaacagaaagataccatgcggttgaacagtgtgcctgtacttgaacaagtgagagaagatacatactccaaaaaggagattcagtctagtgttacttcagttattcacatagtgtctacagggcagaatctcttccaaagcaattttctgttcactaatctacaggcactaatggaactgtaattaaaaccccaaatataaagatgattatttaaacacaactaagctctagccaaagacagtagagcaccaatgccgggcgggttactgacggcatgcagggcctggaggtacattttctggcagttaaccagccttctgctgtagtagacaaactgccttttgtgaatgtacaaatttgctaaattaatagagaactacattgttatttccttacattacaaagaactcttcccatactgtttttcccatgtactactgctgtcttagactaaactgtgccaccttccaacagtttccaaattactatttcaggtcgagataatgaagaaataagaccaaatctgattatctgactgatgacaaatttgagcaccaactacagcaaaattcagggtcaaggtagcttgcaagtcagttctcttgatttggcaattaccttccactattttcatctgtattgaagctgagatcttcagggcctatttgttcaccatcaggaaaactggaatgtgtatctatgattaaaaaataaataaaaaatttaaaatttaaaagcatataacaagggcagtattttccttcccaagtctttaaataatcttaccaaatgtgttatttaagtgataaagatgtgctgggttgtgaacaaatctctgtcttcagagaatttgtgatctgagtcaggtataagcaaacacaaaggaaaaataaaggagaaaaaaacaaaatgtgtaatagacacccacaattaaaagatgacaggaattgtctcattttgtcctcctggggacaatctggggacagcttaaaaagggaacaagaagcaatggtgtatattctcaagattcaagaccttataaacataaaacatatttcaaagccaattaaactacgcattcaagtatcactacaaaaacccaccagcactccaaataacttgcacaaaatttggatgcttattttagaagcagaggaagttactaaagatgccttaatacttacaaatcatcaaatgcttggttctgtattgaaaaagataccagagcaccaggaaaatatgcaaaatataaagcagaaaatggcataggcttaacaatgttgtcactccaggatatcttgcagaggaatgttcagattgattattaaggcctctgggtaactttaaatgtgtatttctctaacttgacagtatatccttttactgattaatctgtattccagaaaactgcttgacagcagaatacttatggtatatccacatgatagaatattaggttgccataaaaaatgaagtttatgaaattttaaataacatacaaatatatttaagtgaaaaaagcagaataaaaaactatttataaaatatttaggtagggctggcatggtagctcacacctgtaaccccagtactttgggaggccaaggtgggcagatcacctgaggtcaggagttcgagaccaggctggccaacatggtgaaaccctgtctctactaaaaattacaaaaactagctggatgtggtggcacatgcctgtagtcccagctattcaggaggctgaggtgggagaattgcttgaacccaggaggcagaagttgcagtgagctgagattgtgccactgcacttcagcttgggagacagagcaagactctgtctaaaaaaaaaagaagaagaaatgcaatgcaaataagacagaagaaaacaagggaaaatattaatagtaggtttctcttgtttttttcctaataacttttttgggggtaggagggaataaaaattatttcataatctgcatgtatttctaagttatttttattttaaaaggttaaagttatcttacagtaggctagaaaaggaaaaaaaacccaaacatctgaaatctccccagggattggcaatcatttcctatgaagggtaaatatttaggcattgtaggccacaaatggactctcttgaaaattcttctttgggctgggcacggtggctcacgcctgtaataccaggactttgggaggccaaggcaggtggatcacgaggtcaagagttcgagaccagcctggccaacatggtgaaactccatctctactaaaaatacaaaaacattagccaggcgtggtggtgtatacctgtaatcccagctactcaggaggctgaggcaggagaatcgcttgaacccaggaggcggaggttgcagtgagccaagatcacgccacagcactccatcctgggtgacagaacaagactccatctcggggcaaaaaaaaaaaaaaagaaaaaaaaaacccacaaagaaaattcttctttgtttcttttgcttggtttttaaagactctttacaaagtaaaaaccattctcaggtcacagactatacaaaagcaggttgtggaccccgtctctgcccagtaagtagcactcattaggtgcaaccaagccaaatattactggctgtgtttttttagtactcaccataatagttaaccaaagaatgttgtctcacaaatgacaataattaaaaaaaaaaaaaaagaagtagaagcagaagaagcaaaagcagtagagcggaaaaagtagaagtagcagcagcagaagaagaagaaagagaagcggcagcggtggttttagtaatctgtgtaaaatgacatcatgtgctgcaccttcatccgggggctgtgtcatgaccatgaaggagtcgtgaaacccgcccacactggtatgctcttcctgctcctcattctcagtgtcacattcaatgtcactgtcgctactcattcctggcaggaaggaaggagaacatgtttctgaaaagaaaccactgtaagtaaaaggaaacagaaatctccgtatctgctaaactgagattcctattgaattttacatggaatgccaagaattcaacaaactaaacactaacaaaacaaagacaaaagtaaccgcacaaacctcgattctctttagctatttagagtggttttatttctgttctcaaagtttaaaattgccctttccatagtacctgaaagttattatttgaaaccagcattaattttattatactgataatacttttttccaaatcaaacactgtttttttttcagtcacaagagataacaggaactcttttaatcctgattcattatagacataattatattccctagcctaaaacataaatataaatgtgttatacaaatccacatggtgtatgaatattagaaattctggcaattctaataatagtttgtattctaattgggcatctaatttttttgtgtatgtcggttgatttgtatttatttttattttttgagagacagggtctcgctctgtcaccctaggctgggctgcagtggcctgatcatagctcactgcagcctcaaactcctaagctcaagggatacttccgccttagcctcccaagtagataggtccacaggtacatgacaccatgccctgctaatttaaaaattttttggagggacagggtcttgctataatatgttgcccaggctggtcttgaaatcctgggcttgagaagagatcctcccactttagcctcttacagtgctgggattacaggtcactgtgcctggccacatcagttgatttttaaaagaataattctataaaaagtatttgtttcagcaagatagcaatcaagaaaacctgaaaatctttctgctacaaatccttacaaatagcaagataaaatataaatgtaaaacattattttaatgaacaagcacattaaaaggcagaaaggaaatccacagtgtcagaaacaaagaaagataaggaactttcattagtgggtcagggaccacagttgccctggagagcttcctgtgaggatttttaaacactgccttgggatagaaaaatgaaccccccacagaaagggaattaaaagtgagactaaaactccaccccctgcataatgttaaaatttttgtttgttttcttgagacagggtctcactctgttacccaggctggagtacagtggtgcaatcatggcttaccacagccttgacctcccagggctcagatgatcctcccacctcagcctcccaacaggcctgtgccatcacacctggctaatttttgtaatttgttagtagacatgggatttcgccatgttgcccagactggtcttcaactcctgagctgaagtgattcacccgctttggcctcctaaagtggtggcattacaggcatgagccaccatgcctggccaatgctaaaattcctattgaaagaacagactagaaaaatgtctgcctactggcataggaaaacagcaaggaattttgtctgtttctactgggctctgaagagggggaaaaaagtcttacctcaaaattcaaagtaagatttatgtgcctaatttcggtttgggatttaaggttgaggttcaaattttaagaaattaacataaaaattgttcaggagctagtgttatttgaataaagcaaaagtaaaatcctctctggaaggaaggttctaggtacaatggagcaagcacattccactctatcttttccactgaaagtagcaataaaacctggagagatgggtagtgtagttatttaaggatattcatagttatttactttgaaaagtaaatagaaacaggcatactgatgaagactgaatttgaatgacagcaaaactggcagattaaaacaagacccagagtcttattaaaaaaaaaaaaaaaaacctaatgaaaatgttcaggatacaaccccaaattattcagcatatgaaaaaccaggaaagacaaccaacaaacatcaatgatgagatgacacagatgtctggaattatttaagggctttaaagctagataaaatgctcatcagccaggcctggtggcacatgcctgtagtcccagctacttgaaaggctgaggcaggaggatcgcttgagcccaggagtttgggactagcctgggcaacttagcaaagccccatctctataaaaaaaaaaaaaaaaaaaaaaaatttaaaaattagccaggcacacattggtgtgcacctgtaattgtcctagctactagggaggctgaggagggaggcccacttgagcccaggagttcaagcctgcagtgagctatgattgtaccactgtactccagcctaggtaacagaacacaagaccctgagggacagaggaaggaaggaagaattaagaatgaaggggataaagggactggtctaaattgtgtcaaatagaatgccatagagatagcaaaaataacaaaggagagacaatagataaaaggaaaaaagttgaaaattttgtagaattataaaaaacattctgaattaaatacaaataaaacatatcaaaatttgtgggatgtgactatagcagtgcttaaaaggaaaggtatgacattatttatattagaagagaaaatatctcaaatcaataatctaaactactactttaagaaactagaaaaaggaaattaaactcaaagcaagtaaaaggaaggaaataataaaaaacataataaaatcagcagaaaaacaaaaaaaccacaatgaaacaaaatggtgtttctttgaaaagatcgataaagttaaaaaagcctctaggtagattcactaacaaaaagagagcaaacaaaatttccaatatcaggaatgaaagaggacatcaactacaggttctataaacagtaaaatataataaaatgctatcagtaactgtatgctcatgaaaccaaaaacagatgaaatgagcaaattctttcctaggtacaaactaccaaaggttactcaaggaaaaatcgatgggtattttaactcttaaagaaataaaatctgctctagtttaaaaagcttccaacaaaggcaactgtggccccacatggcttcagtggtacactcttccttttctctttttaagaagagtttggttagcattatttcagccttaaatatttagaaatcgtctccatcttcagcaaaacaaaaaaacaaaaaaacaaactttcctgttctaaaagagtgaagagtttacaacaattttatgaagtaggggaaaaagaaaaagagcagagacggttaaagaggccaaaactagctagttctgtgaagcaccacctccaccttgtggcccttcatggaactgttgctgaaaacactaaaacacactgagttgaacttcaaggcacaaatttgacctcttattagtagtgtttctgaattcccgacaaataccaaccttcaggattcaaaaacaatgaattggaattctctggaattccccaaatctacattattcttttaaaaaagttattaaatacatttttcaaactctattcattacatgtgtatcttttttttttgagacggcgtctcactctgtcacccaggttggcgtgccactgcgtgatctcagcctactgcaacctccacctcccaggttcaagcaattctcctgtctcagcctcccaagtagctgggattacaggcatgtgccaccacacccagctaatttttttgtatttttagtagagatgtgtttcaccatactggccaagctggtctcgaactcctgaccttgtgatctacccgcttcggcctcccaaagtgctgggattataggtgtgagccaccgcatccagcctacatgtgtatctttaaaacaaatcatttaattagtatttgtaagagctgaggcctatagtgaatattcaaatgctagactgcatgtgggtattactgggtagtatgtgaataatgtcacgtttagaactcagcaaggtttacagtactatgcagaatcacatgttaataaaaatgccaatataaggattttgcttcaaaatctttcttggaacaccaatcaatttttattaagtataccatgtgtaaactcattattatttacttagcagcagacagggccatgaacacacataaaacggcgatatttataatgaggactgatttgtaatcacttctttccaaggagctcctgttgaccttaacctttgattccaggtatcagtatttccagtttttactttcaacttgccctaagtagattccttcaaatcagtaatgtttctgtgttgttaaaattaattctaataagacaattagaataatgttttccatttattaaacttcttgactaatttttttcagaattcaaaaaaaacacacatttcccaagaaatgctaggaagaaattcctgcatgaaaacgcctggtcttttatcaagcactaagatctggaagtttcctacctttgtgaatgtaaagaaaaagacaaatggctggacgtcaatgatagcaattacaagatactattaattgtaaggagcttcagagattgttaacgcaaaagaaatctgcatcttattactctgtcaatcatctaccatattttttgagcacctactatgtatgtgctcagtaaagctaacttgagttataactcccttaaatcaagttgctcgaatttcagatgctatggaaaatacattaaccacctggtacagatgacactttatattctagtcaccaacaatttatctgcctttctcctttcgaagaggaccctgatattgttcaggtattttcccttaccacatatccatgtggaacgagttggtgagggagaccaactaactggacttggctggctgggtgcgcggtggctcatgcctataatcccagcactttgggtggccaaggcaggcagattgcccgaggtcaggagttcgagaccagcctggctaacatggcaaaaccccgtctctactaaaaatacaaaaattagccgggcatggcagcagatgcctgtaatcccagctacttgggaggctgaggcaggagaatcgcttgaacctgggaggtggaggtaacagtgagtcaagattgcaccactgcactccagcctgggcgacagagcaacactctgtctccaaaaaataaataaataaataaataaataactggacttggccactttccttgacagtggctgacgagatagaagaggaagttgttgaggtgcttagagaaaggttgttgctggagatatatagaataaatcaatcctcttccactcccagaatgctgttctgactctgatgtctagaactgcagcaaacatcttaccgccctgagaagagctaagcctctcactcagaatagcagggcaaaagataaaacaaccccacccccaccctccaacacacacacacacacacacacacacacacacacacacacacacacactaaaaccaccccacccccacccacccacacacacacacacgttcctgatgacactgagcagctgaattttctaatcctgaaaactgctctaccacaggtgtaccttcttattgagagatttgttaatgtaaaagagttaattttcctttttgttcaagtcagttaatttttcgatgaattttgttaaaggcatcttaataattaccctaaatgatcagcaatggcaggccatcaggctttgtattcctcttaaagaggccaccagcaaggtttttaacaggcatgccaaggcttttccccagatggtgttttgagtacccctgatttaactgaagggggtatgtgctacttcagcaagaagtcagagagcaaagcctttagttttacaaagaacaagaaataaactggcctacctacagttgtgcaggtcatcaattgaaagaaaaaataagtcaaccttttcagcatcagatcattaaaccagcgactaatacaaccaaaggttgtcccatatggttccagtaaaaaggaaaaggcctatttatgttcatatctaagaaaaaagttatttttaaactgatgcttaagagcaattaagagacactttagtagtcccaaattcccagccagtaccacaaacaacgccttaaagtcctccagacaaccttctctttgagaaagagagagaaccccacagtgatatgacaccgaatgtcttctttttgtattcagctaaaataaagagtcttgtttttcctaagcatggatacaagacaaatccattcaactgtctactaaggcttataggtatataagggtttcctgagaacttgctcttgctgatgatagaataatactggcaacagtgagcaaggccgcactctcctcgagaaacaaagctgattacaggaggcacagggcttcctttgtctcctgtactaccttctctcagcctcatcagttagtctccttctcacagtctatcctgggactctggaggtaaacaagctgttcagataccaacaaattacaagggtgtacttctgtgtccctgttgatttgcacattcacagcaatttttcttattgagttctaggtgctatttatagcacaacaccccacatataaagataaaatgtgttactgaataacactgaccatttaactctaaatcctacatgaataactccattctttcaaagacttggaaaatgtaccgatcttcactatggccaagcaaatgcctttcttcagtttaggacaagctgtcaattagctttaaataagaaatgaaactggtgtcaaaaagttccagtgttttctgtgctgaccagccattttatatataaaaattagtgctgagataatgtaaattgataaattggaggctgaaattaagtccaaatcgggcggccgggtgtggtggctcatgtctgtaacccagcactttgggaagctgaggcagaaggatcatttgagcccaggagtttaagaccagtctgagcatacagcaagaccaagtctctataaaaaattaaaaataaagaagtccaaatcatttcacctaaccatgcttcttaccaattttcctgcctctagttccacatatgctattcccacccccaaatccattctccagaatgcagctagagtagaaatgttaaagtgtcacttctaacttagatcctattcaaatgacaaagttcaaattctagctgggacattccacgtaactcttcatgatctggcctctggtctgtctcccttctggcctttcaccagtcttcatctggctaactcctactcatcccttaggatgatctttccaagggtggattagggactaggttagcagagagaggcgacagttaagagcactggctctaggttcaaattctagctcttccaagttcttttttttcttttcttcttttttttgagacagagtctcgctctgtcacccaggctggagtgcaatggccacaatctcagctcattgcaacctctgcctccttggttcaagtgattctcctgcctcagcctctcgagtagctgggattataggagtgtgccaccatgcctggctgatttttctatttttagtagagatggggtttcaccatgttggccaggctggtctcaaactcctgacctcaggtgatctgcccacctcggccttcccaaagtgctgggattacaggcattagccaacatgcccaaccttccaatttcttttctttttttttttttttttttgagacgaagtttcactcttgttgcccaggctggagcgcaatggtgcgatctcagctcactgtaacctccgcctcccgggttcaagcgattctcctgcctcagcctcccaagtagatgggattacaggtgcccgccaccacactcagctaatttttgtatatttagtaaagatggggtttcaccatgttgaccaggctggtcttgaacttctgaactcaggtgatccaccctccttggcctcccaaagtgttgggactacaggcatgagccactgcgcccggccctggccttccaatttctaaccctgtgactttgggtaaggtaaattacatctccaggcctcagcttactcacctgtaaaactaggttaacaaaagcaactaccatgtagagttattctgagaataacagaatactggtaaagtctttaacacagtaagaacttagtattactattatttttattacgtatctcatttttgagctgcctataaaccttatcacagcactcatcgtcctatattacaactggctattagtctcccctgacacctaacaattggttttcaactgctctccttgccgccctcctaccaataccaccacacatacctagcatacctgagagctacaacttatttctattaataactgtggcccactctggcaagtgattctcaaggagtggtcacctctggttgagaattatttagttcaactattggttcttgactggggatgattttgcctcccaggaaacatgtggcaatgactagagacatttttggttgttgtaaccggagggaaacactactggtatctagtggttaacagctgaggatgctgctaaacattccacagtgcagagaacagtccctgtaaaataaagaattatgtggcctaaatggcaatggtgcaaaggtggagaaagtctgaactagatagtaagttcaggaattttatcactggcatcaaatgcaacatccggtaaattagaagcatttcataaatgttgcatgaaaaaaatgagcttgttattactgtcatttgagatagagtctcactctgtcgtccaggctggagtgcagtggcgtgatctcagctcactgcaacctctgcctcccagttcaagcaattctcctgcctcagcctcccaagtagctgggattacaggtgtctgctaccacatctggctaatatttctatatttagtagagatgaggtgtcactatgtttgccaggctggtctcgaactcctgacttcaagtgatccgcctgcctcagcctcccaaagtactgggattacaggcatgagccactgcgcttggtggaagaaaaatgagcttgtaattccagcatattctgtagtaatttaagctactacaatccagtatgtatggagacacatagaaagtaactattccccggccggccttggtggctcacgcctgtaatcctagcactttgggaggctgaggcgagtggttcacgaggtcaggagttcaagaccagcctggccaacacagtgaaatcccgtctcttactaaaaatacaaaaattagccaggtgtgttggcaagcgcctgtaatcccagctatgcagaggctgaggcaggagaatcgcttgaacccgggagttggaggctgcagtgagccaagactgtgccactgcactccagactgggcaacagagctagactccgtctcggggaaaaaaaaaaaacaacagaaaaagaaagtattccccacaggcccattctataaagatcttcaatcataatatttctttcttgatgttttaacaataaacacatcatttacaaaaatcttttctatttaatctcttctactgaaataatgctgcccatcacagaagcaccaattaagaaaaccaaaatatttagtgttctttaactgagaaacctgaaaatgccaccacctacacaccctcttcttagggcagctgagtagatgctggcacctgtatgtatgctttgagctacaattcatcaatcattgaaattcaaatgagtgcagaggtggaaggtggtggagtttcactaagaaatgaaaaaattacaaggccaaatatcattaagagagttgacattcttttctaccaatttataaaggacacagcaagggcaatacacatagccttgttctaagcacctctgttgccccaaattgcaaaatgtcttctatgcttttagataaacaataatgaacttggaagaacatgcaaaagaaacactagaaagtacagctgagaacaagctgaagtcagtcatcatacaggatttaaaaaatggtcaaaacttggaatgcttctttaagaagaataaagcaatctacagacactaattaagactgactttaaaaaatacttaacatttactattctaattagttgttctagggcatatcttccccattagattgtgaacatatctaattcaactttgtattaataaatctagcaaaaattcgatgcctggtatgtaggtgccttaacatatttattgaccgaacagatgaactatatgcagattttttccccatacaaatgcctgttctagtaaggcctgtccttttatatagtaacttacccattttgccttcctctgtatttggtatcttagcaaatcaaattcagtggcacaaggaatgttgtgttcagatcaagcatgtcgaatagcagatctcagtaacatttccattaaaccaaccactccctatccctatcactaccaccagcagcagcagcaccaccaccaccaccaccaccaccaccacccaccacccaccaccaaaaaagggacagaattctcatttcctgcttacttataagtttatcattccttaccttcttcaggggcagctgaagctccttcaggtagtacaggctgtaactctccagtttcagaattattttccaaatcagtcatctgcagtccttccagatgacctcctttagcattagccctcaaagaagaaaacaacttgatatttctctataactagtgacacaataatctatattttctttttgaactgagcaccaaactaagtagggtacgtgctctggtgcttaatactaaatttcaaattttatctgaaaatatttcactaaggtcctggcacagtggcttatgcctgtaatcccagcactttgggaggccaaggtgggtggatcacctgaggtaggagttcaagaccagcctggccaagatggtgaaaccccatctccactaaaaatacaaaaattagccagatatggtggtgggcgcctgtaatcccagctactcgggaggctgaggcagagaatttcttgaacccgggacgtggaggttgcagtgagccgaggttgcaccattgcactccagcctgggcaacagagtgagactctgtctcaaaaaaaaaaaaaatttttttttcactaaatattcacaaaaaaatgttatgaaatggtggattacatcaatgttggtatcctggttgtgatattgtactacagttttgcaaaatgttatcattaggggagaaaaatacacaggatctctctgcattatttcttacaactgaatgtgaacctataattagctcaataaaattttaacttataaataccaatagaagttttaaataatatgttctaatagggaaagacttttgagatatattattattgctattatttgagatagagtctcactctgtcacccaggctagagtgcagtgatgtgatctcagctcactgcaaccgctgcctcctgggctcaagcgattctcctgcctcagcctcccaagtagctgggattacaggtgtccagcaccacgcccggcaatttttgtactttgtttttagtagagacagtgtttcaccatgatggccaggctggctcgaactcctgatctcaagtgatctgcccacctcagcttcccaaagtgctggggttacaggtgtgagccaccgtgcctggcctgagagatattattgaatgagaaaataaagtacatcttctgtattaaaaaagctacatagtcacagttccttaaatatacacaaaaactgagaagacacagcacacatgaaaaattaataacagcatgaatatgtgtgggcagggggttggaaaactaggtcatgggagttaaggatgggaaatttttcacttattcttttctcctttcattttgaaacacttatcattagtatttaatatttatttttatttaaaaaataaacagaggcaaggtcttgctatgttgcctagggtgttctcaaactcctgggctcaggccatcttcccacctcagcctccaaaagtgctgggattacaggtgtgtgccactgtgcccagcctttcattagtatttaaactttttgcttacactactttaaatcaggcaggaaaaaaaaagacatgagctggacagcacctacatgaaccaggctggcagataaaatcaactgcaaaatgaggatcaagctgcacacacttgcacaggattttacactctagaaaaaaaaaaactaagttcatgtatatttaattgtggtgactaaaggcagataaaaatatctccatagcaaataaaatataagagctagttgcactttaatttgaagaaatgtataaaacatcaggttaggtagtacgtagggaagacaagataatctccagtgattttaacacctttctactactgaaacttgagccagaaagctaaaccaccagctgatcttgtagttttggtaatgagccagaccttgactatataaaattaagtaaacttaaagggtgttaatctttctccaatttaggtaaaattcttttcagggtctccaaaatagaactatttcattgtttaaatttagaaataggtttaatatccataaaatagataagcagatggatattaatggctaatcatctgccacatccatagccaatatccataatcactctatcttttgaatagatggaagtttaattgccatgccggggatttgagtttatgtctcctaggggagagataaacgtgttaactactatatatctttttgggaaattccaactataagttttgaggatactttgataacaggagagaagaaagatgagataaaagcagaaaagcagtgttaaagttgctgtaagtgctttgtttcatacaaaatatatataaatgcctgtgacacataatatagcccaacactaacatctttgacaagtgtaggatagactgaaaaaaaaaaaaaaggctgaccgcccccctaccgccaacacatacaaatttacaaggcagagttcagataaggttacgtatcattgtgaaaatgagctctaacatatttaaactaaacttccggtactatttcatcccattaaaaaaagtactatctcttgagaccatggtgaaaccccatctctactaaaaataccaaaaaaaaaaaaaaatcagctgggcgtggtggtgggcgcctgtagtcctggctacttggagaggctgaggtaggagaatggcatgaacctgggaggcggagcgtgcagtgagctgagatcatgccactgcactccagcctgggcaacagagcgagactccatctcaaaaaaaaaaaaagtactatctcatcccattaaaaaaaaaaaagtaaaatctctgatactttaaaaaagttaaaatttaggccaggtgcagtggctcacgcctgtaatcccaacactctgggaggctgaggtgggcgtatcacttgaggtctcaggagttcaagaccagcctggccaacatggcaaaacctcgtctctactaaaaatacaaaaattagcagggtgtggtggcgggcacctgtaatcccagctacttgggaggctgaggcaggagaatcacttaaaccggggaggcagaggttgcagagagctgagatcacgccactgcactccagcctgggtgacagagcgaggctctgttaaaaaaaataaaaaaaattaaaaaagttaaaatttagtgcaataaatgtattttctgtccactaaaaaattaacaaggtagaaattaatttgttcatcatgatgcatacttaaagttccaaacaaagctattagctattataccattacatatacaaaacaacttaatttaccccaaggtgaccattttcctccttttctcaaccgcaggcaagccactgaaaactgcaaccacaacagcatctgaatccaaagctttacactgccggtcttcagtttttggcagaatatcaccgatactgccatgtatcaaggctcggggagaactgtgcctgctcccagactgagagcttcctggggagccttcaaaaaaaggaagatggaatacaaaaattagctgggcatggtggtgtgcgcctgtaatcccagctacttgggaggttgaaacacaaggatcacttgaacctgggaggcggaggttgcagtgagctgagattgtgctacactccagcctggacaacagagcaagactctgtctccaaaaaataaaataaaataaaataaaaggagggataatcagaaaaaaggcaaataaacatgaaaggtctctctcagttacattagaaaatctcactatatatatcattttaaaactacataaaaacttcaaaaataggccaggtgtggtggctcatgcctgtaatcctggcactctgggaggctaaggcggatggatcacctgaggtcaggagttcaagaccagcctggccaatgtggtgaaaccccatctctactacaaatacaaaaattagccaggcgtggtggcgtgcacttgtagtcccagttactcaggagactgaggcaggagaatcacttgaacacggcgggcggaggttgcggtgagccgagatcgcaccattgcactccagcctgggcaactagaggaaaaaactccatctcaaaaaaaaaaaaaaaaaaacttcaaaaataattttgaaacatatcccttgttttttatgccaagcatctaaaattaaggagtccaggccaagtgttgtggctcacacctgtaattttacactttgggaggctgagacaggaagattgtttgagcccaaaagttcaagaccagcctggacaatgtagcaaaaccctgtctcggcaaaaaaaaaaaaaaaaaaaaaaaaaaaaaaagccaggtatggctgcatgtgtctgtgtctgtggtcccagctacttgggaggctgaggtggaaggatcacttttgtctgggaggtcaaggctacagtgagctatgattgcaccactgcatccctagcctggaaaacagagcaagactctgtctcaggaaaacaacaaaaataaagaataaataaaattaaggtgtttagaatacatagtctaatggctgtattttgttaagggtctgttctgttgagatcaagaaactttccagccaggtgtggtggggctcattcctgtaatccgagcactttgggaggttgaggcaggcggattgcttgagctcaggagtttaagaccagcctgggcaacctgtctctacaaaaaatacaaaaattagctaggcgtagtggtgcacacctgtagtcccagctacttggtggggctgaggcaggaggatctcttaaaccaccggtcgaggccacggtgagccaagatcgcaccactgcactccagcctgggtgacaaagtgagaccctgtttcaaaaaaagaaactttcaaatccaactttagcatttttggtgcccttcaagatctaaagctccacgataacatcaatttcaggtaataaatatttaccccactaaaagtacattctgaatccctcaaatttaccttcagacagagtctgacagtctccctttgaacgactattttctccagggtccactgctcttcgaagtgatagactacctgctacactggatcgagctggcttgggcgaattactcttcttatttgtggctgcaaagacatttaagaacacctctgaataggctactacagcacaaaactcactatttagtctgtcagaaaaagttttaatcttaccttgcatggaagctgttctctctactgtctaaaaataaacaacattctgtagccccaattggtttagacttttgtcataaaacattcccatcttgttgcttgtagagcagaatcttttttttttttcccccagatggagtcttgctcttgttgcccaggctggagtgcaatggagcgatcttggctcactacaacctccacctcctgggttcaagcaattctcctgcctcagcctcccgagtagctcagattacaggcactcgccaccatgcccagctaatttttgtatttttagtagagacggggttttgtcatgttggccaggctgggtctcgaacacctgaactcaggtgatccacctgccgcggcctcccaaaatgctgggattacaggcatgggccaccgcacaccgcccgtaaaatcttaacttaaaagattatctgtgagctccttaagaaaaatcatacaaatttcaatgcagttaaactattaacaaatatataacccgtcaaacatttggaaattataaagtattattggattaaaaagaaaaatcaatgctgagttagaaacaaattacaattatggtacttgaaatcaaaatgtctgtggccaaaccagtagtgaaaagaaaatgtacggccttaaaatgaattaattagggaaaaaagggactatatgacctaatatgcatagattcaaaagctaggaagacaataaaaataagcaagcaagaatgctattgccagaaggcagggccctgcccttgaattcagcctgcagaactgtgagttaaataaatctcttttaaaaatacattttaaaaaaagaataaaaataaaattgtaaaaaacaataaaaataaaaaattcattaataggtaataaacaggtttagcatggttgcaggatataagacaaaataacttattgtatttctctgcactagcagacaatgtgagaatgaagttaagaaaacaatttcatttttaatagcataaaatacaattaaaatacttaggaatttatttaacaaaagaaatgtgagacttgtccactgaaaactaccacacattcttgaaagaaaatagagacaacagcaaagacatcctgtgttcatcactgattagaatacttaatactgttaacaaagcaatattcttaaaattgatctaccgattcaacacaatttctaaaataatagtagctgtgtttttttttttttgcagaaattgacaagctaatcctaaaatccatttgaaaatgtaagagacccacaatacccaaaacaatcttaaatggaacactcacttctgatttcaaaagttactataactaagtaatcaagactatgtggtactgccatatacacatatatatcatcaaaacagaattgagagtctagaaacaaacccttatatttatggtccactgatttttgacaaggatgccaagacaatgcaatgggcaaggaaaaaaagagggacaataagtgttgccaacggtatggaaaacctggagccctcatatactgctgctgggaatataaaatgatgcagctactttggaaaatagtctggcactggtagttcctcaaaaagttaaacacagttgccatgtaacccattaattccacttctaagcatatactcaaacaaaaccatatgtccaaacaaaaacttgtacatgaacgttcatagcagcactactgataatagccaaaaagtaaaaacaacccaaatatccatcaactaatgagtggataaacagtatgtagtacagccatacaataaaatatcatgcagacataaaaaggaatatatgccacaacatgaatgaaccttgaaagggctgtgttaagtgaaataagccagacatagaagacctcatatggtatgagtctatataaaaagtccaggctgggcgcagtggctcacatctgtaatcccagcactttgggaggctgaggtgggtggcgcatgaggtcaagagattgagaccaacctggccaacatggtgaaacctcgtctctactaaaaatacaaaagttagctgggcatggtggcgcacacctgtagtcccagctacttgggaggctgaggcaggagaatggcgtgaacccgggaagcggagcttgcagtgagccgagattgtgccactacgctccagcctgggtaacagggagagactccgtctcaaaaaaaaaaaagtccagaagaagaaaaatccatagggaaaaagtagattagtggttaccagaagatagtagaaggggaagatggggaacgacttttaatgggtttggagttctagggagagggttaatgaaaatgttcttagacttagataaatgttctagacttacgaaaaatgatgaccaatttctccactaaaaggataaatgaattattggttaaggaaaaaagaatgcattaacagtctgggtgcggtggctcatgccagtaatcccagcacttcaggaggccaaagtgggtggattacctgaggtcaggagttcgagaccagcctggccagcatggtgaaaccccatctctactaaaaatacaaaaattagcccggtgtggtggcacacacctgtaatcccagctactcaggaggctgaggtaggagaagtgcttgagcccaagagacggaggttgcagtgagccaagatcacgccactgcactccagcctggtggacagagcgagactctgtctcaaaaaaaaaaaaaaaaaaaaaaaaaaaaaagcattaacaaagacaaaagcagaaatataatgaaatggtaaaagacaatggatgaaataaatctaagaacttggtctttgaggagatgaacaaaattagcaaatcccttgagcaggtcaaatcaaaggagaaaaaaaaacagaagtaagcaataaaataagtgaaaaagaagttaacaacccatatgcacaagaagttttaaaaatttaagaaaatagaataaatgactgtatatcaataaatttaaagacccaaatataattagtttttcttggaaaactatagtaactgacttaagtagcagcagaagtatgagaaaactacatctgacaagagattaatgaccaggatctcaaacaactctataggaaaaaattcaataatctgattaaaaatgggtaaaaatctgaatagatatttcttaaaagacgacacacaaatagcaaacaggcatatgaaaaagtgctcaacatcactgatcatcagagaaatgcaaatcaaaactacaataagataccatctcatcccagttaaaatggcttttatccaaaacacaggcaataacaaatgctggtgaagatgtagagaaaaggcaactctcatacaccattggtgggaatgtaagttagtaaaaccactacggaaaacagtttggaggttcctcagaaaaactaaaaatagatctaccatatgatccagcaatcccactgctggttatatacccaaaagaaagcaaattagtatgtcaaagaggtatctgcattcccatgtttactacagcattattcacaataaccatggtttggaagcaacctaagatccacagacaaatggataaagaaaatgttaggttgggcgtggtagctcacgcccgtaatctcagcactttgtaagcccgactcaagtggatcatttgaggtcaggagtttgagaccagcctgaccaacaaggtgaaaccccatctctactaaaaaatacaaaaaaattagctgggcgtggtggcgcatgcctgtagtcgcagctagctgggaggccgaggcaggagaatgacttgaatccaggaggcagaggttgcagtgagccgagattgcaccactgcactccagcctgggcaacagagtgagactctatctcaaaaaacaaaaaaaaaatgtggtacatatacacatggaatactattcagccataaaaaaggaatgagatcctgtcatttgcaacaacatgggtggaactggagatcgttatgttaagtgaaatacatcaggcacagaaagacaaacttcacacattctcacttatttgtgggggctaaaaattaaaacaactgaactcaagataatacagcaatggttaccagaggctagggagtgtagtgggtggctggggggatggttaatgggtacaaaaatatagttagatagaatgaataagatctagtattcgttagtacaacagtgactacagtctacaataatttattgtacttctgaaaataactaaaagagtacaattggattgttttaacacaaaggataaatgcttgagatgatggatactccatttaccctgatgtgattattatgcattgtaagcgtgtatcaaaatatctcatatatcctataaatatatatacctacaatgtacccacaaaaattaaaaattaaaaaaattaaaaatatgaggaaaccaacaaatccaacagaaattaaaaaggctgttaaagttctaactctgagttactatactagttttatgaatgctttttattagacataaagtttaatacagcataggagcaaataacatatagttaaaataattttatagcatagaaaaggacaaaaacatctgaatttaatctgtaaaacaagcacagaattagaactaaagtgggttaaggatagtgtaatgaaatagatcgatttcacttatgactatgtagtcaaggatcctaagtaaaatattagcaaactgaatacagcagtgtttttttaaaaaaagtataggcccaaactaaataggatgcattccagtatttccagaatggtcaacattagaaaaataatataatttactttatgataacaaagtaatggaacaaaatagtaaatcattttgacaaatgtcaaaacatcatttgatataattctacacagcttcagtttaaaaagaaaagaaattctcgtagtaagaaaagaggcagtttggtattagggtgaagggcataggctctgaagttcaagtttttggctttgccaattaccaatgtgaaactagcaacattattcaatgcctgctgccttggtttcctcatctgtaaatctggaatgaaattgacttaccttacctcttagacttcttgttaagattaagtgagtcaatgcatgtgacttagaatagttagaataatgtctggcacacagttaacacttagtaaatgttagccattattggtattgttgttactaaacaggtttagtaacctttagttactaaatttctttagtaagaaatacagatgtacaataaaaatatgaaaagatattcggcctcacctgctattcaaggaaatggtatattaaaccaaatggtatattaaaaccaaaagtacagctttttgggtgaactttctcaaaaagcctttgttacatattttgcagatacagttgacgcttgaacagcacaggcttgttgtactgtacaggtccacttaatattcgaatttttttcaaccagagaaagattgaatatattactatactatactatagaatctattactataaatagaaggatgtaccttttaacttttttatttatttatttatttatttttgagacagtctcacttgtcacctaggctggagtgtggtggcgcaatcttggctcactgcaacctccacctcctgggttcaagcgattctagtggcttggcctcctgagtagctgggattacaggcatatgccatcatgcccaggtaatttttttgtatttttagtagacatggggtttctccatgttggccaggctggtctcgaactcctggcctcaagtaatctgcacgacttggcctcccaaagtgctgggattacaggcgtgagccattgcacacagcttttttaacttgatagaaacaggcctgtaatctttgggaggccaagacaggcagatcacgaggtcaggagatcaagaccatcctggctaacatggtgaaaccccgtctctactaaaaaatacaaaaaaattagccaggcgtggtggcaggcacctgtagtcccagctactcgggaggctgaggctggagaatagcatgaacccaggaggcggagcttgcagtaagccgagatagagctactgtaccctagcctgggtgacagagcaagactctgtctcaaaaaaaagaaacacaaaaacaaaaaagtacctattgaaacatacagcaaacctcaaatttaatgagaaaaaaactaaaggaattcctaaataaagttgaaaaattataaaaatcctaccactgttactaagaaactgttgaggtacctgcctagacaatgcaatacaaaaagtaagcagaaaatgaataaacaaattatgattatctgctgatgatataaatacttagaaaatcaaaataactaattgaaaaactgttaataaaacaaattcaccaggccaggtgtggtggctcacgcttgtaatcccagcactttgggaggccgaggtgggtggatcacctgaggtcaggagttcaagaccagcctgacgaatatgatgaaaccccgtctctactaaaaatacaaaaactagccgggcgtggtggcatgtgcctctaatcccagctacttgggaggctgacaaagaagaatcacttgaacccaggagggggaggttgcagtgagccgagatcgccccatcgcactccaggctgggcaacaagagtgaaattccgtatcaaaaaaaaaaaaaaaaaaaaaaaaattgccacattggttgaatacagaataaacataaaaatcaatatttttgtcttttatgtcagtaacaattagaaaatactatcagagaaaaagagattccactcacaacagctacctaagatataatacattgagaaatgaatttaacaagacatatatagaacttatatggaaaaaactgagagttctaaaaaaggatatgaatataacagatgacctgaataaatggagagaagtaccacattcctagacatgaatgtttgatgctgaaaagatctcaattgcccaaattagtctctctttttttaagagagagagagagactgttgcccagattggagtgcagtggcacgatcacggctcactgcacctcaaattcctgacctcaagtaatcctcccacctcagcctcccaagtagctggggttacaggtacataccaccatgactggcttatcaaaaaaatttatttttgtagagattaaggtcttgccatatgatgttgaactcctgggctcaagaagccatcctccctcatcagcatcccaaaatgctgggattaacaggcaggagccatggtgcccagcacccctaaactagtctttaaatgtaaagcaattccagtcaaaatactttggaggaggattaaaagtgcaagaaccaccaataacattttgaaaaccaagaacagaataaacatatcctatcatagtattacaaactataaaactacagtagttaaaaaaagtgttagtctggtagaggacatgacaaatactgggttaaacaataccaaattgcgtttttgtatgtccaaaacttgagtactggcaatttcagttgtttcgacctctatgagttcaaaaacagaaccatgtttgggaatctggtctataataaaggatggatttcatattgcatcatatttcaaaaaacatgtttcattcatttggggaaaaacatcattccatttacctcacacagcatcatataaaattaactttatatgaattaatgacctatatgtaaaaaagttagaaaacaaaaagtaccagaagaaattaagggttatttttattaacctgggagttaaaaagccttccaaataaaaataagacccatgaatattattgccatgaatattattattaattataatattattaatattcatgtcatgaatgttaattatattattaatattcatggatgaatattattaatacagttgtctaagataaaattttaaaactctgtgattagcaggaaaaaaaggtggcaatggggaagagacagttgtcccttggtatatgtgggggttggttccaggacccctgcgtatactaaaatcctcgactgaagtcccaccgtaagacctgcagaacccacctatacgaaagttggccctcctatatgcaggtttggcatcacccgaatactgtattttcaatctttctctggttgaaaaaaattcgaatattaagtggacctgtacagtacaacaagcctgtgctgttcaagggtcaactgtatctgcaaaatatgtaacaaaggctttttgagaaagtccacccaaaaagctgtacttttggttttaatataccatttggtttaatataccatttccttgaatagcaggtgaggccgaatatcttttcatatttttattgtacatctgtatttcttatgttaatggcctattcataacctttattcattctactaaattgtcttccttatattaagagaattctatatattttgctattatctcctcaccaacccatctttattggattattcacatcactatcaaacattaatacagccaattttaataaacaacacacacaaagagaacccagaaacaaaccctcgtctatatggtcaaatgatttcaacaatggtgctaaaaccattcaatgaggaaagaaaagtcttttcaacaaatagtgctgggaaaactggatatccatgggcaagcaagtcagacccttccctgacaccataaacaaaatttaattcttaatggatgaaagactaaaagtaagactaaaagcaagaactaaaactcttggaagaaaacaggagaaagcttcatgacactggattaggcaatgttttcttggctatgacaccaaaagcacagggaacaaaaggaaaaacacataaaatgggcttcttcaaattaaaaacttcaaatgttaaatgacacaatccacagagggaaaaggcaacccacacactgggagaaaacatctgcaaatcatatatgtgataaaagataaatatttaaaatatatacagaactcctaaaagtcaactacaaataaacaacccaacccaattttaaaatggatttaattcacagatgaaagacattggagaggacacaaaaaaggacacccctgccaacaagaaactattgaccccgcacctcctccagcttctacccacttcattgtgaaacttcttttaaagaagttgtgcatttgtgctctggtccctgacctcattcactcttctgctacactactccatgggaatagttcttaaaaaggccacttggcctcttgccttgacacttctcagtgatacttaacacacttaacacaggggtaaccactctacttcttgagatgcattatttttgatttttgagatattatcccttctagtttttctcctaccttaatgattgctctttcaatttcctttgctggcctctcctatttatcagatctttaaatgtttaagtgccacagagtcaaaaattttgcttctccattgaaactccctccaaacttgaccctattcagtcttctggatttaaataatataaaatactattgactcccaactgtttatatccagcattgacctctctctgagtttcaaagttgtgtaccattcacgtgtctatgacattttactaggatatctagcaggtgtctcaaattaaacatgtttaaaaaagaatacccaactttctgcccttacctcctcccaagccccataacctgcttcttatctgatttgcttctcaataaatgataccactgcctattaagttgcttaggccaaaacttaatcataattcttagtttctttctaaatagaactttcctaaaattctatttaggctttttcaactatggttctgagaaagaactcagccctgctgatctaagactggattaacttccctcctatgcatctagaatagaatagcacatccttaagagaactaagaaagatgggaacctcagtcaagaaaggctgctagactgtgaacaagcccctctatccattattgtaactccagaaaatgccatcatatttcacacaagataatgtaataggctgttactggtctcacaattcctgtcctcaacccttttcagacccttctccacacaacaagcaaagtcatctttgtaaagtgtaaatcagattataaacaccccttatttttattctctagaggcttcctccttacatcataataaaactcgaactcctttttgaggttttgcaagactctccctgatctaaattctgcctacctctctctgacttcgtctcctgctagtctcctctctctgctttctttgccatactggtcttccttcaatccttcaaatacgcaaaataaatcctgtgtcagtgactttgcagtttctgttctgtttacccagaacactgcttgccctagatctataaatagctgccaccttcctaaacttcaggtctcaggtcaagtgctgcctcctcacagagactttctctgactaccccaatagaacatgtctcatctgctcctcccatcccactcctcggttgtttccttcacagcaccttttacccactgaaatgatctttacttacttgtctacactttttaatgtctgattcccactactagaatacaagatctatgatgttaagaattttgtcttgtttattgccaaatacagagtaagcaatcaagaaatgttagttctattatatagtaaaaatatacggaatcaattttggatgaagaaaaaagtcacatgtaatttgtagtcttaactcactggaagagtggtatttaaatattattcttttgaaaaaaccagtcatctagtttcccaaataacgtgtggagaaatgacactgggaacatattacttacagtttcgtatgtaacaattggcaactgatgactttgccaggagttccattcccaaatcctgcaatctgccagagttttcagttccacatgcagccagagctgcctggtcagcagaaaaaaggcttgtctgcatgtctccagaagcagcactgctgctttttatttctgaaagtgtattctttacatcagttttcatacatcgaacttcggccatttgagttttgagtctttttagcatctttaaatcagagggcactcgccacattgcctgttgcttcctttggtctttatcttttcgagaatatgatgcttcagagaaattgacaagtcatgttaacataaacgttaatattaatgaaatcatttgtaccatgaatatatgcaaatttgatgtgtaaaataagctagcgtgctttacgtggtatcaacaataaaacatgcactaaattccattaatgaaaataaagataaagaatcctaccttattcacaccttcagagttagaatctgagtcacatcatactcaagttcgaattacacatttaattctaaaagtttaaaagctgccctactgccttgtgctttcttctttaaacttctccacttttctgaaactttctacagagcttttattatgtttataattgaaaaaaaagacaaagaaaaatctagaaaccaaatactttgtcaaatctgccatatataacattatattaaaaatacatatttctggccaggtgcagtggcttatgcctgtaatcccagcacttcaggaggctgaggtgagagaatcgcttgaggccagaagttcaagatcagccaggggagcatagtgacaccctatctgtacaaaaaaaaatttttttattagaacttccatttctgataattttctcagaactgtcagctttctgaaatacggtttgaatctaaccacttctaaaataaaacaatagctctccatgcctagtatgaataaattcctccggctagcatgcaagtcctttcatagaatggacccaacatgactctagttctacttaccactatatgtaccttaaaatctggttcaactagattacctgataccttttacagtactcctttacatggttaagaacatgaagttaatctgacaaatgttcactaaatatgtgttaaataaatacacagaaaaaaataaacatcaaagcccaagcaggccacgtgcagtggctcacgcctataatcccagcacactttgggaggccgaggcaggtggatcacttgagctcaggagttttgagacaaacctggccaacatggtgaaacctgtctctacaaaaaattgtagagcactccagcctgggcaacagagtgagactctgtctcaaaaacaaacaaacaatcaatcaaacaaaaaatgacccaagcaagccttttcaataaaaagaaagtcatatatttctgcacactagcttttattaacatcccttcactgaaaggtattttcatttggcttccatgagtattttttctcctttctaaaagctctttatctggctcatcttcctgacactcagtaaaaacagatattcatcaggattatgttcctggctctcttcttttaaaatattcttaaaactcctttgcaatctcacacccttggttttaattatccagtatcacctccagaaaaataactgtctgtattccagttcatttttttttttcatggagtttcactcgttgcccaggctggagtgcaatggcacgatctcggctcactgcaacctccgactcccaggtttaagccattctcctgcctcagcttcccaggtagctgggattacaggcacctgccacaatggccggctaattttttgtatttttagtagagacagggtttcaccatgttggctaggctggtctcgaactcctgacctcaggtgatccacccgcctcagcctccccaagtgttgagattacaggcgtgagccactgcgcccagccccagttcttaatttttagctgtctactggtcctttctaatttgatgtcacactgttatgcccaactcaagatgtttaaatccaaaacttgctttttctttctactattttccccgccctcattattgccagcattttatcacctaaatttgaaattcagatcatctcatttgtattgtttttacacagaaaactagttttacacagaaatcttactatttagtttgcatttttcccaatgatactgattattttcaaaaacacgattttacttgtctataaaatataccattgcatggttacactgtaatttattcagctataactgtattgttgaatatttttaaacatctgcttgttttctctttggaatatactcctcaaagtgaaattacaagtttaaaggatatagatatttttaaactactacaaaattgtccttcaaaaaggttaaaccaacttacatatctacctacagaatcagaacctgtctgtttcactgggcctttgcaaacaacacttaacatttaagtaaaactttatataaagcatacttggcgcacacataaaaggcaactgtttcataacctgaagatagtcttttaagctgaggatccagactttcaggaagtatatctggctcttaggaaagaagaagcctaaataatctgggctccatgtccctacaccagtagaagagctctatttctctgttatttacacagaggttctgccttggactttgattgaaaaatgagttatcttgccttaaaactacatcaaaatcagagttctaaatcattgatttgatgtatataatactattgtttaagaaggtagaaaaatatttggcatatatttttgaatatactgactatactttagaaagcattccaacaaaaatggtttttaaaatgtagcttttaaaggcaaatacttagttgtccaaaatgactctatccccgagagtttaaaaaagcccatatttgactatacaaatctccattttattatagtaacacaaatgtaatttctatttaacaaataacctttgcacagaaaacagtgctgccaactggcatacatttttaagctactgaacatcaaagaatgagtaagtcacctttttctacgttcaatttagatatagttccacttggaagtaagggaattcatgaagcctgaccaaaaaaagtccattcataaagaagataaccgtatttcatatggatcaaactgtcaggcaaaatctgagtagcaagtcacaaaaaaccttcttgcaggcatttttactttgtttttgcacaaatcacctttgaacggtaatttaaaaactaatttggttgacataaatgtcatttttatggtatacaatgaaaaacacagaaatacaccatgttccacacatagctgaaatacttaaatgaaaatccaagagttcttttagagaaccacagaaaaaaaggaaattatcattgttattattttacctgtgggctgcagaagtgaagcaggtgggcgaggctgtaagccccacaaattttctatactgctccggtccttaaggtccaacaaatgtattaaaattaatggatcaatgtctagtaaactactggtagcagcggagcataaatgtgttcttcttgatattctactactggaacccacataaccatggctactacctgcaaaagaggcgtagaaaatgatatatatatgcacaaacttagctatacttaaatgaaaaaatgaactggttaacattatatgaatacttgtctatggacctatctcttaggagttcaggttcatgataagaagcagaaagaaggaaccagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaagaaggaaccagacagttgtacattagcacagtgattgagtggtggcctcattagtacttagaattcagaagcaagcctcaaccccatcctgagccctagaaaaaaacagatgacaatgtgtacgatgtgcacaattggggggatgagaggtaagggtaaggagaaggagattatatcccatgaccacctggttttagataaaagaagacaaattcccatagtataacagattacaaagaattagacaccaaaatagaaatctcccccaagtctctggacagtaaaatgtataggtcatgacagtttggtagactttttctactttgattaaataatggggtacaatttgaagtttttggactgtcatgttaatgactgatgcacattacagacatctgtaggcagatattatgcctatacccctatattggactatgctctttaagccaagaaaagcatctgacttttctctagcacctagtataatgcataacaaataccagatatggaaatgttgcttaaaactgaccttcttcaataaagctgtttaaatatattttaaagagatagaacattttaaaacaatgctacacgcaggaaagtagataatataaaatattaaaaagtcaggttccaactacccatgagtatttcagagagatccagcaggatataacttaggaggaaagttccattgttcagaagcttcaagccaattaataatttatgcttttcacatcctcatgttctcactgtctcccacttctgcctcctcttctaaggattattatctcactgacagtttttcttcccagcctctgtattactgcaattcctattaaataacagaaaacgatttccccttcacattgaaaactgttctttgttgtgttttgagacacagtctcactgttgcccaggctggagtgcagcggcccgatctccactcacggcaacctccgcctcctgggttcaagcgattctcctgcctcagcctcccgtagtggggactacaggcatgcaccaccacacctgtattttcagtagatacggggtttcaccgtgttaggatggtctggatctcctaacctagtgatccgcccgcctcagcctcccaaagtgctgggattacaggtgtgagccaccgcacccagctgaaaactgtttttacctcttttcttttactaaggaattcccaaattgggttgtatgtcagtcagctgaaggagtttttaaaattacatcctagatacactgaacaagaatactggggtgagaagctgggtgcagtggctcacgcctgttatcccagcactttgggaggccaaggtgtgcagatcacctgaggtcaagagttagagaccagccttgccaacatggtgaaaccaaaatacaaaagaatagccaggtgtggtggcaggcacctgtaatcccagctactcgggaggctgaggcaggagaattgcttgaacctgggaggcagaggttacagtgagccaagatcacaccactgcactctagtctggttgacagagtgagactccatctcaaaaaaaaaaaaaggatacggaggtgagatccaggactttttcccaaaaagctactcagatcgttcttatgtatagttaagtccagtagcccagtgaatggaatctattgccctaatatctgattctcctttaaaaatgtaagttgctcattcttccatgttaaaggcacttacagtagagaaagcggtgtctcctgtttctcactgctttttcaggccattattctcactactgaacaaaaactgcttttttttttaatgtgggtatgacctttggctactcccctttcaaatgttcccagctttcttttcttttttgtttttttgagacggagtcttgcctcccaggttcaagcaattctcctgcctcagcctccctagtagctgggattacaggcatgcagcaccatgcctggctaattttgtatttttagtagagacggggtttctccatgttggttaggctggccttagaactcccgacctcaggtgattggcccgcctcagcctccgaaagtgctgggattacaggcaggagccatggtgcccggcctatgttcccacctttctacccactatcacatttccccacaggcatcaaagactttgggttggcactgatttcagtttctctctttccaagctattctgtgtgtctcatatataaatgtacatcccaatgaatgctcacaaagtgatcacacccagatgaagaaatatattatcagtaccccagaaccccctcctatgcctcctaaaattgctcactactcctactctacaaaaataaccttcatcctaacttaaattacagatgggttttgcctgttttgtatttgtataaaagtagtaacagagtatgctcttatgctcttcttctttggtcaacattattcatgagattcatctatatggctgtatatagaagtatcttattcattttctttttaaatatttttctttttttctttgagacaaagtcttgctttgtcacccaggctggagtacagtggcacaatcttggctcaccgcaacttccacctcccagtttcaaatgattcttgtgcctcagcctcccgagtagctggggttacaagcgtgcgccattgcaccaagctaattttttctactttcagtagaaatgaggtttcgccatgttggccaggctggtcttgaactcctggcctcaagtgatccacatgcctcagcctcccaaagtgctgggattagagacatgagccactgcctcattttcattattattgtgcagcatccatttatgaatatatccaatttatttctttattctattggaaaacaatttgggttgcttctagcttttggctattaagaataaagctatacagccaggcgcggtggttcacgcctgtaatcccagcactttcagaggccgaggcaggtggattacgaggtcaggagttcaagaccagcctggccacaatggtgaaaccgtctctactaaaaatacaaaaattagctggccgtggtggagggcacctgtaatcccagctactcgggaggctgaggcagaattgcttgaacccaggaggcagaggttgcagtgagctgagatcgtgccactgcattccagcttgggcaacagagcgagattcaaaaaaacaaaaaaacaaaaaaccaaaaaaacaaaaaaacaacaaaaaccatgcttctgaagttcacatagaaaaaaaacctcataaaaagacagacggatcggtgacaggttcttctccatttgtgccaagccatatggatcttgctaaaatgtcacacttatatacttgagttcattacagcatactgcctgtatgcattatcatgacactcaaggccctattatagtctagtctcaaactacctttccagaatattctacattttcacatccttcactttgttacaaattacataccgatatttaccatcacaaaatcttgtaatgatcagtgctggattttcatttaaaaattatgctcattcattcttctaacatctgtggtccaggtgcaatagctcacgcctataatcccaacactttgggaggctgaggcaggaggactaattgaggccaggagttggagaccagccagggcaagagagcaagactccgtctctataaaaaattagttgggcgtggtagcatctgcagacgtcttcttatgagaactgcttttagtttattcagttatttgaagttaaatgaaagacaatttatgttaaaaaaaatttgtgctaaaaaggttttaagtatcattctaatccagattattggctcattgaatccagtgagtaggaaaaatctagtttgtatttgctgggggtgtgtgtgtgtgtgtgtgtgtgtgtgtgtgtgtgtgcacgcgtgtgttttaagagacagggtcttgctctgtcacccaggctggagtacggtggcagaatcatggctcactgtaccctcgaactcctaggctcaagtgatcctacggccacagtctcccaagtagccaggactacagccagttgagtcaataaatatttcttgtttcaagctatctccttatttaatatggtctataaaataagattattaagtaaacatttaactttatacctagcttttatataagcccaatcatcccctttttaacgcataacttaacatcgtaattctttagatcacataactctttagacaattgtgtagttctaaaacattaaccaggccaggtgtggtagctcacatctgtaatcccagcactttgggaggctgaggcgggtggatcacttgaggtcaggagtttgagagcagcctggccagcatggtgaaaccccatctctactaaaaatacaaaaaagttagcttggaatggtggtgcatgcctgtagtcccaactacctgggaggctgaggtaagagaatggcttgaacccgggaggcagaggttgcagtgagccgagatcgtgccattgcactccagcctgggcaatacagcaaggctccatctcaaaaaacaaaacaaaacaaaacaaaaacaaaaaacacataaaccattcgaggcttgaaatggaccttcataataagcatattaaaaaaaagcatttccacactctgcccagtgtcaccccgatctagctttttcattgccttggtttaaaaagctttttattggccaggtgcagtggatcacacctgtaatcccagtactttgggaggccaaggagggcagatcacaagatcaggagatcgagaccatcctggctaacacggtgaaaccccatctctactaaaaatacaaaaaatcagccgggcgtggtggcgggcgcctgtagtcccagctattcgggaggctgaagcaggagaatggggtgaacctgggaggcggagcttgcagtgagccaagatcatgccactgcactccagcccgggcaacagagcaagactctgtctcaaaaaaaaaaaaaaaaaaaaaaaaaaaaaaaaggcttttttaatttttttattttagtatagttttaggtttacaggaaaggtaaaaatacagagagttcctgtacaacccagatccaatttccccaatgttaatacctttcattactatggtatatttgtcacaactaatgaaccaatactgatatattattaactaaatcctatactttattgagattttagtagttttcccctaatgttctttttctgttccagagtctcacctagagtactgaaatacatttagttgctcctgtctttttagactcttctggtctatgacagtctctcagactttccttatgtctgaaagtatgtcaaatattttgtagaatgttcctcaattaagggtatgattttttccctcatgattagattgtgtttgtgggtttttagggggaagatactacagatataaagtaccattgtcaacatatcaacatgacttatcacttacaatactgtcaacatgctatcaacatgacctatcacttacaatactaaatttaatcacctgggtaggtaatgtttgccaagtttctctacttcaaagttgtttcccccttttgaaactgtactattcagaagcaagtaactaagcacagcctacatttaaggggtagaagttatatttcatctccttgagaagggagtatttaaatgatttggaattcttttgtatgtacattgtcatattctagctaattgttcataaatatactcacccttaggttataaattacttagtgttgtatgttccaggtaggcatgatatttaacaaatttctgccaaatacataaatttcccaaagcatataataaaaataaactggttcattattatgtcttcaacatctagaatacagtgcctggattattacagaatattcagaattataacataggctccataagaacagggatatcttgttattcaatattgtatctctagatagtaaaactgtacacagctcaagtgctcagtaaatatttgatgaatatataattcaaaaatgtaaactcttctttaccctaagtgtatataaatgttatatacaagaatctctctaccacacagtttaagagaggaaagaatggacctaactaaaagaaaacacacaaggctgaaaagttagtcagtcagtaagacctaatgccataccagacaaggattaagtcacacgctccctatacttaaagaataaactacattctaactgcaacagaatttcttcttttttctagaagctaagcaagcactggcctcaagataagcaatattgaaacaattgcagcttactgactgccagatgctgactgactcactccctgttccacagccgtaactacagctttgactggacaagagactgatttcagtaactttctcctgataggagtcgccaaccatggactggttctggcccgtatacagaggctgagcattgagtgccttcgtgtccttggctttaccttttgacaacagggcctaattgtaatgcatttaaattgttcagtccccactccaaagtaaacatgaaatgcatgtaacatgcatgtttgtctactatgcatgcgtgtgtttcccttttcatgatgttcacagctcctcctatagcctgctgaatcgatttagttgtacttggccaacttattcagcatcaattcctatgttacccttccctcctgcaaagtgcctgcttttagtctttgccagaggccacacttcccagcctgtcaggatggccagtcttttttttttttttgagatggagtctcgctctgtcacccaggttggagtgcggtggcgcaatctcagctcactgcaagctccgcctcccaggttcacgacattctcctgcctcagcctcccgagtagctgggactacaggcgcctgccatcacacctggctaatttttgtatttttagtagagagggggttccatcatgttagccaggatggtctcaatctgctgacatcgtgatccacccacctcggcctcccaacgtgctgggattacaggtgtgagccaccacacccggcccaggatggccagtctttataagaattaaagctcttctctccaaattggtagatcttgtgattctttgaagttcctcctgactaaagaatgatacagaggaatgacagaaataaggctaaggaaacaaacaggaatccagacacaaaggaatttatgtgccatgttaacaagtttggactttatcctataataaatataatccttaaagagtttttaagtagagaaataacatgattagatattatttttcattatttttatttctatttttgacacagggtctcactctgttgcccaggctggagtacagtggtgctatctcagcttactgcaggctccgcttcctgggctcaggtgatcctcccacctcagcttcccaaatagctgggaccacaggcagcaatttagccaccacatctggctaatttttttgtatttttttgtagagacaaggtttcaccacgttgcccaggctggtctcaaactcctggactcaagcgatgcacccacatcagcctcccaaagtgctgagattacaggcgtgagtcaccaagactggtagagaagtaacatgattagatattaatcagaaagaaaaaaacaccctcattctgaatccatgctgtaaaaatacaatggaggggaacaataataaatacaaggaacccaggtgaaagacagaggcctagactagaaatggcaaaggagtgggagtaccaaatgaatttatgcacgatttaggacacagaaccaacagatcttggtaatacactaaaggtaaagttttagggagaggaagaagtaaagaatgtatagcattatcagtcacggtggctactgctgacaggcaggctggcagatgaaaagacagtaatttgtgtttgggaagtgctgaatcacacaccaagacatgggtttggaaactatggaaagacaaaggctaaagaaagaacttgaaaagtaatcagcatatagacagtaactgaaatacaggtgtggataagattacccaggattaaagtcaggagtagaaagaatatagagcttaggttggagttgaaatggtgaggactagtatttaagaaatctttagttatcccagcatattaagaatatgccaggccgggcgcggtggctcacgcctgtaatcccagcactttgggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaagaatatgccagtgttcatactgaggagaacatgggtaaaacagaaacagtagaaagctaacttttaattactctaaccaagattcactacttaattaaatagatccgagaacacacaaaaaagtactcattatataagtcagttcttcccaggagaagcagtgttttagtttgggagaaaaatgctgggtccacaaacccaggacaatctggggttctagtctggttgtactaacaaccagctatatgaccaggtaactgaaaactataaaatgagctctttaagatccttcgtaagtctaagagtcaatgattccactgagatcattctatagtctagcaagatatacaaataagactttatatcagaaagaatagtataaaatatgagcatgggatacaaacaaatctggggattcaattactctcatttactaaattgttaaaagttggcaagttgctttaatttctctatgcatcagtgaatgtatcacacagaattttattaatataaggtacttaaagtgcttctcacagtgcctggtacataaaacatttttcaaatgttagctattgttttaaatatctttagtaataaactctaaaaaatccatattataagatataccacttccaacaccatgaaccatgtacaagcagtggctaccacctatttaaaatataatacagtcagagaagagcagagagaaaacagaatggcttggaggcagtggagtgacctcattacctgcgggtcctgcagcagctgcatcttccatgagttctccctcttctaattccatgttgttatattccacatcattttctccagacctaagaatatacaaaatccatcatttatatagagtgatacaataaacgttgtttttcacacctcaataaattttatgatatgcagatttttctgtgaaataagatatttctaaatacaaaaaggagaaagatttttgtcattttccaaatttaagtagcgttaatgttattgtttaaacaacctttaaaaaatatcggccgggcgcggtggctcatgcctgtaatcccagcactttgggaggctgaggcaggcggatcacgaggtcaggagatcgagaccatcctggctaacacggtgaaaccctgtctctactaaaaatacaaaaaattagctgggtgtggtggcaggcacctgtagtcccagctactcaggaggctgaatcaggagaatggcgtgaacccaggaggcaagcttgcagtgagccaagattgcacaactgcactccagcctgggcgacagagcgagactccatctcaaaaaaaaaaaaaaaatcagccagttcttcttagaaagctaagaaaaaaaggaatttaaaaaaaaaaaaaaaaaaatatatatatatatatatatatatatctcaaggccgggcgcagtgactcacgcctgaaatcccagaactttgggaggctaaggtgggaggatcacctgaggtcaggatttcgagaccagcctggccaacatggcaaaaccctgtctctcctaaaaatacaaaaattagctgggcgttgtggtggggacctgtaatcccagctcctcgggaggctgaggcagcagaatcggttgaacccgggaggtggaggttgtagtgagccaagattgcactactgcacttcagcctggacgacagagcgagactctgtctcaaggaggacaggacaggacaggaaaggaaaggaaaggaagattaaaaaaaaagaactgtgtcaggcaaaaaaatagaaataaatgaaacactaaaaaatctaagaaccactattagaagagattaatctctcctatttaattagtgttagaaacactaataaatacaagaaccactgttagaagaaattacagcttcagagaactggtagcttaatggcaataagcttaaaacactacatgtagtgttaggcttaaaacactacattttaacatccaaaaaaagcccaaattactgtatatgactaaataccatttttcaaaaataatatttcagcaaagagggtattacttcctactcggccatacaaagtctctcatgttaaaaaacaatcactattactttattttaaacaacatactacttgaaacagtaccagtcaatgacagtcttgggtatttaaggaaatctcaagataagcacccagcttgacaatgtaaggagctctgtaggtctgctctttagtcaaactggtgacaattattttaaaaacaaccacttaacgactctggaaatggtcccaagggcatacagcaaatgaagaaacatctactcaaaaaaatctataaaaactgggtaagacaagtgggcatctgcagtatttgaaccaagatcactccacttcctaacttggtgttacagaaattccactccagactggtgcagtgaagaacacaggcctcccacttcccgaacttccaagaggagggctatattcctgggagtggcaaggtatcagcatctctcattctgcccccagctacctattgctgatgctatagtacaggcacacacggccaagaggtggagactcccttctgctgagacccacttgtggactagatgctctacctggatgcagcatgatgagaatactggggcccagatcatccctgccccagcttattcataaggtggaggtcccaagcctgaaaaggaaagaactaaggctactgtccccaacatccagttagctcagcttctaaagtaagagaggtacacctttatccttactccaacttcaaagctttggctcagagattttgcctatggggagaagcagagacacatacaacactcagagaaacatacaacactattaagagcatcaacgaaatatagttggccttctttatctgtgggctctgcatctgtgcattcaaccaactgtggatcaaaaatattttttaagccctggtgtggtggttcatgcctgtaatcccagcactttgggaagccgaggctggagggacttcttgagcctaggagctccgggccagcctagaacatagtaaggcaacatagtgagaccctgtctctacaaaatattaaaaaattagccaggtgtgttggcatgcacctgtagtcctagctacttggaaaactgaggtgggaggatcacttgagcccaggaggtcgaggttgcagtgagctgtgatcacgcgaccactgcactccagcttgggtgacagggcaagaccccgtctcaaaaaataaagccggccgggtgctgtggctcacctgaggccaggagttcaaaaccagcctggtcaacattgcaaaaccctgtctctactaaaactacaaaaaattagtcgggcgtagtggcaggcgtgtataatcccagctactcaggaggctgaggcaggggaactgcttgaacccaggagacggaggctgcagtgagctgagattgtgccactgcactccagcctgggcgacaagagcgaaactccgtctcaaaaaaaaataaataaaacaaaacaaaataaagtcatgcgcagacattttccccttgtcattattctgtatacaatagagtataacaactacttacatagcatttgcattgtattaggtattataagtaatctagagatgatttaaaagtataggggaggatgtgcataggttatatgcaactactctgccattttatataagatacttgagcatcctcagattttagtatccaagggcggggtcctagaaccaataccgcaaggatactgagggacaactgtactagcaaacagaatgcagtaacatataaaaagaatcatgagccgagtgtgatgatgcacaccagtagtcctagctactatggaggctgaggcaggtggatcacttgaggccagagttgaaggttacagggagctataatcatgccaccatactccagcctggccacaaagccagattctcttaggaaaaaaaaaaaattgctgggtgccgtggctcatgcctgtaatcccagcactttgggaggccgaggcaggcagatcacaaggtcaggagattgagatcatcctggctaacacggtgaaaccccatctctattaaaaatacaaaacaaaattagccgggcaaggtggtgggcacctgtagtcccagctacttgggagactgaggcaggagaatggtgtgaatccagaaggcggagcttgcagtgagcggatattgcgccactgcactccagcctgggggacagagcgagactccgtttcaaataaaaaaaaaagaaaaaaaaaattacggctgggcgaagtggatcacacctgtaattccagcactttgggaggccaagacgggtggatcacgaggtcaggtgtttgagaccagcctggccaacgcagtgaaacctcgtctctactaaaaatacaaaaaattagctgggtgtggtggtgggtgcctgtaatcccagctacttgggaggctgaggcaggagaatcgcctgaacccgggaggcggaggttgcagtgagccgagatcatgccactgcacttaagcccgggtgacagtgcgaaactccgtcacaaaaaaaaaaaaaagaaaaaagaaaaaaaattacacactatgaccaagtgggatgtgtcccaggaatgcaagcttggtttaaaaatccaaaaatcgccaggcacagtggctcacacctgtaatcctagcactttgggaggctgaagtgggcagatcacctgaagtcaggagttcaagaccagcctggccaacatggtgaaaccccgtctccactaaaaatacaaaaaaatagccaggcgtggtggtgcacgcctgtaatccttgctactcgggaggctgaggtggaaggatcacttgaacccaggagatggaggttgcagtgagccaagatcgtgacactgcatgccagcctgggtgacagagcaagactccatctcaaaaaaaaaaaattatccacattaatgaaattcattagttcatcaattaacagggcagaaggaaaagctcttccttaaattgcaactaatgaatgagtaagaaataatggaattagaaaaacaccacttggcaatcaacacagtaacctttttcaggcaacactcatcaaagggtgtcaaaattcataggaaaaagtaggatgaaaaataggatatttacagtcccatacataagatacttattaattataaaggaaaaagtacaaattttggagtgaagaaacctggcggatgctacctcaactaagtgatcaaaattaaccacaagtaatgggacatactgacatcatgctccactctgtatgacgcagtgaaaaggatacattatcatttccgtagtatccctgccaaaagtgtgtaacctctatctaatcatgaggaaacttcagactaatccaaactgagggactttctacaaaataaactattctgtatttctcagaaagtattagtcatgaaaaacagtttttttttttttttgagacagagtctcaactgtcgcccaggctggagtgccgtggcgtgatcttagctcactgcaagctccgcctcccgggttcaccccattctcctgcctcagcctaccaagtagctgggactacaggcgcctgccaccacacctggctaatttcttttttgtatttttagtagagacggggtttcaccgtgttagccaggatggtctggatctcctgacctcgtgatccacccgcctcagcctcccagagtgctgggattacaggcgtgagccaccgtgcccagccgaaaaacaaatttttaaaaaagtaacccagattggccaggtgcggtggctcacgcctgtaatcccaacactttgggaggccgaggtggacggatcatgaggtcaggagatcaagaccaacctggctaacacggtgaaaccccgtctctactaaaaatacaaaaaattagctgggcgaggtggcgggcgcctgtagttctagctgctcgggaggctgaggcaggagaatggcgtaatccggaaggtggagcttgcagtgagctgagatcatgccactgcactccagcctgggcgacagagcgagactccgtctcaaaaaaaaaggaaaaaaaaaaaagtaacccagattgaagataactaaatcgatttaacaattaaatgcaacatgatcctgacaaaggacattactggcaaatttttagaaggttacagtattacatcaatgttaatttccagattttgataactattctatagttatgtaagaatatccttgtttttagaaaagtacacaatgagaagtatattcgatctcaagtgtttcagaaaaaattatatacagagaaatataaagcaaaatattcatagggaatgaatctgtgtgaaggaaacatgaaattctgaacttttcttaagtataaaataatttcaaaattcaaatttaaaagttaaaacacaaacaaaaattattggctaagagcccagagattagagagagaaaactgactattgattcaatctttcaaaaaagtgctgaatatccctacatttaagtgtgagttagttaatatgcttctaataattaccacttaaatgctttacagtagtaaagtgggaaactcacatagtttcttcatcaatatcattttcttctgtattacttgttgctgtggaactagcagaggaactgctgccatcgagctgatttacttcatcctcataaacaagatccagatccagatctccatctgaaagctcgtgctagatcaatgccaagaaaacaagacgtctattccaaatgtttctactcagttgatcaccccatccagcccataaaccaagcaccaaagaataatacagttttcaaaaatctattttctgctcctgtgcctcagctgctgagccctgtagagaaaaatcacacaaccacactgactgatatcattttactaacttatgcgtgccgccttcagctgggccctcagtgtgactggaatccttcacatattccacatcagcttcctcacagagtaacgtttcaaaccatcactcctcaattctacctaattttaccattatcaaggtcattaattaacactgtcacctatctgcacagaaaaaaaatacccactattaagcaaaaacttccccaacttttcagctgccttacctgcaaactccacccttcctttaactcagtttatcaaaggttaactgcttcacctgactgctccattccaaaccctattatctctagtttatcaaagcacttaatctgtgcattctctcgacccactgggtccttcattttaacttaaaactgaagtctctcatcttaaaaattactacaaaaaaaccaactgtctatgcatcccttcttatgtaaaaatatcaactacttcttgaactcttattctggattctgactgttgtttagctgggatagaacctggctagctaccgaatcctaaatcagtctacctacgtaagtaatgataaggcatgtactagtttcagtgaatgaaaatagaacaccttttttttttctttttctttgagacagagtcttgctctgtctcccaggctggagtgcagtggcacaatcttggctcactgcaacctccgcctcctaggttcaagtgattctcctacctcagcctcccaagtagctgggattacaggcaagcaccaccacacccagctaatttttgtatttttcgtagagacagggtttggccatgttggccaggatagtctcgaactcctgacctcatgtgatccacccaccttggcctcccaaagtgctgggattacaggtgtgagccaccgcacccggccagaacacatttttaaaatccacaatgtatggtagtttaggttttaaaatgtgtatcacggtttgttttatacaatgtattgtttttttcacaaccttgaaatgctttgattcaacaacttctgacttattaacatttacataagggcatacatacattactaatggaaatcaatggacaatatttttagcctactgttttagcacataatatgttaaaagccatgatgctactgtttttttttaatcaaacacaaaaatctaaaactggcctcattattacatgataatcttcattctgaatcttctcctcatcttcttcatcctctttggcctctcttacagaagctgtagtaggaccaccttcgagaagcatgtcagagcatgcagacttcttagctcgtgtctccagagcatcatcattttgggggctaagatggttatctggtggtgacaaatctcttgacttctgagttcgagacagctcaatagtaagtctcttttaaaacaagaaaagcacaaatattagccacagctcactggcacagtaaaagatgtctcaagtgaaaaaaaaatgcatccagatgtttctaaaaccattgctttatttattttttgagaatggtctcactctgttgcccaggctgaagtgcagtggtgccatcatagctcactgcaagccttgaactactgggctcaaacgatcctactgcctcagcctctcaagtggctgggactggaggtgtgtgccaccatgcttggctaatttcatttttatttatttttagagacggtatcttgctatgttgctcaagctggttttgaacccctgggctcaaatgttcctctggcctcggcctcccaacatgctgggattacaggaatgagccacctcacttggcaccatttcttaaaccatttctctgaatccctactgccttttatttataaaaaaaaattgatgacaaagataaactgccccatttatgctcatcctccttctttcatatccagcctaagctaaacatacaattagcaaacagtatagtgaatacaggcagttttaaatagcacatttaacatgaaaatctctgaaagcatgtatttattcacattttcctccctgacctattaacgactctcagcactccaaacctcctgccacaccctaacttcctaagggaaatgaaacattccttagtttaccactgtaaaataaaaattcatcaattaatcttccccagtgctcattcaacaatagtaagagttcaagatgggacaacttttaattgtgctatagcctagaatcctctaaatccaagataacttgtggaagagaaactaagtcactgacagaaacacaaacagcttacctcaaactacagccacactgttcaaaacaactttatgcaatgatggaaatgctctagatttgcagtaaccaatgcaagcacttgaaatgtggctactgcaactaaggaactaaatttttaattttaattaagctaaatttacagaccaggcacagtggctcacacctgtaatcccagcactttgggaggccaaggcaggcagactgcttgagcccaggagttcaagaccagcttgggcaacatggagaaacccatctccacaaaaacaaaaactagccatgacacatgctcgtagtcccagctacctgggaggctaaggtgggaagatcacccgagcttgggaagttgaagctgcagttagtggaaattgtgcctggcaacaagagtgagtccgacctgtctccaaaataaaaaaaaataaaaataaagtggcagggcgtggtggctcatgcctgtaatcccagcactttgggaggccgaggtgggcagatcacgaggtcaggacatcgagaccatcctggctaacactgtgaaaccctgtctctactaaaaatacaaaaaaattagcccggtgtggtggcaggcgcctgtagtcccagctactcaggaggctgaggcaggagaatggcgtgaacccaggaggcggagcttgcagtgagccgagattgcaccactgcactccagcctgggcaacagagcgagactccttctcaaaaaaaataaataaataaagtaaaataaaaatttacatggccgtatgtggctagtgtctactaaactggacactgcagaactggtaaggatggggaacaagataactagattttttttctaattacaaattacaaaattacaaatagcaataaaatatataaaatctaattacaaatataacaagccaaaaggacaataggaaacaccaaaacagaaatagatattttcttacctctttaaggttgtttatttgttggatataactagtctgtgcagcttccaactgagtaatgtaccaatgctggtcccgggatttttgaaagaaagttggtgaacgtacctgaaaccttaaaagaattgtgccacattaaaaaaaaaattcaaatagtaaaacattatcagtctagcactgaattctgcaatttgggttaacttgattataaggccaaaattcacataaacttagagctgctagtatttgttgtttatagatgtagtccacagattatgacacaaggttctgaaaagccagttgtcctcaaactacctttctaaagaaataacattgtacattgtagttaagcttcccaaactaacctactcaggcatatttattataataatgtaactaaaatacaatgatgatcatgagttgggaagaagagagccatatactatgcagtttcctcctataaggaggaagataactcttatccctttcttccctaaatgaggccccagcaaaatacaaagttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtagcaaaatacaaagttttaagtgctgctctttatatttctctattccatctcacgttcccgtatttcctgcccctcagaaaaaaaatcacttcctggctcaaccacccaggattgctttactatcccccaaggagttacatgctctaaataaactatatcctgaacccttcaagatagcaatcaaaactgcccttattacaatatggcattatttcagcttaggttaggaaaaaaagtactgcacctacataaaatcgtattaatatataaatgacagaatcttaatctatccagagttgttttaattaaaaaaaaaaaaaaaactattactaaagcaaacaaacctctacctttgttacatagcctaacgtgactatatttaaggtgaaaaaattgcagtgcatgtgtgaaggtgtttttgaagaaaggaaaaaccacaaggcaagactaatttggacatctacatctctctcattccttccagcccttttacccggctacacaatgttagctgttcatttttttctaggattttacaccttattgtaagaacctactgaccatttaacagttatctggcagtagatatctagttttagtgaagaatactaatgcaagaaaggacagaacataaacactgactataaaacaacagtcctatttaatgttgggatagtctttataggtcagaagtttttgggcatcattatatgttataactggatgatcaaaatgagaacttgagtattaaaaaaagagagagattggccgggcacagtggctcacacctgtaatcttagcactttgggaggccgaggtgggcagatcacctaaggtcaggagttcgagaccagcgtggccaacatggtgaaaccccgtctctactaaaagtacaaaaattagccgggtatggtggcgggcgcctgtaatcccagctactcaggaggctgaggcaggagaatcgcttgaatctgggaggcaaaggtggcagtgagccgagatcgcaccactgcactccagcctgggcaacagagcgaaactctgtctcaaaaaatcaaatcaaatcaaatcaaatcaaatcaaatcaaatcaaatcaagagattaaattacgttctgaacggaactgagtagagatgattcactcaactgagcagagacgattcacagtctaggaagtacccactggtaagacattaaagtaagaccgtctaaacactattattttctttgaatgatttaaaccactggttaactctgcacattagttctaatattttgccattaaaacaaaaccaagcagcaggtaaaatttcttaactttctgttttaatgaaagaatgaaacatacattcatagttatagaaaagccttaaataactttctaataaatacatacaaaattccaccagaatcttgaaataaaaggtttaaagtttgagcaatgtctcattaataggataatgtgaagccccctatccacaaacttcatagcaatttacttacggtgctactatagcattattttataataagagagtagtaaattctgtttttatctgccaatttcatcttgagttccctgtggacaaaaaccatgtctatatttttcttattagcaactcagtgtcaggcatatggtatagactcaatgttgcttaaaaaaaatgatgtcataacaggaatttgtttctgtactaataagtaacgctaataaggatgaaatcaaggctataagaaaatgggtcttttataggttggtaaaattgatgtttgaataattttgtaattctctctatggctgaagcatgaaatagcaataaattatttctcttggtgaatagttaaaccccaaaagtctgaaaagctatacgaagaaaactaaaataatccctcccctcaaaaaacatgattccaggcaccgtggcatgcacctgtaatcctacctacttgggaagttgagacaggaggatcacttgagcccgagaattctagactagactgggcaatatagcaagacactgactctaaacaaaacaaaacaataacaaaaacatatctttttccctacactgaaaatcatatcccttgttaaacttctttatacttccagaaaagctacggaaaacacataagagtaaatgctgatatgatagcaactcatctgtccagtatgctcaagaacaaagagctccgaataagggaaattcaggagtacattaaatcactctcaagaaaaaaatgtttaaaattgttgtgatgagaactttttaaactgttaaatactctgaaacttctcagttcagaacatattttaatcttttttaaatattcaagttcttattttgatcatcaaattataacatcatgtaatgatacccaaaaacctttttttgtttgttttttgtttttttaagatggagtttcactcttgtcgcccaggctggagtgcactggtgaaatctcggctcactgcaacatctgcctcccggactcaagcgattcaactgcctcagcttcccaagtagctgggattacaagtgcctgccaccatgcccagctaatttttgtatttttagtagagacagggtttcaccatgttgcccaggctgatcttgaactcctgacctcaggtgatccacccacctcagcctcccaaagtgctgggattacaggcgtgagccacggcacccagccaatgcccaaaaacttctgacctgtaaagactaccccacgttaaacagggctgttgtttttatttactttattattatttttgagatagggtcttgctatgtcgcccaggctggggtgcagtggcataatctcggttcactgcaacctccacctgccggattcaagcgattctcctgccttggcctcctgagtagctgggattacaggcgcgtgccaccacagcccggctaatttttgtatttttagtagagataggatttcaccatattggccaggctgctctcaaactcctgagcccaagtgatctgcctgcctcagcctcccaaagtgctgggattacaggcgtgagccaccacacctggctaaatagggctgttgtttgagtcagtatttacgttctatcctttcttgtaaatactacaccaacaatcaacaataaaaattgatggttttggccagacgtggtggctcatgcctataatcccagcactatgggaggccgaagtgggtggatcacctgaggtcgggagttagaaaccagcctgatcaacacggagaaaccccatctctactaaaagtacaaaattagccaggcatggtggcgcgtgcctgcaatcccatctactcgggaggctgaggcaggagaatcgcttgaacctgggaggcaaaggttgcagggagccaagatcgcgccattgcgctccagcctgggcaactagaaactctgtctcaaaaaaaaaaaaaaaaaaaaaaaaaaattgatggttttcgcaaataccacatgttctcacttattatttaagagctaaatgggccgggcgcagtggctcaggcctgtaatcccagcactttggaggctgaggcaggaggctcaagaggtcaggagatcgagaccatcctggctaacacggtggaaccccatctctactaaaaatacaaaaacaaaattagccagatgcagtggcaggcacctgtagtcccagctacttgggaggctgaggcaggagaatggtgtgaacccgggaggcagagcttgcagtgagccgatatgtcgcctctgggcgacagagggagactccatctcaaaaaaaaaaaaaaaaaaaaaaaagctaaatgatgagaactcaaggatataacgaggggtaacaacaacagacactggggcctacttgagggtggagggtgggaggagggagaggataagaaaaaataactattgggtactaggcttagtatctgggtgatgaaataatccgtacaccaaatcaccatgatgtgagtttacctgtataacaaacctacacatgtacccctgaacctaaaataaaagtttaagaaaaaagtagaaaattgctggttttcgtcaactttcatcttgactcttctacttttaatttgctgttattgacaaagaactgatagttgctttataaaattaagttgtaaaaccagtcactcaaatataatatgcactgtgaagtgaaaaaaatcagcactttatccctcactattcttagatttccaaatggtgaggtcactagaagttcaacagacaaatggaacattactatacttactggaagttgtagtttcccacccacccccttttttttttctttttaaaaagatggggggtctcataatgtttcctaagctggtctcaaactcctgggcccaagccgtcctcccatcttagcctccatagtagatggaaacaccggcgcaccactgcacccagcttatctttaatggaattgctaactagatgtcaaaaaaagtttgactttttgactacaaatttttgattattatccacttaaataaaacagttaagaaagtgataaggggccgggcacggtggctcacgcctgtaatcccagcactttgggaggccgaggcgggcggatcacgaggtcaggagatcgagaccatcctggctaaaacagtgaaaccccgtctctactaaaaatagtaaaaaattagccaggcgtggtggcgggcgcctgtagtcccagctactcgggaggctgaggcaggagaatggcgtgaacccgggaggcggagcttgtagtgagccgagatcgcgccagggcgacagagcgagactatgtctccaaaaaaaaaaaaaaaaaaaaaaaaaaaaaaaggtgataaggttatagttagtatgaatttcaatattcatctttgttaaccaaatgatctttgaaatatagttctgatgatattatttccccacaataaaaaccacaacatcaaatttttcctgttaccttaaaatcactgtatcattttgtggattcaagtatccttcatttgcgagtaagtccaaacggaaaaatctattatagccccagcattctccaacttcaaagtcagatgcaaattctcgaatgatattttttgtaggatcattacaggactggtgaaccatctctacacgatattcatatctaaaattgaaaaacagaccattactatacagttagtaaagtaagaataaaaaacaaactcatctaaacattaaggtcactaagtaattacctgagaagaaaccttattgatatacgcagttacatttcttttatcatttataaaaacagcagtattttggggtttttttatttatttaagatggagtttcactcttgttgcccaggctggagtgcaatggtgcaatttcagctcactgcatcctctgactccaggttcaagtgattctcctgcctcggcctacagagtagctgagattacaggcgtgtaccatgcttagctaattttgtatttttagtggagacgggggttcatgttggccaggctggtcttgaactcctgacctcaggtgatccacccaccttggcctcccagtgtgctgggattgcaggcgtgagccaccacacccggccagaaaaagagcagtatttttttgtttgcttttttgagatagagtctcactctgtagcccaggctagagggcagtggcggggtctcagctcactgcaacctctgccccccagttcaagtgattctgctgcctcagcctcccaagtagctgagattacaagtgcacaccaccatgcccagctaattttttgtatttttagtagagacagggtttcataatgttggacaggctagtatcaaactcttgacctcagatgatccaccctccttgacctcccaaagggctgggattacgggtgtgagccactgcgcccagccaaaacagcagtattttgaacgaaccaccaaaacatgaatggcaataggtccttttttcctcgtaaagatgtttaccgatatatcaggtataaaacaacacctcaaaaaataaataaattttgaataaacaagtaattcaaagttgcttttgttttactaatgcaatattttttccatatattcactacatatgtttcctcataaatattgttatttctattatcctttgaggtttatcaccttgcaattttaaaatataaattttgaaatactctactgtattttgccagtacaagtgataagaaagcaaattattgtgtattcagaaaatcaaaggctataaaatttcctaatagaaaataagtatgcagccataaaaaagaacgagattatgttttttgtgcaacatggatggatggagctggaggctattatcctcagcaaactaacacaggaacagaaaaccaaataccacgtgttctcacttatattgtgggagctaaatgatgagaacttatgaacacaaagaaggaaacaacagacactggggtatgcttgagggcagagggtgggaaaaaggagaggagcagaaaagataactattgggtactgggcttaattcctgggtgatgaaataatctgtacaatgaacccccatgacatgagtttacctatgtaacaaaccttcatacgtaacaccaaacctaaaataaaagttaaaaagaaaagaaaaaggaaaaagaaaataagtaagctggacacagtggctaacacctgtaatcccagcactttaagagaccgaggtgggcagatcgcctgagcccaggagtctgagaccagcctgggcaacatggcgaaaccccgtctccataaaaacaaaaaacaaaaaaattagctgggtacggtagtgcattcctgtagtcccagctacttgggagactgaggcaggaggatcacctgggcccaggaggttgaggctgcagtgagccataattgtgccactgtgctccagcctcagtgacacagcaagaccctgtctcaaaaagaaaagaagtatacattgggaaagccaatatattctaatttatatatccaatcttgtaaaattttcaggtttacaaaaagacaaagaagatagcctataaacttttgtgcattaatgcacattatcaagaaaatgaaaagaaaacctaccaaatgggagaaactatttgcaaatcatatgtctgataaaggtttagtatccaaaatatataaagaattcttgaccgggcacagtggcacacacctgtaatcccagcattttgggaggctgaggtgggcggatcacctgaggatacgagttcaagaccagcctggccaatatggtgaaaccccgtttctactaaaaatacaaaaattggctgggcgtggtggtgcatgcctgtaatcccagctattttgggaggctgaggcaggagaattgcttgaacctgggaggcagaggttgcagtgagctgagatcatgccactgtactccaagctgggtgataaagtgagactcaaaatacattaagtaaataaataaattgagacagggtctcactctgtcattcaggctggagtgcagtggtgcggacacagctcattgcagcctcgacttcctgggctcaagcaatcctcctgcctcagcctcctgagtagctgagacgtatgcagggtctcaccatattgcccaggctggtctcaaattcctggtctcaagcaatcctcctgccttggcctcccaaagtgctgggattacaggtatgggccagccagtctggcatattaacctttgactgaacacaagacactgtaaattttactctgttggatgttagatacttcagcaaccttataaattttcttgagcttccttctgggatgcagttaagttacttgaaaacaatttgatcctttcaggtctcacttttgttaggtgggtccagagcagtgttcagtctagggctaatttctgctatcgagacaaaaacttccttagtgttatacccaatcagtgacccatgaattataaatttctccaccgtggcaggttgcaatagacacagttcctggccccgtgtgaacaccagtcactcactattccctctaatcctgtcaaggagttctttccccaatctcaggtagtttcctcagacatatgccctgataagtactctgctgaatactcaaggggaacccattacggatctctagacttcagtctctgcagctttctcctctctggtattttgtccaatgcgctctagctgtattgtcctttctagactctcagcactatcccctcaactaagtctgccagattctccctcagtcccagctcctccctgtgttgcagcctgaaaactctctcaaggctgtaagctggagaaattgtagagttagtttgtgtttctcatctctcagggactactttcatttgttaccaccatgtccagtgtctagaaaatgttgtttcatgaggtctttttttttttttggttgttgcaggaaaatgggtagatctcatccctcttgcttcatgttagctgaaagcagacattccatactaaactaacagatttcatgtaacagagttaaaaaaaaaaatcattaatatgattccagatcccacattgtaaataacatttaacaacctaccacttgttcagtttggatgtaatatcaaagaagatccacaattatctaaaaccactttaaaaaatattcctccttgtcaaaaagtacatttgtggttctcagggactgagggaaacggggaatgggaagtgactgctaaggagtacagggattccttgtggagtaaatagaatgttataaaattagatgttggtgatggttgtagaactctgcagacagatttcatacatgtatttcaatcaaaatgatattttaaaaaaattgaatataaaagcagacatgagaatccagtagtcttcttctaagccagatagtaaagagatttctaaaaacgcaaagcaatacaagttttcttaaaaatattttgtttttagaaaaataccatcctatgatgccaagaacatattattctacatcttaacagacataccaatacagtaattaacaaaaataaaaattaacaaaaattgctagggggaaggtatgtaaatgcacattaaggttgttatttaattacacttcttacttagaagtttcaggcaagccagctgagagctccagaaacacagataagtagtaacctcgcacaactccatttccatcctaaaagaagaataatcagtttgagtgtaaaaaaattaagccacaataaaacaaaatgcagataatatctgatatctagattgagaagtacttctaagcctcaaagcaatggaagaaataattaaaaacaccaatagatttgagttcttaacaactttaaacttttgtgcattaaaaaaaaagtgaaactattaaggcacaaaaatgaagggaaatatcaacaaccacaacaaaggttaagagttttaacatatatagaactcttacaaatcaaccttaataaaaaaacaagaccctaatgggaaaaataatttcattagaaatgagtgaagcaaaaaaaaattttaaaccaaaaattaatttttaagaccaacatacaaaaaggtaataccctatgctgaaagtaattaaatataatttctatatgattttaatattagaattccatataagattctgtctagagattgagaagttgtttaaatctctactatagattttatttttataaagataattactccctccctttttgtttaatttggcaagactcttttaaaaaaagagaattacttcctatgtatttccctagtacttcaggtgtctatgttttaaaagaatcacatttattataactacttgtttaaacatctgttcccccaacgagacaatgaaggctgacaacagagatccttatacatctccagtgtctactgggatatgactacagagaggtacaagtactattaaccccttcatttttagtctactttgcttgaaaggacctgaggcaacttttgaggttcgacatgataatcactcagtagatatcaatgaataaatgactcatcagctaggtgaataaagccagacataaaagatgatatattattgtgtaatgccattatacaaaacttttctaaaaaaaaaaaaataatctgaaactacatattgaaagacttcaatgtgtaactgagaatactaacccaggagggctaaaatgtgtaatagtaaattactggactcaaaaagattatttagcatctaggcaatatcaccaaacatctttaaaggtaaagaaaattagtttattatcagacttttcctaaagaaaatggaattgcatattgaagatacccaatgaaagaaaatatgagccaaggattttatatccagcaatactagccttagaatataaaaggcaaaaactgttttcaacatatgagaactcagggaacattgtttccaataggccttccagcagaatgtattagagaacaaggtgtggacaaacaaacagttgtctaatatgggggaagaaggggaacagggaatgcggacagcatatgtaacaaaaaaaagaagagttaacagttctcagtaatcaaattagtatactacagaactctgaaagaaagaccttggtttcaaaatttattagaaatatgaaaaacttactgggtaaacttttaacctccagcaaagtcctgaaacttgaagaggtggactgtaaacaggatctgctctctgacgcaaagtgctaacgaaaaagaaaaccaaccaaatcccaagatcaaaactgttgtgaaatggcaacaggcaaaaagaaagaccaaccagtttctttgttacatacttgaaatcctagacaaataacaaggtgactgaacaggtcaaaattccactgtaaaagtttagatatgcttacatcctgaaataaagaaaatttaaagatactgaaatattcagcaatatcttttaagtttcaggggaaaaaaaaccctcaaaattgtgacatttaagggaaaaggaatgtatcaccaagtctcccaaaattaattaatgcttcaacaagcagtcttcaccattaaaaataaaacaaaacccagaatgtttcttcctcgcttctctgcagtataatcatcttttaatattgaagaacaagagtacactaaaccttaatacgtgtgggaaaaacctcaaagagactatgttttagccacaaaagtaaccctaagaaaagacaaattaaatgggaagagggataaattctgtgtggctttttttttttttgagatagagttttttcagacagagttttactcttgttgcccaggctggagcgcagtggcacgatctcagctcactgcaacctccacctcccggtttcaggcaattctcctgcctcagcctcccaagtagctgggattacaggcgcccaccaccacgcccagctaatttttgtatttttagtagagacggggtttaccatgttggccaggctggtcttgaactcctgacctcgatgatccacccgccttggcctcccaaagtgctgggattacaagcttaagccaccatgccctgcccagtgtggccttattttgatggcctttgcctattatttggagtttctctcctgaagaccttatagtccttgtttccacttccatgctgccctcaaagacaaattgctaagaacctttgcatgttacgatcttcacttctgatcttaagagaaaaagtagtaaaagctaacaaaattaacatacaactgacaaagcctacacatttcttacaataatggccccttatccacaattcttcactttgagctgagataaatggatctcaatggatttcttcccagcacttttatttctgaggataggtaagagggggctcatcaacctctaactgtccagccccccaccttagtcaaagctaagtgatctctcttatttaaaatggttcctcactttgggcagggcaccgtggctaatgcctataattccagcactttgggaggctgaggtgggagaattactggagcccaggagtttgagaccagcctaggaaacacagtgagaccccatctgtgtggtggcacacgcttgtagtcccagttacttgggaggctgaggtgggaggattgctgcagcccaggaggttgaggctgcagtgagcaatgatcacgccactgcactccagcctgggtgacagagcaaaacccagtctcaaaataaaaagaaaaggttccttttcccagactagagaagcagtcagtctaaagatacaatataatccagcacaaattatctctacatttctaataggaaacttattcttctaagacttctaaagtgagtgacacagttcactagattactgtcttaccaaagaatacctttctggctcttccttatatacacatacaaaaaaaccagaattgtcaaaaactcttacctgaaattctctaaaacaaaagtagctgaatcgtaagatggcactaattcactaaaaaaaaaaaggcaaaaaaaattatttagcttacatgtttaaaattccatttgcctaaaaaagccaagtccctcactagtatcttaaaaactttattaaactaaaatctaagaaatatttttaaatctttattgaacataacattaaatcaaatgaattcataaaaccatcaagtttgcaattaaattggagatacaaatactttataaaagttttttggctgggtgaggtggctcacccctataatcccagcactctgggaggccaaggtgggtggatcatctgaggtcgggagctcaagaccagcatggccaacatggtaaaaccccatctctgttaaaaatacacaaaaattacccagatgtggtggtgtgcacctgcaatcccagctacttgggaggctgaggcacgagaatcacttgaaccctagaggtggaggttgcggtgattcgagattgcactaccacacatctctattaaaaatacgcaaaaattacccaaatgtggtggtgtgcgcctgcaatcccagctacttgggaggctgaggcacgagaatcgcttgaaccccagatgcggaggttgcggtgaatcaagattgcactaccacactccagcgagggcgacagagccagactctgtctcagtcaaccaataaatcaataaataaatactttataaaagctttttttcctaaaagaaaaaaaggcaacacattatataattattaaactaagtacaagaaatacactttaaaaagtactcatggaaatgggaaaaagaaactgacgcttagggtgtgaatctgaattatgaaacagatataaaacatcctttaaaaaatgaaacaacagtcagtgataacacaattaatccccaaacttcctactctggaatggattatgggaaatattaacagacctcaaatactttgaaactatttactagcaaataaatctacacatttttataggatgaatacctcatcacctaaggggcaactgtgatggactagcacactcacactttcttggcaagtcaaaactacttcaagcaactttagtcccatccaatcttcttcagagagaactgtattataatcacagaatggactaaaagtcactttgctgctaactacctttaatcatgtggatggtttgtacactttcattagaacacctcaaaactcattaaaacactatactatgaaaaagactatcatacgatgttttaatagtgttataaatttgatatataaaattacaaatttcccaaaacaataaactgcaaaccatttcaccacatcttcagatatattttctaaagttcaattcatcataattttggttattatcaaaacaagataaaatatacatctatagcactgccacactatgatagtgtctaaagaaattagtggcttgcaatacaatatagacaaataattctttatttcaatgtaagtacgtatagctaaataggtcacgtcttttacacagtaagcagatgtactttgccctgtgattaactgtatagctactatccaaattgactatgtcaagaattcctatgatatccctagtcagttgttatccttcttagaagactcacattcctcatccccatatccttttgcctggttaacccttactatttcttcagataacagattagaagtcacatactcttggaggtttgctctaaggtcttcccattatatgatctcctagcactcaacatacacaaactccaattagcaggaccaatgcaattagtgcctaggaagcctttctggaaccataaacctagtaagagctctaagggagtcttcccagtatagccttcaaatttgacatgtttttgaaattttgtgcaactttcaatcaggtctctcatcaagtacagaatatcctccacaacatgcaaagactttaatcaatccccagttgcctgctaatctgcatattatttcttctgccatgtccagtgtaatttatttcctgtgttgttgttactgttatttctgctctaagtccagactatcattatcatattttattggccattaagggtcaaaagacttcagcagaacccaaattaaacaacaagagatgccattttcaactcagaatggtgaagtagaaagcttccaggctaaagagcataggttactaacactcatgaaccaagagagtacagtccagtttaccctagtctcacttgctaggagaaaatgaccacattcagagcacagaaaacaggtactgtgatatacttttacatatgtacattctcctagggaaaattttttggacacaaatagtataatgacaaattagtggtatggggcagcattaaacaggatacttacttcccctatcaccagttaccacattaattttattactgttccaataacctgtttttctaaatcataattataaacccaaagagctctgtattatgcttaatgctagcacttaacacatgcctaaaatatagctggcatatattcactgaatgaatgtttataaatacttgctggcagattcgtagagttggaaatatttgctcaaaaatttcttttgcgaaagaaattactttgctttttaaatttaaattttatttatttatttatttatttatttttttgagacgcagtctcgctctgtcacacaggctggagtgcagtggcgcgatctcggctcactgattttgcattctttatatgtatatacaaagctattgctactgctaggccatctaattccaccaccacatctccatattatgctcattcatttagagattatcttcaatcatactgatgttatcattctgtgtctgcagatgaggcactgctttatcttttcatagttttaaaattttctcctcctctcttagaagtgtagactgctctggttatgatgactggattcatctcatgatggtgtcagtgaatctttgtcttcacagaatatgggaaactaccctcaaaccatctctagcccaggaatctggaagtcactgatctgcaaatcttcagaccagtaacctcatcataacttcatcaacaaagggaaaaaagggagaaccacaagtatccatttgtttcttaaggaaataaactgctgagctatataaaaactggttctccttatcaacttgactatttctccctgaaacataaaactctctatgaactgacagctatactattgtatcttttattttttcttttctgcctcagcctccggagtagctgggattataggcatgcaccaccacacccggctaattttgtatttttagtagagatggggtttctccatgttggtcagactgctctggaactcctgacttcaggtgatccgcccgcctcggcctcccaaggtgctggggttacaggcatgagccaccgcgcccagcccacagtaaaatatttagttcctcttctcccatgcagcacctacaacaatactgggcacatagtctttaataaataacacttcactgatttagtgaccttttcttctccattgtggctccatcaccaattactaactgatagaactaaaggcaatagaaacaccactgctttgcatatctaaagtttcatgtgtaacttaatgtcacgaatgctgatctttcttatttggccctcttttcctgtatgttgcaactaataaaacaggtttctaataagaattaaattaaaagccaaagtttccaataaggtagtgagcattactggagaaagagagaaggccctgaaagtgattaattaacagactagcgagcattgttgcctgcctgatgagctgctgaaagtggtataagaatgggaatttacatacatcaatggttcccaaactttagtgcagtattattacttagagtgctcaagacgcatttctgaataccacctctaaagattctggggacattggcctgggaatttgcatttcagacaaatgccacacatagccctgacttaggtcatccatgcaccacactttgaattgaaaaatactaatttttatatatgacccttaggtcaaaatctgtttcattccacaggggatgaaatggttcagaaaacaaatcttcaaaactgaaatagctgaccacagtatcaatgaagcagcctagggattttggtgaacattcttcaaccaaatctacttaatgacagcaaatacatagtccttttaataatattcagtgctgtcattcagaaatgagatttaaacaaaaaagtcagtgctttaaaaagatatgaatattttatgaggttgttaatcaaaaagaaaggaagacttctactggtcaatgagaaccactggagttctagctgtcagaaaaactttgcccttctgtttataggactgtggcatctataacgagtaagaagggcttataacagtgattctcagtcaggggtgattttgtccccaaggacatttggcaatgtctggaaatatttttgtcacaactgcaaggtggtggggtggggagtgctactgggatactgctaaacatcttataaaacacaggaaagctcaccccaccccacaaataattattctgcttaaaatgtcaacaatgccaagattgaaaagccctggcttatatgatatactctagtacaatgaatgcggccaggcatggtggctcacacctataatcccagcactttgggaggtcgaggcaggcaaatcacttgaggtgaggagtttgagaccagcctggccaacatggagaaaccccgtctctactaaaaatacaaaacttagctgggcgtggtggtgcatgcctatattcccagctacccaggaggctgaggtgtgagaattgcttgaatccgggaggtggaggttgcagtgagccgagatcacgccactgcattccagcctgggtgacagagtgagatggagtataataataaataaataaaataataaattaaaaaaataaaaaataaaatagtacaatgaatgctctgtggtcatcagaggcatcacatattagaggaaaaagaaaaggcagctcaacatataaacatttttataacaaagactgttttctaaatgtgccacagccctcaccatggtaggaaaacttgatagtattccataagtcatctctctaagataaagtctgtcacaccaaaatgtttatctgaagcagtggcttcacccctcatcatagaataagctaaggagattttaaaagaacaaactgaaaatgtccatctgaaccctatgtcacaggctgaattgtgtctccccaaattcccatgttaaagccctaacccccaatgtgactgtatctatagccagggcctttaggaagataattaaggctaaatgagttgataatggtgggtctaatacaataaggcttgtgtcctcataaaaagagaaagagacaccagagactgatctctctccaagcaagaacagagaaaaggtcaggtgaagacacagaaagaaggcagctgtctgcaagctgaggcaaaaaagtgaattttctgacaccctgatcttggaattcttgtttctcgaactgtgagaaaatacatttctgttgtttaaaggcacccagtatatggtattttgttatagcagcccaagtagactaatacacacccaaagattttctttcaaatggcctggggtatggtatgacccagcactgattaattttcagccaaatcccaagtgattccaacatctagtcagaaaccaccagtctaacaccacagaatgattacaaacatgcttgaaggaatatgctgttcagaaaaattctaaggtttagcccaagatgaaaactaggatactttttgccataattatttcctctctctatcttttagtatccggagataacatggcgtcaccttcaaattcttttggcatttcatcagtttctgagttttgtgttaggagatatagttcaattcaaaaggtacactgatgaagctaatgtaatcaattatttttttctatactacggaagatggagctcttggaaaaaaaaatgatttctagttcattgtcattttctcttaagagtcaaaagtatcagtctgtgagacttttcaggagaactagatttgtatgtatacaacagagcttgccagaccactccattataaacaagaccttaaaaagctatggagtggccaagtgtggtggctcatgtctatgatccctagtaatttggggggtcaaggtgggaaaatcacttgagtccaggagtttgagaccagcctgggcaacaagtgagaccctatctataaaagaaaagagagagagagatggcattaaaaaaaaaaacattcttttgaaacaagtatatgcatttccacataaatttcaaatgaaaatgaaattaaaaactgtgtcatacctggtaaagtctggtggaacaggagtggtaacaaaagatgccatgggcttccgatgaacttgctgaaacatcataaggatctctgagctcttagatatcaactcactcttactacaagaccgcaactgtgtgaggaaaaaaattatctgaacaaacaaaattactattcactgccacctcaaaattcttaagaaattacaaattattctgattataaactgaaaaaaatgataaaaataactcaaagtgagcttgagaattaagaatgtacaaagaatctaggtttatttctataatattctaacagtaaagtcaatgaataagtatacttaatactaatgcatttttctctccttacattttaggataaatgaggttttaagcaagtacaaatatactttcaggctggtacagtgaagttcttatgaatgtattaatgaacaaaccggtaagttgaaagcttttttttttttttttttttgagacagagtcttgctctgttgcccaggctggagtgcaatggcgcgatctcggctcactgcaacctccgcctcctgggttcaagcgattctcctgcctcagcctcctgaatagctgggattacaggtgggtgccaccatacccaggtaatttttgtattttttagtagagacagggtttctccatgttggtcacactggtcttgaactcctgacctcatgatccacctgcctcggcctccccaagtgctgggattacatgcgtgagccaccgtgcccgaccaaggtgaaagcttttaaaagcaatttctcagattgtattctaggtgacagaatacaaaacgtacacacatacacccgtgtgtacacacacacacacgcactatctgatactaatttgggaaacactattttgggaaaaagtaacaaatctaacttcagtaacataaccatggtagataaaagataagactactaattttttcttcaaaaaaaccagtttgaagtaactcccaattctgccactgactaattacataactctgagtctgtttacatacaaaactaaaatagtaatatccaccactgcttacttcgtgaagtttgttataaggattatgaagctatagtgaaaaagctttgtaaactatctgttatgtgctgaattttgtgcccctttcctccataatttatatactgcaggctcaacctccagtacctcagtctatctggagataatctttaaagaggtgattatgttaaaatgaggccactggggtagggccttaatctaacatgactggtgtccttattaagaggaagagactctagggctgcacaaccacacagaaaagtccatgtgaggacacagtaagaaggcagtcatctacaggccaaggagagagacctcagaagaaacgaaacctgccaacacctgaatcttagacttccagcccctagaatactgagaaaacaaatttctattgtttaagtctcacagtcattggtattttgttatgacaggcctagcaagctaatatactatcaaatgccatatgaatgatattcataaacccacctacaggtgagtttatatcttttaaataacagttgcttaaggctcaccaaaaataacatatcatatggctgggcacaatagctcacacctgtaatcccaggactttgggaggctgaggcgggtggatcacttagggtgaggagttcaagacctcatgacctggctagttcaaggcctggccaacatggtgaaaccccatctctactaaaaatataacaattagctgggcgtggtggcacgtgcctgtagtcccagctactcaggaggctgaggcacaagaattgcttgaacccaggaggcggaggttacagtgagccaagatcacgccactgcactccagcgtgggcgacaaggcaagactctgtctcaaaaaaaaaaaaaagtatcatatatcatatgatatatatcaaagtttatagtcttgggttaccaagaataatgatatcatgtttgagctactgcatcaaccaatgacataatggtaagtggtaacagcagaaaacaacaaacagctgcatattttgtcattcatattattatgtgtcaggcattgcccaaggcattacggttttttgaacaatttatataaaatgatctaaagttatttgaactgtttgcttaagatttttaaggtatgctaaaaatcactgtgtatatgtacatacatacacacataatacaaaaaaatttaacttatattaattgaatgcttactgtgtatatccttccttgacaccatttcttccaaaagcaacttgctcccttcaacagaagtttattatcactatacatgtgtttccacaattactatgtgtgtacatacatccataaacaatgttctgaatgttttcaaactttacataaacactatcaggctatatcaccatgtagcctacatttttcagttaatattatttactttttttttttttgagacagggtctcgctctgtcgcccaggctggagtgcagtggcacgatctcggctcaccgcagcctctgcctcccgggttcaagcaattttcatgccttagcctcccgagtggctgggactccaagcatgtgccacctcgcccagctaagttttgtatttttagtagagacggggtttcaccatgttgcccaggctggtcttgaactcactcaagtgatctgcccaccttggcctctgaaagtactgagatcacaggcatgagccaccacgcccggcctatttctttacttttttaaacagatgggtcttgctatacttcccaggcgagcgccgtggctattcacaggtacaatcatagcacactgaagccttgaattcctgggctgaggcaatccttccacctcagcttcctgagtagctgggactacaggtgtacaccccatctcaatactgttttgttaaaaactaagacaatggcctaggcctacacatggtcaggatcatcaatatcaccaccttccacctccacatcttgtcccattgaaaggtcttcacgggtactagcacatatggatctacaatgctaacaatgccttcttctggaatatagtcaacgtttttttaaaaagtaggagtaaactctagaatatattctagaataatgaatggtatggtatagtaaatacataaaccagtaacacagttgtttattatgcttatcaagtattatataccatacataataatgtgttatatttttatacaactagcagtgcagtatgtgtgtttacactagcatcacaataaacacatgattaatgctttgtgctactacattacaatggctatgatgtcattagacatcactactaggcaacagaagtatttcagctccattttaatcttgtgggaccactgtcacatatgcagtctgtcattgaccaaaaggtcataatttgacacatgtttgtatatgggagatgtgtataggttatatgagaatactatgccattttatataagggacttgagtatctgcggattttggtatccattaaggtcctggggccaatgccctacagatatatatgtgtgtatgtaaaaagaaaaggaaaaaagaatggggataatgaagaaaaataagagtatttagtaaatatttatgtgctgaatcctacaagccaaattgtcaatcaagtacaaagataaaataaaaatattttcagacaatgcagtcaagaaaaatgtgttctgactacccttcctggaaagctactgagggaagtgtgatgttaaaacaaaacaagtaaaccaagaaagtggaaaccataggaatcaggaaacatgagattcaatacaagaaagatgtgaagggaattcccagaatgattaagataaaaatctcaggagacagctgtgtataaggcatagagagaaattacaaaaagcaaattccagacaagtgaatgtatcagatatttatgcaacactacatattttatttactcatttactatatgcttcatattcacccaccctaatctaaaatataaactctatgaggacagaattttaccattttgttcactgctgtatcaccaatatctacaatgatgcctgctatctatttaggacttaatatttcctcaataaataaaaatgctaaattttagagtaataatcgctacatgtaaagtaactggcaataatatctcaaagccaccacttaagtcacagtgtggggagattttaacctcttatacattcagatttctatggaaatagttctgttcttacaaagcagaatgtagttctaatgcagttcccaaacatgaagaaaaaacttggcaagaatcagctgattcctaatttcataaaaatctccattataacacaaaagatcaacagatcttttgatctcatacagataatctctgtcaaaaaaaaaacgtttataatatacagagaaggccgggcacggtggctcacgcctgtaatcccagcagcttgggaggctgaggcgggcagatcaccaggtcaggagatcgagaccatcccagctaacatggtgaaaccccgtctctactgaaaatacaaaaaaattagccgggcgtagtggtgggcgcctgtagtcccagctactcaggaggctgaggcaggagaatggtgtgaacccaggaggcggagtttacagtgagccgagatcgcgccactgcactccagcctgggcgacagagagagactccatctcaaaaaaaaaaaaaaaaaaaaacaactacagtatacagagaaaaaaggataaagactatttcattacatttaatatttcatcacctggtgctccacctcctgaagtaaggattccaaaagctctgtttcttgggttagagatgtcttctgacctgatgaaaaatagtgaatcatcaacacttgggttcattattggtttaagaatgaaattaacttccaatgaacatatttaataacaagaaatacacttcaagtaagcaaaaattcttcattacagctaccctaaaaattctcattcaactttaagaggctgaatattatagtagccttgaaaatggaacttcagaaccaattctaattagttttagacaagataccactgagatcaaattcatctaagaaacgaaatgtgcaatgacaatatactttaagcaaaaaatttacttttctagattttcatattcccttgggaagaagcaataacatgaatttcattcaatcagctattctgaaatcatttttcaccaaatttaactgtggcttaaaagagaatacaaagtgggccagatttttaggttaaatgtcagcaaaaggtctgtcctgtgaatatacaaggacctgtttaaaaaaaaaaatgcccacagaggtgaacagtctcaaaaagttggagacagaaaaggataaacaaattattactggccggggccatggctcatgcctgtaatcccagcactttgggaggccaaagcaagaggataacttgagcctaggtatttgagaccagcctaggcaacatggtgagacccagtctctacaaaaaagtaaaaaattagccaggagtggtggtgcatgcctgcagcccaatttactcaagaggctgaggcatgaggatcacttcagcccaagcggtcaaggctgcatgcagtcatgcaatgagccttgattgcaccactgcagtccttcctgggcaacagagtgagaccctgtctcaaattacaaacaaaaaaattataattacagaaattatccttatagaaaaggaagaaagtgctttatatgttttgaaacaaaaagaagataggtatgcttaccaaatcaggccattttctttgtaaacccaaaatttgaaaaactggaagtacatccatgaggacagcaaaagttttatcaatctgtagtgttatttgataaggaaaaacatttaataggtagaacttttatttattttatttatttattttttgagatggggtttcactcttgttgcccaggctagaatgcaatggcacgaactcagctcaccgcaacctttgcctcttgggttcaagtgattctcctgcctcagtctcctgagtagctgagattacaggcatgtgccaccatgcccggttaattttgtatttttagtagagatggggtttctccatgttggtcaggctggtctcaaactcccaacctcagatgatccacccgcctcggcctcccaaagtgctgggattacaggcatgagccaaggcgcccggcctttatttatttttatttatttttttgagacagggtctcattctgttgcccaggctggagtatagtggcgtgatctcggctcactgcaacctccacctctcaggctcaagcgatcctcccacctcagcctcctgagtagctgggactacaggaacacactatcacacctggctaatttttcttttttttttttttttggtagagatggggtttcaccacattgcccaggctgggcttaagagatccacctgcctcagcctagaacttttatttttgaaacaaaactcagaatttctaggttgcaaaaagagttaaaataaagtattagctagaatctaatattatcagacataatttctactataaccacatcccacaatcctaaaacattagcctatggacaacattacaatacataattaaacttaaaaatgagtggcagaggccgggggtggtggctcacgtctgtaatcctagcactttgggaggccaaggcagacagatcacaaggtcaggagtttgagaccagcctggccaatatggtaaaaccctgtctctactaaaaatacaaaaattagcagggcgtggtggcacgtgcctgtagtcccagctacttgggaggctgagatagaagaatctcttgaacctgggaagcagaggttgcagtgagccaagatcacgccactgcactccagcctgggcaacagaacgagactccatctcaaaaaaaaaaaaaaaaaaaaattagtggcagaggtcaggtgtggtggctcacgcctgttatcccagcacttcgggaggcggaggtgggtggatcacctgaggtcaggagctcaagactagcctggccaacatggcgaaaccccatctctactaaaaatacaaaaaattagctgggggtggtggcacgtgcctgtagtcccagctactcaggaggctgaggcaggagaattgcttgaacccaggaggcggagggtgcaatgagccgagatagtgccactgcactccagcctgaatgacagagcgagactccatctcaaataataataataataataataaattagtggcagatattatggtatgaattaaaaatctgaggcttataagactattctaaagataaactaaccctgaaaatatccttttccccacctcttatccttagaaagaatcctatttaatcataaaagctaccttggaaatcacaaattataatttttcataatgaaaaataatttgaaagccacaaaagcagggcaagttcagttattagaaagggaagttatttcacagttatacaggtagtaaaattaataaacttaagagatctgtactgtggtattatttgacttttagttgattcaattaaataaatgaagcaatgaacaaactcactcaagaaaaacaagaccacatgcaaatgtttatttggctacgactgaagatcacatcaacagtcaagatcccctcaattttaaagtcctaatacgtatcaacatccagtactctacatggcttaatgaacttaaagagatctcaaatattatctagagttctgaaaaactaagatcacctatatgtatgactgcaactgaggatctaagaacaattacgattttcatttacatgaaatatataagtggcattgtgaccagtacaatcaatacctacaggttttgtctaattgctccactgggtggatgaactgtgctttccaatctaactactagaagaatgattgtttaagactatttgctacttggtctgtgggaaaaaaactaaaaatcagatattaaatagtataggattataatagaaaagcaattcatgaaatgatatacaaatatacaaactcaaagatatttgcatctcatttttaaaaagttaaaaataaaatggataaaatcattattttggatgacacaaagacatggctaaaatcttggagaatcaagatagccaaaaaaaaaaaaaaaattctttgttcacaccttatttaaagtatatatatttcactttggactatgataaaaaatgcaaagctggtttttagtcagcaaaacactggaaggactaagatcaccaaaacaaatcaaacaaaacaaaccatagcattggattaaattcttacttaaaatttaagttcaataccaggctccacaatcaaagaagaatgaaggaatcttcgaaaagcaaaaaggtcagcaataaatataattaagcatatgtaaaatgaaccctactagaaatcaaaagctgagactttaaatctctaagaaaatgctggcaggggatgacgccgatgtttacaaatgtcagtttcttcatccccaatgaaaatggatggaaaggatatggaacattagtagaaggaattctgttagatttggagaaaaagctacctaacaatgatgcccactggccattaggattttcatccaaatggctatgaaaacttggattttcatccaaatggctatgaaaatttttctctcctatcatttctaaatacaagtctaacatttatctgtctaaattgtaacaacatggagttgcctaaaatctcaagattccttcctaggatgatcacccttattcttcaaagactgaatctcaaagaagctgaaagcaccaggtaccccagcagcatacataaacacttacccatcagtgttataagcttattcttcagctgtgtgtctaaccgtgcaatcatcatctccactgcattcctaatttcccgaacacgctcatcttttgcatttcttacagcttctacattcctttcctagaagataaagaggtaagaataattttaattgggtaaattttaaaaacagaagcaccacattataatattgccaagaatagataatatgaaaaaggtagttagaggaaggtcaaatggaaatgacccaacttgcttatatttcaaaatggcagacatgcaatcaaaaacacaaattttctgcataaagaatgttataaatgatcacttggttcttgattcctaaagaggtaaaacaaagaagacatctgcttttaatttaggatatggtccacaaacttcattttaagttaggaaatggtccataaacctcatttatgactgtcattctaacaacttgaaacaaaatgtattctaaaaacatgcttagtatttcattcttgggggcttatcacattttttcacagaaataacattataaatagctcactaaagctgtttgacctaaacaatatctaaacagtaatgttaaatattgcactttcaagtctgtggagttctaaatcaggacatcacaaatagttcattgcttagtaaaagaaactcacccaaaagctggggatccaaagagtgtataacttaatgaatgactgtaaaagtcaatactgattctgtttagaagtaaattattggggccaggcacagtggcttacacctgtaatcttagcactttgggaggccaaggcaggtggatcacgacgtcaggagtttgaaaccagcctggccaatatggtgaaaccctgtctctactaaaaatacaaaaattagctgggcgtggtggtgggcacctgtaatcccagctacttgggagggtgaggcaaaagaatcacttgagcccgggaggtggaggttgtagtgagctgagatcgcgccattacactccagcctgggcgacaagagtgaaactccatctcaaaaaaaagaaaaaataagttaattattgactctgtaacaaacagactttttaaattcactgattttctaattctgcataagtggtaattctctgactccaactgcttccttacaagccaggggctttgtatgcaaatttctcagatactctgaaatttatggaatttgactataggtacagcctatcaaatttgcaaatcttgaaaaccttgatttcaacatctgattaacttatattatataaatatattattatatattacagattaaaaacaaaataattatattttagtagtagtcttaccacttcttgaactaagctgatcagttccatgagacgccgacgaagtttggctacctcttcattcactttagtgacgtgttgctcataaatttctgccaaaggtttaaaggtatgtccgccatgctatttaaattagagtagctttagaacactttcacatatctcatctgcatttacattcctttgtaacactctatggacactaataaactggtaaatctctcaaatgaactttaccttattagctaatttaattttgttgaagcaggccagtgcccgcttaaaatcacttggtccaagtaggaactctttcaagattataaataaagggctttagcaaaatattcatttaactagaaattaacttattaaaaagaaccaagatctttaaccacagcccaaatcatctgccacaaccttatcagtcagtcactcttctctaaggcaaactagtcttcttccatgtcctcaaacttctttccaccaggactttacaaaaattactccctcttattaaaaaataattattagccaggggtggtggctcatgcctctaatcccagtactttgggacgctgaggagggcagatcacttgaactgaggaattcatgactggcctggccaacacggcaaaaacacgtctctactaaaatacaaaatgtagccacgcatgttggcgcacacctgtaatcccagctactcaagaggctgagacatgagaattgcttgaacccgggaggcagagcttacagtgagctgtgatcgggccactgtactccagcctgggtgacagagactctgtcccccccaaaaaataataattttttaataataaaaaccaaaaaaaaaaaaaaataaaaaaaaaaaaataataataataataataataatgctgggcatggtggctcacgcctgtaatcctagcactgtgggaggctgaggcgggtggatcacctgaggtcaggagttcgagaccagcctggccaacatggtgaaaccccatctctactaaaaaacacaaaaattagctgggcgtggtggcatgcgcctgtaatcccagctactcaggaggctgaggctggagaaccacttgaagccgggaggcggaggttggagtgagctgagatcaccccactgcactccagcctgggtgacagagtgagactctgtctcaaaaaaacaaaacaaaacaaataataataataattctccatcttccctctcccatcttggtttgtcttaatcctactcatcctttgcacttagctcagatttacaggatcagctgctatagttatgcatcctcatcagctctctgtatttattcctataatttatcaagccaattgagtatgtaattgtttgatatgttcatcaccaaatccctagtctttaccacagctgaatgaattagaaagacacttgaagaaaaagcccaggatacaaaattaacaaaagcaatgaacccattttccatcccacagagttactacagagacagaagactgatacaagttagcctcacaaatccagttgcattcagctcaaagaacaatttttatagctaactacctaaaaataattttgatttgtaaccagaattattaaattttaatataagaaacctcctataagttcttactagaattgtcttatttagccaaagtatcccattattgtctccaaaaaagatgtagatttttacatgttcactttaagtatagaaaaaaacatttctactgtctcttacaaaacctatgtatttaaagtattaaatgtgagaacttaattttttctagttagcacattaatattcaaattctagcagaaagctctgaattgagctctactcaaccaatctggcctgccactctctccgtaaaacatactgactgatgcccacagaatgatcaattcttatagcaactctagatacctacccacttccatttcacccataacttatttttcctaagaatctattgtgtttattctcaacctatttatgccaattgtacttattattgtaaggagatcatttaattaagtattcagaggctgggcgcggtggcttacccctgtaatcccagcactttgggaggccaagtcaggtggatcacctgaggtcagcagttcaagaccagcctgaccaacatggagaaaccccgtctctactaaaaatacaaaattagccaggcgtggtggtggcacatgcctgtaatcctagctactagggaggctgaggcaggagaatcacttgaacccgggaggcggaggttgcagtgagccgagatcccaccattgcactccagcctgggcaacaagagcgaaattctcaaaaaaaaaaaaaaagtattcagtaaacaacagaacacgactttaaaataaaaaagctgcttctaagaaagctaacttcaatgcttcaggctcaataatggtagactgtctttaaaaactgctcttgaattcaattggaaaaaataatctaaaaaataaaaaataattataagatctagataggcgtactcatgttgtttcacaagtgtctaagttcgtgctccattttaaaggaactaaaattggaaatgttggccagtacatctgatcaactgacctttaatgaaaaaagtgacctagatcctacaacgaaaagatctgcaaatgaatagaggatatgttttataggtgttacagattaaaatatttacataaggggtccatcaaaccacacaaacaagattcttctggaataaaagtacaatacctttaataaagcgtatagaaagcagatgcattttaactttcattctacgagagcataatgacactattttctatctgaataagtatttcagtgccttctagcctctaacttaaaaaaaatactgaatttgttctgctcaccattcctccccaaagtgcacactgatggcagatacacttcttacaagtccagcaaaatacactaagtttttcatggtgattttcacatctatacattatgaaaagaaaatgaagttataaattaaattggaacataatcacctccacaaattcttaagcttgggcaaacaggtcagttttaaatgattatatctcaagaaacacagtataaaatgtactccatggcttctgaaaaggaagctaaagaagtttatgcggacaattttttgtaaagtactgttttcattgatctggactttataatcacatgcgaaatacagatttgcttcttaaaaacataacacatattgcatcatttccacacagcactacagatgatatattctattgtactactacattttgggcatgtgcttaataatcatattgattatgcatctatacctacatgagcatgcacaagtacttttcctacatgtggtcaacgataacaataatcaagacacatgattaactgcacgatttaatactagaccctcatggaaaatgaacaactcaattttaaatgttcttttaaactggatattcacatgaaaaacaataaagttagactctgttatggattaactatgtcccccctcaaattcataggttaaagccttaacccccagtgtgaatgtatttgcagacagagcctttaaggaggtaattaaggttaagtaaggatcacaagggcaggacccaaatccaacaggactggtgtcctctataaagaggaggagacaccaggcatgcacgtgcacatagcaaagatcatgtgaggacagagctaggtggtggccatctataagtcaaggagaaagggaggcctcactagaaaccaacactgctagcatttaatcttggacttaacacctatcagaactgtgagaaaataaatttctattgtttaagctactcagttagcagtattgttatgaaagacctagcagactaatacagaccctcactttataccatatacacaaataaactacaggccgggtgcagcggtggctcatgcccgcaatcccagcactttaggaggccaaggcgggtggaacacttgaagccaggagtttgagactggcctggccaatatagtgaaactccttctctactagaaatacaaaaaattagctgggcgtggtggtgcactcctacaaccccagctactcagaaggctgaggcatgagaatcgcttgaacccgggaggcagaggttgcagtgagctgataatcacaccactgcactccagcctgtgcaacagagcaagactctgcctcaaaaaaaaaagaaaagaatgaaggtttaacatccagaatatataaataacacctgtaactcaacaaataaactttaaaaactctaatttaaaaatgagcaaaagatctccagtaagcatatgaaaagatgctcattactactaatcactagagaaatgtgaatcctaacctcataccatattaggatggttgctatcaaaaaaacaaaaaagagcaagtgttggccaggatgtggagaaactggaacccttgtgcactactggtgggactgtaaaatggtacagtcactatggaaaacagtatggagattcctcaaaaacttaaattaaaaatagaattaccacatgatctagcaattctacttctgattacataaccaaaagaactgaaagcagagtctcaaagacatgaacatccatagtcatagcagcattattcactacagccaaaaggtggaagcgacaccaattttcactgagagatgaatggacaaaaaaaatgtgacatatacatacaatataatattattaacccttaaaaaggtgggaaattctgacacatggatgaaccttgaggacattatgctaagtaaaataaaccagttacaaaaagagaggtactgtatggttccacttatatgcagtatctagagtactcaaacagatagaaacagaaagtacaatggtggctgccaggggctggtgcgaagaaggaatggggagttgtttaatgggtacagtttcagatttgcaagtttaaaaagttctggagattggctgaacatgtgaacatgcttaacataactgaactgtacattaaaaaatgattaagatggtaaattttatgtatattttaccataattaaaatgttttaagtattctcttgtttataaagtagacatactcttgcaatttttttttttttttttgagacggagtctagctctgtcatccaggctggaatgaagtggcgcgatcttggcccactacaacctccaccttctaggttcaagcaattcttgctgcctcagcctcccaagtagctgggattacaggcacatgccaccacgcccagctaatttttgtatttttaatacagacagggtttcaccatgttggccaggctggtctcgaactcctgaccttaggtgatccacccaccccggcctcccaaagtgctgggattacaagcatgagccactgtgcctggcccactcttgcatttttcaaaaagcatttcattgatgaaggacactgagcttagagaaaatacttacataagtttatattttatatttctaattcataagtaatcagaatataaaatgggaaatgaataagagttagaatacatcaggtactgtttggaagctcatttagcaagacttccaaaagaccaaatttataatatagcttttacaatatagaaaatttgccaaaactcctcttaattaacagcctgtattcacttgcagcaaggggaggccagtaggcatcaaacagcaagtaagaaagactagcaggttagcaaattgtagcagtctattccttttgagaggctctaatagaagaggcccaaaaagaggtaaaaggtctttccaaacagtaatacccaccacttcagaggaaaaacacctaagtgttcaccaaagaaatgtgccattgtatagaaaagaaattaaataattatttttggtgagacctctacaatgctacaagtgacagaattccttaaaagtccagttaaacttgaatagcaggtttttggttttgtttttgtttttttgggagatggagtctcgctcgttacccaggctggaatgcaatggcacgatctcggctcactgcaacttacgcctcctgggctcaagcgattctcctgcctcagccccccaagtagctgggattataggcgtccaccacgacgcccagctaatttttgtatttttagtagagacagggttctccatgttggccaggctggtcttgaactcctgacctcaggtaatccacccacctcggcttcccaaagtgctgagattataggcatgagccaccacacccgcccgaatagtaggttttaattctgattatgcattaatgtgttatactaccataattaagcctctttctttttttttttttttttctttttttaagagatgggttcttgctatgttacctaagccatcctctgggctcaagagatcctcctgcctgagcctcccaagtatctgggactacagatgcacaccaccacaccctgttctcttatttctatggttctatttcctcagtataatgaagaaacagataaatttttttctaatgacctgtgaggtttcaacctcttgctttaccatgttgtgactctacagaaagtgacaaggctttatttctaaacattcaggggtcctggaatctcacctaattcaagttattttattattgctggacagtgaagccttacaattaaccatgttgtagcttcttcatctataaaaaccaatcactgccacatcactctttcctttctttacctgctccccataacaactctccagatatgttcaaaattcttcaatcatggaacataagaccatttattcattcttgtcccttaaatgacttaacactgtattatcactgtgtccccattaaacagttaacagaaatcatgtctcatttacctttgtatgcctatcatctagcaaagtactttctgtgtggggggaggggagggcgagaggtatctgtgtatacatggcatgaaataactgttgttaaataaacacaataagaatatgttacttaacagtaacagcgcatgactgaaagaattaaaaacaagaaatataacactacttattcataaataactaaaaggcaactaccaatatagtgtcattaaacaatacaaaggcaaaatccattcaatattgaacaaagaaattgaggacatacttgtccttttcattttcttcatgtttggtgagactgcagagttgaagagtatcaagctgttgtgttacttcttctgcccaacgacaatttactagttctcgtagctggagtggagcactggggagaaaatccatacacatacactaattcaggaatttgagattattttataaaataaatacgtttctcaaaatagagagcacaataatactcataccataacactattttttttttttaagagatgagtctcactctatgacccagggtggaatgcagcggcatgcatgatcatggttcactgtagccttgacctcctaggctcaagcgatcctcctgcctcagcctcctgagtggctgggactacagcagcacaccatcaaacccagctaattttaaaattttttgtagagacgggaatcttgctatatttcccaggctggtcttgaactcctggcctccagtgatcctcccaaagtactaggattacaggtatgagccactacctggccccataatactattaaaactaaaaaaataaaaaataaaaaaaaagacaatgaaaaatattatctgtgacttattttcaccacattaacacgtcatttatgaaaagaaacaaaaagctaaacaaaaacatatgattcagaatatggactgaattctcaacttctgagtctaaagctgtactgttggcgtagtggctcgcgcctgtaatcccagcactttgggaggctgaggcaggtagattgcttgagcccaggtgttcgagaccagcctgggcaacatgatgaaaccctgtctctataaaaaattagccaagtgcaatggcatgtgcctacagtcccagctacccatgaagctgaggtaggaggaccacatgagccagggagattgaggctgcagtgagccaagatcatgcctctgcactccagcctggggaacagagtgagagcctgtctcaaaaacaaaacaaaacaaaacacaaatccacagctgtgctgtccaaaacgatagccactagccacatgtgactcttttaagttaaaattaaataaaaataaaattttggccaggtgcagtggctcacacctgtaatcccagcagtttgggaggccacagcgggtggatcacaaggtcaggagatcaagaccatcctggccaacatggtgaaacgctgtctctactaaaaatacaaaaattagctgggcgtggtggcacgtgcctgtaatcccagctacttgggaggatgaggcaggagaatcacttgaaccagggagtcagaggttgcagtgagccaagattgcgccactgcaccccagcctggcgaaagagtgagactccatctcaaaaataaataaataagtaaaatttcatcatatagccacactagacacatttcaagtgatcgacagccacacacaactagtggctaccatactggacagtgtagacatagaacactttcatcattataaaaagttctacttgataatgctggtcttataagataatgtaagaaaggtgggacgaggcacagtggttcacgctgcaatcctagcacttcgggaggtcaaggtggtaggatcccttgagcccaggaagtcgagaccagtttggccaacacagtgacatctcatctctacaaaaaataaacaaaattagctggcatggtagcacacaccagtggtcccagttaggaaggaggttgaggtaggaggatcacctgagcccaggaggtcgaggctgcagtgagctgaaatcacgccattgcactccggcctggacgacagagcgagactctgtctcaaaaaaataaaaagaaaagtgaatacaaaaagaaaaatggttaacagatggcactccagcattattttttgaaaccaaaagtagagataacctaaatgtctctcaatatgggcataaataaatcaaggtatagtcataaaactgattatcagtcacttttttaaaaaatgacttatgtatacatacaatcaagaaaagatatctaccatattttacatgaaaaagcaaactgcaaaacaatattatatcattggtacattttaagaaaaagcatatgggaatcacatacgcatatatatatataaatataggcacaatcatactggattagggcattacaaaatacatgcacaaaaaacagtctagaagaatagataccaaacccaacaatttcttctgaaagtattattaagtgagaagacagggtagggagtatcagaatcagaaggctttttattttattttatatttatctctaccatctggatttttttgtttgttttttgtttttatttttttgagacagactctcgctctgtggcccaggctggagtgcagtggcgtgaccttggctcaagtgcagcagtacgatctcagctcactccaacctccacctcctaggttcaagcaattctcatgcttcagcctcctgagtagctgggactatagtcgcgcgccaccacgcccagctaatttttgtatttttagtagagacaaggtttcactatgttggccaggctggtgtcgaattcccgacctcaggtgatccagccgccttggcctcccaaagtgctgggattacaggtatgagcgagccactgtgcccggccaagctatctggatttttttaaccagaaaacattaaaattttttgcttaattataaaagataaattatgccctaactatctggattttttaaccagaaacattaaaaatttgttgcttaattataaaaggtaaattaagaagttatacaatgattttctgagaggcagagtacaacatagtaaacgtaattttaagtcacatgaattagtccctgcatttctttttctagtcaaattgcttatttctactcaactatcttcacgaagaagagaaatgggcagactgcaggaaaactgcctttatgaatcccaaggcacattctgatcttactattttcaaaattcacaaataatcgtaaggaaacacttaccggcaatgaggacattgagctctctgctctgtcagccagcgctaagggggcaaaagattagatatcgattagaaaacatcattactatatatatatattacttaatattttatatttatatataatatatataatattcttaatatatataatatataaatatataatattcataatatataatatataatatattattatataacatatcatatatatataatgtataatgtataataatgtataatatattatacattatatatataatatatataatgtataatatattatacattatatatataatatatatataatgtataataatgtataatatattatataatatttatatatataaaatactacaaatctaatgggtttaactctctagtgcttagttttagagatacttataaaagtaacaggcaatctactgtttccctcactgtcatcctcatagggataaacttttgaagggacaaaactcaacacaaaatagctgttaaaaggctactctcacacaggaaaagcaatgatttcaggactaactgattctcacagggaacgtctatataatcttattattgtcttataataatggcactgtctcctttgcactcaaaaataaaccacagtgatgatttatttctatctagtttactactaaatttattttttgaaaagctaattcgaaaaaaaaaaggaagctaattctgagttacatacattatagacatgtaaattaaaccgaaaaaaatgaataagcaatacagcacaacttttaagtcttaaaacagtttcacagggctgggcacggtgtctcacgcctgtaatcccagcaatttgggaggccaaggtgggcagatcacctgaggtcagctgatggagaccagcctggccaacatggtgaaaccccgtctctactaaaaacacaaaaattagccaggcatggtgatggtggcaggcgcccataatcccagctactcgggaggctgaggcaggagaattgcttgaaccaaggaggcagaggttgcagtgagccgagatcctgccactgcactctagcctgggcaacagagcaagactctgtctcaaaaaaaaaaaaacaaaaaaaacggtttcatagttcagtaattgaagcttctagatatcttggtttcctcataattataaaaaggttttagaagagaataatgtctctactaaaccaaaaattatattaataatttattaggaaactgagagcaatgttataccacatataaaggagatgttaagattttctgactagttttcaggaaacaacaggtttataataaaaaaaactttatgttttaattgtctgataaataggttcagaggtaaataactatgatcctacaccaacgtactcccaatatctgttatttgtttatctctttctactttttaaaatgaacatgagctttaacttgatgccaaataattaacttagaaataaaattcccaaggaaaccttaaaggacagtaaaagacttaaaatgatagcaagcaaggtacttcagagcaaagaaaataaagctgaaagaaaaagcatacagagcacgcctgtaatcccagcactttgggaggctgaggcgggtggatcacgaggtcaggagttcgagaccagcctggccaacatagtgaaatcccgtctctactaaaaatacaaattgagccaggtgtggtggcatgagcatgtagtcccagctactcaggaggctgaggcaggagaactgcttgaacccaggaggtggaggctgcagggagccgagacagcgccacggcactacagcctgtgtaacagagcatgattctgtctcaaaaaataaaataaaaataaaataaaaagcctatggaaaaggattcctccattcttaataaccttgaacattattattaccttggtccctaggcaaaaacgaaatttgggtcaggtttcttcccctgaaacaatggcatgaccatgccactcttctgttaaagtcacagctcctctccagaactggtctcatgaactcctctccagaactggccctataacccagcaaggtaatgtctttacatgtttcctctctctgcctaagatattcttcaaaacctttcttcatctgggttactcctactcattgtttagatttcagttcataagttgctttctccaaaaagctttccctgacactctgcagactattttagatacaattgccatgctctaccacagcaacctacacttcccccttcagatactttattacgacgacttatttgttggtctcctttgccctgctagactataaaacttataaagactgggactatgatagggagtaaccagatcgtattttaaatgtctccctccctcccagtcaaaacaggcttactgctgcactatataacactgtcgatatatctgtgcatttgcttatatggtccctccctccatatcccgtctcatagaaatgtcactggatcatgtccataaaatttcctgcctttcccaggctatagtgagttttacattctctgaatatttgtggtatttttatcttgtattccacaatctaatttatttatttattttttgagacagagtctcactccctcccccaggcttgagtgcagtggtgcaatctcaactcactgcaacctctgcctcccgggttcaagcaattctcatgcctcagcctctcaagcagctgggattacaggcatgcgacgccacacccagatggttttcgtatttttattagagatggggttttcccacgttggccaggctagtctccaactctgacctcaagtgatctgcccgcctgggcctcccaaagtgctgggattacaggcatacaggcatgaaattgctcagcctccacaatctaatttaattacaaaataaatatgacaatgttaatactttgagaaaagcaatgtttctctcaaaccaaaaccaaagaaccagtggtacaatattaatgcataatattaaacaaatatctttagagcattccccctcattcaattaaaaaatcataaacataaaataaaattaaaattaaaaattattttctctccttcattaaactggaagaatcacaagctttagaaagtattcagatctgtgtctgattcccagctctggcacttatggaccacatgacattggacaagtgactgagctcgtctcctcatatgcaacaagagaatcaacatatctaccctgcaaaaccgctctaagggttagagagaagctgttagcaatatatactaagtatctaagataatcttaaaaaaaaaacaaactggctgctaacatttatagttcaattactactggatgtgaggaaaaaggaagattaaggtgagctaggtttttggataaaaaactgggttcctgactggaaaagaaacagatttggcatggtgaaaaacaaaaacaaaaacaaaaacaaaacaaaaaaaaacctcttatagagacgatatatttcagatgcatactacaagtccaaatgaaggtagttagatactggaggcagagaaaaggccaggactgaaaagataaagttgggaagtttaagtctagaggtagtgttaaaagtcatggaccagtcgggtgtggtggctcacacctttaatcccagcactttggcaggccaaggtgggaggattgcttaaggccaggagctccagatcagcctgggtcacatagcaagataccatctctacaataaatttaaaaattagccgggcatggtggacacgcctgtagtcccagctactcctcaggaggctgaggtgggaggatcaactgagtccagaggtcagggctgcagtgagccatgatcatgccactgtctctagcctggatgacagagcaagactcggtctcttaaaaaaaaaaaatccatagaccatgaagttactaggaagatggtatagctattatggcaaagataccaaagataacgtttcaagaaaaacagatgaagtaatttatgctgaatgctccgagaaggaaagataaggccaacaaaaggttcattggatttagcaaaactgagtctacactttgcaggagctatgtgagtagtgtggagggagctaaagccaagttagaatgggttgaagggtaagtagatggcaaggttgcagggaaatggagtggaaaacactcttttaaatacttttagctataagagaaaacaggcagtaaataggaaatttgttaacaaaggacttttattcccaaacagctcaaaattgcaaggaaactaggaggccgatcatagaggatcttagatgccttgtgaaagcatacaaaatttcttacatcccctaatgtactgtttgaggcaaactatatatacatacaaaaacatgctaaatactttctggggttgtttttgtttttgagacaagtctcactctgtcactcaggcaggagagcagtggcccaaacacagctcactgcagcctcaacctcttcatctcaagaggtcctcccacctgaccctctgaagtagctgaggctacaggtgtgcccaccacatccagctaattttttaattttttttgcagagatgggatcttgccatgttgctcagcctggtcttgaagtcctgggctcaaacaatcctccatctttgggcctcccaacgtgctgggactacaggcatgagccactgtgcccagactaaaatagtttcttacaaacatctataccactaaactataacaaaagtccacttcttatggtatgtctaccaaagaaagggaaaagctgtccttttgttcatttccaaaaacctgtaagaatgagtaattatcataaagattgtatatattaattatctagcatacagaactaaataagccagatggtaaataaaattactgttagtgtaacaggagaccaaaaaaagagagtttaaaaaaaaaacatcagccgggcacagtggctcacgcctgtaatctcaatactttgggaggccgaggtgggtggatcacctggagtcaggagttcgagaccagcctggccaacatggtgaaaccccgcctctactaaaaatataaaaattagccaggcatggtggtgggtgcctgtaatcccagctactcgggaggctgaggcaggagaatcgcttgaacccaggaggcagaggttgcaatgagccaagatcgtgccactgcactacagcctgggtgacagtgagactctgtctcaaaaaaaaaaaaacaaaaaaaaaaaaaccaactttgtaacagaaaacaaggtctttaagaaacattaattacagcaattattaaaaatcttagatcatgggctcatgattgattaaatactatttccaatgcctaatcctgcatttgaaattaattaaaaatataagtatttattaaattccttccatttcttcagaatataatcagagatatcattattgacatgtactgtgcatcctcattcataatgctatatgaaaaattttaatgtatatgtggtctgggagtttaagatatttactagagaaattgtgctagggaaatcctcaacaaaatcccaataaaactaattcaacagactatttaaaaaattatacactgtggccaagtgggatttattcctagaatagaaagatgattcaactacaaaaatcattcaatgtaataaaccacttcatggaaaacccccactatgatcatctcaattgatgcagaaaaggcatctgacaaaatccaatatcctttcatgataaaaatactcaatagaaatagaagggaacttcctcaacttgataaaggccatatataaaaactcataaaaatcatagtcaacgattcaaaggctaaaaactcttccccttaagatcaggaaaaattccccttaagatcaggaaaaagacaaggatgccagcttttaccatttctatttgacataatacaggtactaaaaattccagccagagtacttaggcaagataaagaaataaaaagtatcctaattaaaaaagaagtgaaattatctttttgcagatgacatgatcttatctgtaaaaatccctaaagagtccacaaaatattgttaaagctaataaacacaacagttacaggagacaaacacacaaaaaacactggcatttctataagcttgcaatgaacaatctaaaaacgaaattaagaaaataacacatttgcaacagcatcaaaaggaataaaatgcttagggaaaaaaaaaaccaagaatttgaaagacatacatggaggctgagtgtggtggctcacacctataatcccagcattgggaggccaagacaagagggtctcttgaacccaggaagttgaggctgcagtgagccatgatcgcatcactgcactccagcctgggtgacagtgagatcctgtctcaaaacaataaaaaacaaaaagaaagacttatacgtgcaaaactacaatacactgctcaaagaagttaaagaagtcctaaataaatggaaagacacccatgttcaaggatcataagatttaatattgttaagacagcaatattactcaaaggcatgtacagaatcaatgtaatccctactaaaactccaatggtactttttatattggtagaaaactgcatttaaaattcacatggaatctcaagggatgccaaatagtcaaaactatcttgaaaaagttggaggactcacacttcctaatttcaaaacttactacaaagctacagtaatcaaaacagtgtggtactaccataagaacagaaatagagactaatagaacagaatagagaggtagaaataaacaaaaatattttatgattccatttatatgatgtacttagaatagtcaatgtaaagacagaaggtagaatagtggttaacaggggctagggggaagagaataatgagaatttattgtttatcaagtacagagtttcagtttgggatgatgaaaaagtactaaaggtggatagtggtgatggctgcacaacaatgtgaatgtacttaatgccgctaaacagtacacttaaaaatacagttaaaattgcaaatttggctgggccaagtggctcacatctgtaatcctagcacttgggaggccaaggcaggcagatcacttgagcccaggagtttgaggccagctttggcaacaaagtaaaaccctgtctctacaaaaaataaaaaaattagccaggcacgatggcacacacttgtggtcccagctactcaagagtgtgaagcaggccaactgcttgagcccaagagattgaggctgcagtgagccatgattgtgtcactgtgctccaacgtgggcaacagagtgagacactgtctcatttaaaaaaaaaaaaaaaaaaaggctaattttacattaggtatattttaccacaattaaaaaaaaattaacagaataccatatgacccagcaatttcacttctagatatatattcaaaagaaatgaaagcaggaactcaaacagataattgttaacaacagaactattaacaatatccaatatccaaaaagtgaaaacaacccaagtgtccatcaagagataaaaatggataaataggctaggcgcggtggctcaacgcctgtaatcccagcactttgggaggccaaggagggtggatcaccaggtcaagagatcgacaccatcctggccaacatggtgaaaccccatctctactaaaaatacaaaaattagctgggtgtactggcgcacacctgtagtcccagctactcgggaggctgaggcagcagactcgcttgaacctcggaggtggagggtgtggtgagccgagatcgcacgattgcactccagcctggcgacagagcgaggctctgtctcaaaaaacaaaaaaacttaagaaaaaggataaacaaaaagtggtatatagccatgtgtcacataaagatgtttcggtaaatgatggaccgcatatactacagtagtctcgtaagattagaatggagctgccctacataggtgtaccattttttatcttttatactgtatttttaatataccttttctatgtttacttatgtttattttcttttttctttttttttaatgggtacagactttctgtttggggtgatgaaagattttggaaatagtgatatggttgtataacattatgaatgtaattaaagacaccgaactgtacccttaaatatgggtaaaatggaaaattttgttatatttattttagcacaaaatggggggcactgaacagaccccttaccaaagacaacatatggatggtaaataactcctggaaaagatgctaacatcattactcaacagagaaacgctaactaaaacaaggagatacctgtaagaatggctacacgtccctgagaatggctaaaattcacaaaaccgaacacaccaactgttagcattaatgtggaggaattggaactctcataaacttctggtgagaatgtaaaattataaaactatttccttttttttctttttgagacagagtttcgctcttgttgcccaggctggagtgcaatggtgcgatctcggctcaccacaacctccgccttctggattcaagtgattctcctgcctcaggctcccaaggagctgggattacagacatgtaccaccaggcctggctaattttgtatttttggtagagacagagttctccatgttggtcaagctggtctcgaactcccgaattcaggtgatccatccacttcggcctcccaatcctttttttaatttaaccttcatccctctcctcctctccctcttttgaagtccccagtgtctagcatttccccctttatgtccatgtatgctcattgtttagctcccagatacaagtattttagaaaatagcttggcaattttcaaaatgttaaacacacatctaccacataatctctatccgttccattactaattatttacccaagagaaaagaaagcttcttgtacacgaatgttcgcagcaattttcactgtaatagcaaaaactgtaaacatgccatatgcccatcaacaggtgaatgcataaacaaattgtggtaaatacatacaatggaatactacttagcaataaaaaggaatactactgatacatacagtatttttgctgagtgaaaaaaagccagatccgtaagagtacatattgtatgattttcatttgtataaaattccaaaacatgcaaacttatcttttttctctttttccatcccccttatctctgaagcaaacttatctatcgtgacagaaagcagatcaatggttgcctggggacaaggcaagtagagggaggaattaccaagaggcacaaggaaacttttggggatgacagatatattcactaacttggatgcaatgattgtctcacaagaatacatatatgtcaaaactgtacacttggccaggctcagtgactcacatctgtaatcctagcactttgggaggctgaggtgggtggatcacctgaggtcaggagtttgagaccaacctgaccaacatggtgaaaccctgtttctactaaaaatacaaaattagtcaagcgtggtgatgcatgcctataatcccagctacttgggaggctgaggcaggagaatcactcgaacccaggagatggaggttgcagtgagcggagatcgcgtcattgcactccaggctgggcaacaagagcaaaacgccgtctcaaaaaaaaaaaaaaaagaacaaaacaaacaaaaaaactgtacactttaaatatgtgtagtttactgcatgtcagttatacctaataaaaaatgactggcttgaaaacaagtaggcaagcaatcaatatttgctgaatgaatgaacaaatgattagtgcattcaggaaccaagacagccctagaaagaaaggtcagaaccagatctggatggtctgaacacaaggctaacattcttggattttatcctttacataatacatttctgaggcttctggggaaaagaaagagatatcagtgaaaaatattaatatagtagcaggacagaaaatggactggagataagaaaagactcaaacctgagagatcagacagaaagtaattaaataatctaagcatgaggtaaccaatgttcatacttctctattagcatggtaatgataaaaacagaagggtaagacaaatataagtgaaacagggagataataactaattgcacttaaaaatcattggtataggccagaggcagcggctcatgcctgtaatcccagcactttgggaggccaaggagggaagatcagttgaggtcaggagtttgagaccagcctgggcaacatagtgaaaccccatctctacaaaaaaaaaaaaaaaaaaaaaaatatatatatatatatatacacacacacacacacacacacacacatatatacatatacatgtttatatatatacatatatacacacacatatatacatatatatatacaaaaatagccgggcatcatggagtgcgctgatactcccagcaacttgagaggctgaggcaggaaaatctcttgaacctgggaggcggaggtcgtagtgacccaagatcacgccactgcactttagcctgggcaacagagcaagaatccatctcaaaaaaaaataaaaaataaaaaataaaaaaatcattggtataaagtttccagtttgagtgactagcagaacagaacaaaaagaatgaacttagaatcggtttgagaaaataatatgaataatctgatcttgaacaaagttcaagatgctagaaggacaagacatccaaaagtcagtgctgaaggaatagatttaggagccatacacacagagatgatagctaaagctgctaaagtaaatcaaatttcccaaagtaggtgaatactcccagaaacctcagagtagagaacgacagcaacaagatcttaggaaattaagaaataaatgcatttaaggggcaggaggaagaagatgtaacaatgaaaaaatacagaatcaatgaggcataaggtaacaaccagagaccataagcacatgggaccttcatcaaaagaaatgcgcccagatccagattctaccacttaattaactataacggagtccaattacttaatttatctagcatcagtttcactgtttattaaaacatgggtaagtgttaatgtgtattagttgctattttaacaataaaataacaccttacaaacaagtagatatagtatttcataatttctgaattactccttaggttatctcatttaatgccataaccaccctgtaaagcaaatcatatctgaattctacagctgaagaaagaaggccaagaaagagtgaatctcttagttttagaagtatgagaactaacatcatatttaactgggtcttctgcgcatggtacagtgacaaagaacaggctatagagttcttgaacttaatgggttcaaatccagtaccatcaattgtgagctgtgtgactagaaaaaaattatttaagtgttacggataatactcttgacaaaggcatatgtatcttccttaggcaagaataaggaaacagaaattttttttttttttgagacgaagtctcgctctgtcgccaggctggagtgcagtggcaccatctctgctcactgcaacctctgcctcccgggttcaagtgattctcctgtctcagcctctcgagtagctgggactacaggagcatgccaccatgcctggctaatttttgtatttttagcagagacagggtttcaccatattggtcaggatggtctcgaactcctgacctcaggtgatccacacacctcagcctcccaaaatgccgggattacaggcgtgagctacctactgcgcccagctgaaacagaaagtttgaggtgaagagcatgtgacctctttgattttctcaggaaaataaataattgaaggggaatgtgaacaaggcagttttcaactatgctctgtagatgtgctattggactctcgcatacacaaccaaaatcttggacttcctcattttgttattttgttttttgtttttttgagacagagtctcgctctgtcacccaggctggagtgcactggcatgatctcggctcactgcaacctccgcctcctgggttcaagcgattctcctgcctcagcctcctgagtagctgggattacaggcacacaccaccatgcccagctaatttttgtatttttagtagagatggggtttcaccatgttggtcaggctgttctcgaactcctgacaccatgatccacccgcctcggcctcccaaagtgctgggattacaggcctgggccaccgcgctcaggccaacattcaagttttttttttttttttgagacggagtctcactctgtcgccaggctggagtgcagtggcgctctctcggctcactgcaacctctgccctcccgggttcaaacaattctcctgcctcagcctcccaagtagctgggacacaggtacatgccaccatgcccagctaatttttgtatttttagtagagacagggtttcaccatgttggccaggatggtctcgatctcttgacctcgtgatccacctacctcggcctcccaaagcaccaacactcaagttttaaagccactagattatattcatctctagagtgtcttgtaattgtaagattaaacactttttctctatcttactcaccaaacacatataaaccagtcctcttctgagccccacagcacttctttagtgcctccttatgataccgcacattcttcaaaataaacattctaaactccattccctcaattagatttaagctccttcaaggcaggcaatttgtcatttatcttagtattcctcaaccccaagcacagtgcaagcaagcactttagggcaaaaaatgtaaaataaaaagataagggaaatggttaatccttacaatatatactatatatactaactgcatgtaaaaagaaatacaacttaccctaatacagctgaaacaacacagtttggagcaatgaggacacaggcgtgcatcccgcaatttctccatacaaatgaaacatcggaaaacctcagcaatgctctgaaaacagtaaaagatgtaaggtccaccagtttaggctactgaatcaagagtaaaaggcaagctcaaaacaacttgacatttacatttattttgggctgatctctcaattttaactattccatatcaggatttggttggtcaagatacagagtacctcaaaacatctggaaaatgtactcccgtttggtttcacgatgattctattctaaggaaaatataggaaatgcaaacacagacatgcagaaaaattttcactaaagcagtaattataatggcaagaatctaggtacagcccaaatgtccaaatattaagtaaattatggcagttacacatagattacagtcaccagaaatacttcttcatctaatgatatagaaaaatgcatataatgtataacagcagggaaaaaaggcccaggcatgatggttcattactgtaatcctagcactttgggaggctgaggcaggtggatcactcgaggtcgggagttcgagaccaacctggccaaaatggttaaaccccgtctctactaaaaatacaaaaattagccaggcgtggtggtgtgcacctgtaatcccagctacacaggaggctaaggcagaagaattgcttgaacctaggaggcggaggttgcagtgagccaagagggtgccactgcactctagcctgggtgacagagtgagattctgtctcaaaaaaaaaaaaaaagaaaaaaggaaaaaaggcagactatatgactgaatacacaacatgaacttttaactttttctgcaatttccccaaaaggtataaactgattttataatttagaggaaaaagaagtttaaaaagacacatcctaaaggcagtgtactgtgacccagaaaaaaatgaattcagaatccagaaatctgaattgctgccctgatgttacaacagactagctacttatttgaacctgagattctgccccaattgaaaatgttgacggtagttcaaagcgatcttgggaacaacaacaacaaaaatatgtaaatacaagaaacagtattatgtttgcaagcctcaatttaatcaatttaggaagtaactgaaaagtttttaacaagaaaaaggatacaattaaacgtatacttattgtattgtatactttgtttttatattactgacatttactttcactccattctagaattaaaccctcctaaaaccaagataagtttacaaaacctttataatactttatatgaggaattaaggagaaaattactcattaatctcatcatgactctgtagggccagaaagaacctgggagatgcagattctgtaacctgcaacggggtggacaataagactactgaatgactagtttcaagtggaatatccataacatagttaccccttactaaaaagcaaggatttcctatttcagtatctgaaaggttcaaaatttgataatgattacacaattatgttcaataaacaatcttttaaaatatattcctagcctttacttacatatcctacatatcccaactattttaactcacagcttacaagaatcagttataaaaagaagagtttgttctggaaactacacatgagataatatatgctgattcaatctaggaaggaagggcagaagcctgcaaaatgtgccactgagagggaaagatgactatccatttggaaggagatttagatcagctcaagaactcgcaaggactggtggcgagtggcagggtacatccatctgatgaatctgcagttttggtcggaaaaggatgctgtttgcaaacacccggtggggatgagtacctgtgccaagacatccttgaaaactccaggatacgcaccacctgactgcggaacagtgagcacaagacacccggagcgctgcagaatgggcacggcatccttggtaccgggccagccctctccacagcggcaggggcggggtaggggtgccctactggagggaggacatgggcacgactccccgaataaaaaccgctcatcgggtgggggcggggactaaccaccaccctcacaaccccctcacctccacgctctgttcatccattgcctccggctctcggcggggccgctggcgacccgcaggctccgcagtctgacctcttaggcgccggcccgaggtcgccagatcaaatcgccgataaaagcccggcgcccacgtcagggggctctgacaaccgccccacctgcgcgccccatctcttcaggtccagcgccgcctacccccatttcgccatttttaccggcgcgcccgccccgaggcgcagaagtagggcgaacggtggccgcagctcctttctcccggctcagccgccggccagcagccgcgccggaacctcggcccacgtgacgcgggcgcgcgcctatggaactgacggtggagttcagcgaagaaggtgccgcagagaattcgcaaacaccaaccgtaaccagagcagctgggggcgcggcggcgagagaagctgcgaagcgcatgcgcgcaggacgctgt

SEQ ID NO: 2841 - DNA, 108706 bp, Homo sapiens
  source 1..108706: mol_type = genomic DNA
tattttctcaagttgattttattaacaaaaagtgcaaactattttgaacaaaagtaaactatgagtcacagcattcagcaagacatcagacacggaagagtgaacaatattcactaagtaaaatacagcagatgagatgtctctcacatgtatatttaattattcatgctttttcaatagtctcttagtcaactttcagtgtaatttccacaaatatatagcagctcaaacacaaatgcaggagcacaatggcaaagtttggcaactgttttgggctaattatgagtatgaaagaaaaccttatatcacagtttcacgttcatgtaagccactgtgcaacatgaatgaatctttaaatgtgttgacactgaaatcaatgtacaactaatgaaaataaagaagaaaagggggctttaaaatatttgttgcactacagtcgtatagtaagaggcagaaaaaaatgaaagaattttaaataatcttacacgtgtctacagggccaggaacgtaatgaatccatgttaacttaatttcatttaaaattacatttgtagaagtcacacaacagaaagataccatgcggttgaacagtgtgcctgtacttgaacaagtgagagaagatacatactccaaaaaggagattcagtctagtgttacttcagttattcacatagtgtctacagggcagaatctcttccaaagcaattttctgttcactaatctacaggcactaatggaactgtaattaaaaccccaaatataaagatgattatttaaacacaactaagctctagccaaagacagtagagcaccaatgccgggcgggttactgacggcatgcagggcctggaggtacattttctggcagttaaccagccttctgctgtagtagacaaactgccttttgtgaatgtacaaatttgctaaattaatagagaactacattgttatttccttacattacaaagaactcttcccatactgtttttcccatgtactactgctgtcttagactaaactgtgccaccttccaacagtttccaaattactatttcaggtcgagataatgaagaaataagaccaaatctgattatctgactgatgacaaatttgagcaccaactacagcaaaattcagggtcaaggtagcttgcaagtcagttctcttgatttggcaattaccttccactattttcatctgtattgaagctgagatcttcagggcctatttgttcaccatcaggaaaactggaatgtgtatctatgattaaaaaataaataaaaaatttaaaatttaaaagcatataacaagggcagtattttccttcccaagtctttaaataatcttaccaaatgtgttatttaagtgataaagatgtgctgggttgtgaacaaatctctgtcttcagagaatttgtgatctgagtcaggtataagcaaacacaaaggaaaaataaaggagaaaaaaacaaaatgtgtaatagacacccacaattaaaagatgacaggaattgtctcattttgtcctcctggggacaatctggggacagcttaaaaagggaacaagaagcaatggtgtatattctcaagattcaagaccttataaacataaaacatatttcaaagccaattaaactacgcattcaagtatcactacaaaaacccaccagcactccaaataacttgcacaaaatttggatgcttattttagaagcagaggaagttactaaagatgccttaatacttacaaatcatcaaatgcttggttctgtattgaaaaagataccagagcaccaggaaaatatgcaaaatataaagcagaaaatggcataggcttaacaatgttgtcactccaggatatcttgcagaggaatgttcagattgattattaaggcctctgggtaactttaaatgtgtatttctctaacttgacagtatatccttttactgattaatctgtattccagaaaactgcttgacagcagaatacttatggtatatccacatgatagaatattaggttgccataaaaaatgaagtttatgaaattttaaataacatacaaatatatttaagtgaaaaaagcagaataaaaaactatttataaaatatttaggtagggctggcatggtagctcacacctgtaaccccagtactttgggaggccaaggtgggcagatcacctgaggtcaggagttcgagaccaggctggccaacatggtgaaaccctgtctctactaaaaattacaaaaactagctggatgtggtggcacatgcctgtagtcccagctattcaggaggctgaggtgggagaattgcttgaacccaggaggcagaagttgcagtgagctgagattgtgccactgcacttcagcttgggagacagagcaagactctgtctaaaaaaaaaagaagaagaaatgcaatgcaaataagacagaagaaaacaagggaaaatattaatagtaggtttctcttgtttttttcctaataacttttttgggggtaggagggaataaaaattatttcataatctgcatgtatttctaagttatttttattttaaaaggttaaagttatcttacagtaggctagaaaaggaaaaaaaacccaaacatctgaaatctccccagggattggcaatcatttcctatgaagggtaaatatttaggcattgtaggccacaaatggactctcttgaaaattcttctttgggctgggcacggtggctcacgcctgtaataccaggactttgggaggccaaggcaggtggatcacgaggtcaagagttcgagaccagcctggccaacatggtgaaactccatctctactaaaaatacaaaaacattagccaggcgtggtggtgtatacctgtaatcccagctactcaggaggctgaggcaggagaatcgcttgaacccaggaggcggaggttgcagtgagccaagatcacgccacagcactccatcctgggtgacagaacaagactccatctcggggcaaaaaaaaaaaaaaagaaaaaaaaaacccacaaagaaaattcttctttgtttcttttgcttggtttttaaagactctttacaaagtaaaaaccattctcaggtcacagactatacaaaagcaggttgtggaccccgtctctgcccagtaagtagcactcattaggtgcaaccaagccaaatattactggctgtgtttttttagtactcaccataatagttaaccaaagaatgttgtctcacaaatgacaataattaaaaaaaaaaaaaaagaagtagaagcagaagaagcaaaagcagtagagcggaaaaagtagaagtagcagcagcagaagaagaagaaagagaagcggcagcggtggttttagtaatctgtgtaaaatgacatcatgtgctgcaccttcatccgggggctgtgtcatgaccatgaaggagtcgtgaaacccgcccacactggtatgctcttcctgctcctcattctcagtgtcacattcaatgtcactgtcgctactcattcctggcaggaaggaaggagaacatgtttctgaaaagaaaccactgtaagtaaaaggaaacagaaatctccgtatctgctaaactgagattcctattgaattttacatggaatgccaagaattcaacaaactaaacactaacaaaacaaagacaaaagtaaccgcacaaacctcgattctctttagctatttagagtggttttatttctgttctcaaagtttaaaattgccctttccatagtacctgaaagttattatttgaaaccagcattaattttattatactgataatacttttttccaaatcaaacactgtttttttttcagtcacaagagataacaggaactcttttaatcctgattcattatagacataattatattccctagcctaaaacataaatataaatgtgttatacaaatccacatggtgtatgaatattagaaattctggcaattctaataatagtttgtattctaattgggcatctaatttttttgtgtatgtcggttgatttgtatttatttttattttttgagagacagggtctcgctctgtcaccctaggctgggctgcagtggcctgatcatagctcactgcagcctcaaactcctaagctcaagggatacttccgccttagcctcccaagtagataggtccacaggtacatgacaccatgccctgctaatttaaaaattttttggagggacagggtcttgctataatatgttgcccaggctggtcttgaaatcctgggcttgagaagagatcctcccactttagcctcttacagtgctgggattacaggtcactgtgcctggccacatcagttgatttttaaaagaataattctataaaaagtatttgtttcagcaagatagcaatcaagaaaacctgaaaatctttctgctacaaatccttacaaatagcaagataaaatataaatgtaaaacattattttaatgaacaagcacattaaaaggcagaaaggaaatccacagtgtcagaaacaaagaaagataaggaactttcattagtgggtcagggaccacagttgccctggagagcttcctgtgaggatttttaaacactgccttgggatagaaaaatgaaccccccacagaaagggaattaaaagtgagactaaaactccaccccctgcataatgttaaaatttttgtttgttttcttgagacagggtctcactctgttacccaggctggagtacagtggtgcaatcatggcttaccacagccttgacctcccagggctcagatgatcctcccacctcagcctcccaacaggcctgtgccatcacacctggctaatttttgtaatttgttagtagacatgggatttcgccatgttgcccagactggtcttcaactcctgagctgaagtgattcacccgctttggcctcctaaagtggtggcattacaggcatgagccaccatgcctggccaatgctaaaattcctattgaaagaacagactagaaaaatgtctgcctactggcataggaaaacagcaaggaattttgtctgtttctactgggctctgaagagggggaaaaaagtcttacctcaaaattcaaagtaagatttatgtgcctaatttcggtttgggatttaaggttgaggttcaaattttaagaaattaacataaaaattgttcaggagctagtgttatttgaataaagcaaaagtaaaatcctctctggaaggaaggttctaggtacaatggagcaagcacattccactctatcttttccactgaaagtagcaataaaacctggagagatgggtagtgtagttatttaaggatattcatagttatttactttgaaaagtaaatagaaacaggcatactgatgaagactgaatttgaatgacagcaaaactggcagattaaaacaagacccagagtcttattaaaaaaaaaaaaaaaaacctaatgaaaatgttcaggatacaaccccaaattattcagcatatgaaaaaccaggaaagacaaccaacaaacatcaatgatgagatgacacagatgtctggaattatttaagggctttaaagctagataaaatgctcatcagccaggcctggtggcacatgcctgtagtcccagctacttgaaaggctgaggcaggaggatcgcttgagcccaggagtttgggactagcctgggcaacttagcaaagccccatctctataaaaaaaaaaaaaaaaaaaaaaaatttaaaaattagccaggcacacattggtgtgcacctgtaattgtcctagctactagggaggctgaggagggaggcccacttgagcccaggagttcaagcctgcagtgagctatgattgtaccactgtactccagcctaggtaacagaacacaagaccctgagggacagaggaaggaaggaagaattaagaatgaaggggataaagggactggtctaaattgtgtcaaatagaatgccatagagatagcaaaaataacaaaggagagacaatagataaaaggaaaaaagttgaaaattttgtagaattataaaaaacattctgaattaaatacaaataaaacatatcaaaatttgtgggatgtgactatagcagtgcttaaaaggaaaggtatgacattatttatattagaagagaaaatatctcaaatcaataatctaaactactactttaagaaactagaaaaaggaaattaaactcaaagcaagtaaaaggaaggaaataataaaaaacataataaaatcagcagaaaaacaaaaaaaccacaatgaaacaaaatggtgtttctttgaaaagatcgataaagttaaaaaagcctctaggtagattcactaacaaaaagagagcaaacaaaatttccaatatcaggaatgaaagaggacatcaactacaggttctataaacagtaaaatataataaaatgctatcagtaactgtatgctcatgaaaccaaaaacagatgaaatgagcaaattctttcctaggtacaaactaccaaaggttactcaaggaaaaatcgatgggtattttaactcttaaagaaataaaatctgctctagtttaaaaagcttccaacaaaggcaactgtggccccacatggcttcagtggtacactcttccttttctctttttaagaagagtttggttagcattatttcagccttaaatatttagaaatcgtctccatcttcagcaaaacaaaaaaacaaaaaaacaaactttcctgttctaaaagagtgaagagtttacaacaattttatgaagtaggggaaaaagaaaaagagcagagacggttaaagaggccaaaactagctagttctgtgaagcaccacctccaccttgtggcccttcatggaactgttgctgaaaacactaaaacacactgagttgaacttcaaggcacaaatttgacctcttattagtagtgtttctgaattcccgacaaataccaaccttcaggattcaaaaacaatgaattggaattctctggaattccccaaatctacattattcttttaaaaaagttattaaatacatttttcaaactctattcattacatgtgtatcttttttttttgagacggcgtctcactctgtcacccaggttggcgtgccactgcgtgatctcagcctactgcaacctccacctcccaggttcaagcaattctcctgtctcagcctcccaagtagctgggattacaggcatgtgccaccacacccagctaatttttttgtatttttagtagagatgtgtttcaccatactggccaagctggtctcgaactcctgaccttgtgatctacccgcttcggcctcccaaagtgctgggattataggtgtgagccaccgcatccagcctacatgtgtatctttaaaacaaatcatttaattagtatttgtaagagctgaggcctatagtgaatattcaaatgctagactgcatgtgggtattactgggtagtatgtgaataatgtcacgtttagaactcagcaaggtttacagtactatgcagaatcacatgttaataaaaatgccaatataaggattttgcttcaaaatctttcttggaacaccaatcaatttttattaagtataccatgtgtaaactcattattatttacttagcagcagacagggccatgaacacacataaaacggcgatatttataatgaggactgatttgtaatcacttctttccaaggagctcctgttgaccttaacctttgattccaggtatcagtatttccagtttttactttcaacttgccctaagtagattccttcaaatcagtaatgtttctgtgttgttaaaattaattctaataagacaattagaataatgttttccatttattaaacttcttgactaatttttttcagaattcaaaaaaaacacacatttcccaagaaatgctaggaagaaattcctgcatgaaaacgcctggtcttttatcaagcactaagatctggaagtttcctacctttgtgaatgtaaagaaaaagacaaatggctggacgtcaatgatagcaattacaagatactattaattgtaaggagcttcagagattgttaacgcaaaagaaatctgcatcttattactctgtcaatcatctaccatattttttgagcacctactatgtatgtgctcagtaaagctaacttgagttataactcccttaaatcaagttgctcgaatttcagatgctatggaaaatacattaaccacctggtacagatgacactttatattctagtcaccaacaatttatctgcctttctcctttcgaagaggaccctgatattgttcaggtattttcccttaccacatatccatgtggaacgagttggtgagggagaccaactaactggacttggctggctgggtgcgcggtggctcatgcctataatcccagcactttgggtggccaaggcaggcagattgcccgaggtcaggagttcgagaccagcctggctaacatggcaaaaccccgtctctactaaaaatacaaaaattagccgggcatggcagcagatgcctgtaatcccagctacttgggaggctgaggcaggagaatcgcttgaacctgggaggtggaggtaacagtgagtcaagattgcaccactgcactccagcctgggcgacagagcaacactctgtctccaaaaaataaataaataaataaataaataactggacttggccactttccttgacagtggctgacgagatagaagaggaagttgttgaggtgcttagagaaaggttgttgctggagatatatagaataaatcaatcctcttccactcccagaatgctgttctgactctgatgtctagaactgcagcaaacatcttaccgccctgagaagagctaagcctctcactcagaatagcagggcaaaagataaaacaaccccacccccaccctccaacacacacacacacacacacacacacacacacacacacacacacacactaaaaccaccccacccccacccacccacacacacacacacgttcctgatgacactgagcagctgaattttctaatcctgaaaactgctctaccacaggtgtaccttcttattgagagatttgttaatgtaaaagagttaattttcctttttgttcaagtcagttaatttttcgatgaattttgttaaaggcatcttaataattaccctaaatgatcagcaatggcaggccatcaggctttgtattcctcttaaagaggccaccagcaaggtttttaacaggcatgccaaggcttttccccagatggtgttttgagtacccctgatttaactgaagggggtatgtgctacttcagcaagaagtcagagagcaaagcctttagttttacaaagaacaagaaataaactggcctacctacagttgtgcaggtcatcaattgaaagaaaaaataagtcaaccttttcagcatcagatcattaaaccagcgactaatacaaccaaaggttgtcccatatggttccagtaaaaaggaaaaggcctatttatgttcatatctaagaaaaaagttatttttaaactgatgcttaagagcaattaagagacactttagtagtcccaaattcccagccagtaccacaaacaacgccttaaagtcctccagacaaccttctctttgagaaagagagagaaccccacagtgatatgacaccgaatgtcttctttttgtattcagctaaaataaagagtcttgtttttcctaagcatggatacaagacaaatccattcaactgtctactaaggcttataggtatataagggtttcctgagaacttgctcttgctgatgatagaataatactggcaacagtgagcaaggccgcactctcctcgagaaacaaagctgattacaggaggcacagggcttcctttgtctcctgtactaccttctctcagcctcatcagttagtctccttctcacagtctatcctgggactctggaggtaaacaagctgttcagataccaacaaattacaagggtgtacttctgtgtccctgttgatttgcacattcacagcaatttttcttattgagttctaggtgctatttatagcacaacaccccacatataaagataaaatgtgttactgaataacactgaccatttaactctaaatcctacatgaataactccattctttcaaagacttggaaaatgtaccgatcttcactatggccaagcaaatgcctttcttcagtttaggacaagctgtcaattagctttaaataagaaatgaaactggtgtcaaaaagttccagtgttttctgtgctgaccagccattttatatataaaaattagtgctgagataatgtaaattgataaattggaggctgaaattaagtccaaatcgggcggccgggtgtggtggctcatgtctgtaacccagcactttgggaagctgaggcagaaggatcatttgagcccaggagtttaagaccagtctgagcatacagcaagaccaagtctctataaaaaattaaaaataaagaagtccaaatcatttcacctaaccatgcttcttaccaattttcctgcctctagttccacatatgctattcccacccccaaatccattctccagaatgcagctagagtagaaatgttaaagtgtcacttctaacttagatcctattcaaatgacaaagttcaaattctagctgggacattccacgtaactcttcatgatctggcctctggtctgtctcccttctggcctttcaccagtcttcatctggctaactcctactcatcccttaggatgatctttccaagggtggattagggactaggttagcagagagaggcgacagttaagagcactggctctaggttcaaattctagctcttccaagttcttttttttcttttcttcttttttttgagacagagtctcgctctgtcacccaggctggagtgcaatggccacaatctcagctcattgcaacctctgcctccttggttcaagtgattctcctgcctcagcctctcgagtagctgggattataggagtgtgccaccatgcctggctgatttttctatttttagtagagatggggtttcaccatgttggccaggctggtctcaaactcctgacctcaggtgatctgcccacctcggccttcccaaagtgctgggattacaggcattagccaacatgcccaaccttccaatttcttttctttttttttttttttttttgagacgaagtttcactcttgttgcccaggctggagcgcaatggtgcgatctcagctcactgtaacctccgcctcccgggttcaagcgattctcctgcctcagcctcccaagtagatgggattacaggtgcccgccaccacactcagctaatttttgtatatttagtaaagatggggtttcaccatgttgaccaggctggtcttgaacttctgaactcaggtgatccaccctccttggcctcccaaagtgttgggactacaggcatgagccactgcgcccggccctggccttccaatttctaaccctgtgactttgggtaaggtaaattacatctccaggcctcagcttactcacctgtaaaactaggttaacaaaagcaactaccatgtagagttattctgagaataacagaatactggtaaagtctttaacacagtaagaacttagtattactattatttttattacgtatctcatttttgagctgcctataaaccttatcacagcactcatcgtcctatattacaactggctattagtctcccctgacacctaacaattggttttcaactgctctccttgccgccctcctaccaataccaccacacatacctagcatacctgagagctacaacttatttctattaataactgtggcccactctggcaagtgattctcaaggagtggtcacctctggttgagaattatttagttcaactattggttcttgactggggatgattttgcctcccaggaaacatgtggcaatgactagagacatttttggttgttgtaaccggagggaaacactactggtatctagtggttaacagctgaggatgctgctaaacattccacagtgcagagaacagtccctgtaaaataaagaattatgtggcctaaatggcaatggtgcaaaggtggagaaagtctgaactagatagtaagttcaggaattttatcactggcatcaaatgcaacatccggtaaattagaagcatttcataaatgttgcatgaaaaaaatgagcttgttattactgtcatttgagatagagtctcactctgtcgtccaggctggagtgcagtggcgtgatctcagctcactgcaacctctgcctcccagttcaagcaattctcctgcctcagcctcccaagtagctgggattacaggtgtctgctaccacatctggctaatatttctatatttagtagagatgaggtgtcactatgtttgccaggctggtctcgaactcctgacttcaagtgatccgcctgcctcagcctcccaaagtactgggattacaggcatgagccactgcgcttggtggaagaaaaatgagcttgtaattccagcatattctgtagtaatttaagctactacaatccagtatgtatggagacacatagaaagtaactattccccggccggccttggtggctcacgcctgtaatcctagcactttgggaggctgaggcgagtggttcacgaggtcaggagttcaagaccagcctggccaacacagtgaaatcccgtctcttactaaaaatacaaaaattagccaggtgtgttggcaagcgcctgtaatcccagctatgcagaggctgaggcaggagaatcgcttgaacccgggagttggaggctgcagtgagccaagactgtgccactgcactccagactgggcaacagagctagactccgtctcggggaaaaaaaaaaaacaacagaaaaagaaagtattccccacaggcccattctataaagatcttcaatcataatatttctttcttgatgttttaacaataaacacatcatttacaaaaatcttttctatttaatctcttctactgaaataatgctgcccatcacagaagcaccaattaagaaaaccaaaatatttagtgttctttaactgagaaacctgaaaatgccaccacctacacaccctcttcttagggcagctgagtagatgctggcacctgtatgtatgctttgagctacaattcatcaatcattgaaattcaaatgagtgcagaggtggaaggtggtggagtttcactaagaaatgaaaaaattacaaggccaaatatcattaagagagttgacattcttttctaccaatttataaaggacacagcaagggcaatacacatagccttgttctaagcacctctgttgccccaaattgcaaaatgtcttctatgcttttagataaacaataatgaacttggaagaacatgcaaaagaaacactagaaagtacagctgagaacaagctgaagtcagtcatcatacaggatttaaaaaatggtcaaaacttggaatgcttctttaagaagaataaagcaatctacagacactaattaagactgactttaaaaaatacttaacatttactattctaattagttgttctagggcatatcttccccattagattgtgaacatatctaattcaactttgtattaataaatctagcaaaaattcgatgcctggtatgtaggtgccttaacatatttattgaccgaacagatgaactatatgcagattttttccccatacaaatgcctgttctagtaaggcctgtccttttatatagtaacttacccattttgccttcctctgtatttggtatcttagcaaatcaaattcagtggcacaaggaatgttgtgttcagatcaagcatgtcgaatagcagatctcagtaacatttccattaaaccaaccactccctatccctatcactaccaccagcagcagcagcaccaccaccaccaccaccaccaccaccacccaccacccaccaccaaaaaagggacagaattctcatttcctgcttacttataagtttatcattccttaccttcttcaggggcagctgaagctccttcaggtagtacaggctgtaactctccagtttcagaattattttccaaatcagtcatctgcagtccttccagatgacctcctttagcattagccctcaaagaagaaaacaacttgatatttctctataactagtgacacaataatctatattttctttttgaactgagcaccaaactaagtagggtacgtgctctggtgcttaatactaaatttcaaattttatctgaaaatatttcactaaggtcctggcacagtggcttatgcctgtaatcccagcactttgggaggccaaggtgggtggatcacctgaggtaggagttcaagaccagcctggccaagatggtgaaaccccatctccactaaaaatacaaaaattagccagatatggtggtgggcgcctgtaatcccagctactcgggaggctgaggcagagaatttcttgaacccgggacgtggaggttgcagtgagccgaggttgcaccattgcactccagcctgggcaacagagtgagactctgtctcaaaaaaaaaaaaaatttttttttcactaaatattcacaaaaaaatgttatgaaatggtggattacatcaatgttggtatcctggttgtgatattgtactacagttttgcaaaatgttatcattaggggagaaaaatacacaggatctctctgcattatttcttacaactgaatgtgaacctataattagctcaataaaattttaacttataaataccaatagaagttttaaataatatgttctaatagggaaagacttttgagatatattattattgctattatttgagatagagtctcactctgtcacccaggctagagtgcagtgatgtgatctcagctcactgcaaccgctgcctcctgggctcaagcgattctcctgcctcagcctcccaagtagctgggattacaggtgtccagcaccacgcccggcaatttttgtactttgtttttagtagagacagtgtttcaccatgatggccaggctggctcgaactcctgatctcaagtgatctgcccacctcagcttcccaaagtgctggggttacaggtgtgagccaccgtgcctggcctgagagatattattgaatgagaaaataaagtacatcttctgtattaaaaaagctacatagtcacagttccttaaatatacacaaaaactgagaagacacagcacacatgaaaaattaataacagcatgaatatgtgtgggcagggggttggaaaactaggtcatgggagttaaggatgggaaatttttcacttattcttttctcctttcattttgaaacacttatcattagtatttaatatttatttttatttaaaaaataaacagaggcaaggtcttgctatgttgcctagggtgttctcaaactcctgggctcaggccatcttcccacctcagcctccaaaagtgctgggattacaggtgtgtgccactgtgcccagcctttcattagtatttaaactttttgcttacactactttaaatcaggcaggaaaaaaaaagacatgagctggacagcacctacatgaaccaggctggcagataaaatcaactgcaaaatgaggatcaagctgcacacacttgcacaggattttacactctagaaaaaaaaaaactaagttcatgtatatttaattgtggtgactaaaggcagataaaaatatctccatagcaaataaaatataagagctagttgcactttaatttgaagaaatgtataaaacatcaggttaggtagtacgtagggaagacaagataatctccagtgattttaacacctttctactactgaaacttgagccagaaagctaaaccaccagctgatcttgtagttttggtaatgagccagaccttgactatataaaattaagtaaacttaaagggtgttaatctttctccaatttaggtaaaattcttttcagggtctccaaaatagaactatttcattgtttaaatttagaaataggtttaatatccataaaatagataagcagatggatattaatggctaatcatctgccacatccatagccaatatccataatcactctatcttttgaatagatggaagtttaattgccatgccggggatttgagtttatgtctcctaggggagagataaacgtgttaactactatatatctttttgggaaattccaactataagttttgaggatactttgataacaggagagaagaaagatgagataaaagcagaaaagcagtgttaaagttgctgtaagtgctttgtttcatacaaaatatatataaatgcctgtgacacataatatagcccaacactaacatctttgacaagtgtaggatagactgaaaaaaaaaaaaaaggctgaccgcccccctaccgccaacacatacaaatttacaaggcagagttcagataaggttacgtatcattgtgaaaatgagctctaacatatttaaactaaacttccggtactatttcatcccattaaaaaaagtactatctcttgagaccatggtgaaaccccatctctactaaaaataccaaaaaaaaaaaaaaatcagctgggcgtggtggtgggcgcctgtagtcctggctacttggagaggctgaggtaggagaatggcatgaacctgggaggcggagcgtgcagtgagctgagatcatgccactgcactccagcctgggcaacagagcgagactccatctcaaaaaaaaaaaaagtactatctcatcccattaaaaaaaaaaaagtaaaatctctgatactttaaaaaagttaaaatttaggccaggtgcagtggctcacgcctgtaatcccaacactctgggaggctgaggtgggcgtatcacttgaggtctcaggagttcaagaccagcctggccaacatggcaaaacctcgtctctactaaaaatacaaaaattagcagggtgtggtggcgggcacctgtaatcccagctacttgggaggctgaggcaggagaatcacttaaaccggggaggcagaggttgcagagagctgagatcacgccactgcactccagcctgggtgacagagcgaggctctgttaaaaaaaataaaaaaaattaaaaaagttaaaatttagtgcaataaatgtattttctgtccactaaaaaattaacaaggtagaaattaatttgttcatcatgatgcatacttaaagttccaaacaaagctattagctattataccattacatatacaaaacaacttaatttaccccaaggtgaccattttcctccttttctcaaccgcaggcaagccactgaaaactgcaaccacaacagcatctgaatccaaagctttacactgccggtcttcagtttttggcagaatatcaccgatactgccatgtatcaaggctcggggagaactgtgcctgctcccagactgagagcttcctggggagccttcaaaaaaaggaagatggaatacaaaaattagctgggcatggtggtgtgcgcctgtaatcccagctacttgggaggttgaaacacaaggatcacttgaacctgggaggcggaggttgcagtgagctgagattgtgctacactccagcctggacaacagagcaagactctgtctccaaaaaataaaataaaataaaataaaaggagggataatcagaaaaaaggcaaataaacatgaaaggtctctctcagttacattagaaaatctcactatatatatcattttaaaactacataaaaacttcaaaaataggccaggtgtggtggctcatgcctgtaatcctggcactctgggaggctaaggcggatggatcacctgaggtcaggagttcaagaccagcctggccaatgtggtgaaaccccatctctactacaaatacaaaaattagccaggcgtggtggcgtgcacttgtagtcccagttactcaggagactgaggcaggagaatcacttgaacacggcgggcggaggttgcggtgagccgagatcgcaccattgcactccagcctgggcaactagaggaaaaaactccatctcaaaaaaaaaaaaaaaaaaacttcaaaaataattttgaaacatatcccttgttttttatgccaagcatctaaaattaaggagtccaggccaagtgttgtggctcacacctgtaattttacactttgggaggctgagacaggaagattgtttgagcccaaaagttcaagaccagcctggacaatgtagcaaaaccctgtctcggcaaaaaaaaaaaaaaaaaaaaaaaaaaaaaaagccaggtatggctgcatgtgtctgtgtctgtggtcccagctacttgggaggctgaggtggaaggatcacttttgtctgggaggtcaaggctacagtgagctatgattgcaccactgcatccctagcctggaaaacagagcaagactctgtctcaggaaaacaacaaaaataaagaataaataaaattaaggtgtttagaatacatagtctaatggctgtattttgttaagggtctgttctgttgagatcaagaaactttccagccaggtgtggtggggctcattcctgtaatccgagcactttgggaggttgaggcaggcggattgcttgagctcaggagtttaagaccagcctgggcaacctgtctctacaaaaaatacaaaaattagctaggcgtagtggtgcacacctgtagtcccagctacttggtggggctgaggcaggaggatctcttaaaccaccggtcgaggccacggtgagccaagatcgcaccactgcactccagcctgggtgacaaagtgagaccctgtttcaaaaaaagaaactttcaaatccaactttagcatttttggtgcccttcaagatctaaagctccacgataacatcaatttcaggtaataaatatttaccccactaaaagtacattctgaatccctcaaatttaccttcagacagagtctgacagtctccctttgaacgactattttctccagggtccactgctcttcgaagtgatagactacctgctacactggatcgagctggcttgggcgaattactcttcttatttgtggctgcaaagacatttaagaacacctctgaataggctactacagcacaaaactcactatttagtctgtcagaaaaagttttaatcttaccttgcatggaagctgttctctctactgtctaaaaataaacaacattctgtagccccaattggtttagacttttgtcataaaacattcccatcttgttgcttgtagagcagaatcttttttttttttcccccagatggagtcttgctcttgttgcccaggctggagtgcaatggagcgatcttggctcactacaacctccacctcctgggttcaagcaattctcctgcctcagcctcccgagtagctcagattacaggcactcgccaccatgcccagctaatttttgtatttttagtagagacggggttttgtcatgttggccaggctgggtctcgaacacctgaactcaggtgatccacctgccgcggcctcccaaaatgctgggattacaggcatgggccaccgcacaccgcccgtaaaatcttaacttaaaagattatctgtgagctccttaagaaaaatcatacaaatttcaatgcagttaaactattaacaaatatataacccgtcaaacatttggaaattataaagtattattggattaaaaagaaaaatcaatgctgagttagaaacaaattacaattatggtacttgaaatcaaaatgtctgtggccaaaccagtagtgaaaagaaaatgtacggccttaaaatgaattaattagggaaaaaagggactatatgacctaatatgcatagattcaaaagctaggaagacaataaaaataagcaagcaagaatgctattgccagaaggcagggccctgcccttgaattcagcctgcagaactgtgagttaaataaatctcttttaaaaatacattttaaaaaaagaataaaaataaaattgtaaaaaacaataaaaataaaaaattcattaataggtaataaacaggtttagcatggttgcaggatataagacaaaataacttattgtatttctctgcactagcagacaatgtgagaatgaagttaagaaaacaatttcatttttaatagcataaaatacaattaaaatacttaggaatttatttaacaaaagaaatgtgagacttgtccactgaaaactaccacacattcttgaaagaaaatagagacaacagcaaagacatcctgtgttcatcactgattagaatacttaatactgttaacaaagcaatattcttaaaattgatctaccgattcaacacaatttctaaaataatagtagctgtgtttttttttttttgcagaaattgacaagctaatcctaaaatccatttgaaaatgtaagagacccacaatacccaaaacaatcttaaatggaacactcacttctgatttcaaaagttactataactaagtaatcaagactatgtggtactgccatatacacatatatatcatcaaaacagaattgagagtctagaaacaaacccttatatttatggtccactgatttttgacaaggatgccaagacaatgcaatgggcaaggaaaaaaagagggacaataagtgttgccaacggtatggaaaacctggagccctcatatactgctgctgggaatataaaatgatgcagctactttggaaaatagtctggcactggtagttcctcaaaaagttaaacacagttgccatgtaacccattaattccacttctaagcatatactcaaacaaaaccatatgtccaaacaaaaacttgtacatgaacgttcatagcagcactactgataatagccaaaaagtaaaaacaacccaaatatccatcaactaatgagtggataaacagtatgtagtacagccatacaataaaatatcatgcagacataaaaaggaatatatgccacaacatgaatgaaccttgaaagggctgtgttaagtgaaataagccagacatagaagacctcatatggtatgagtctatataaaaagtccaggctgggcgcagtggctcacatctgtaatcccagcactttgggaggctgaggtgggtggcgcatgaggtcaagagattgagaccaacctggccaacatggtgaaacctcgtctctactaaaaatacaaaagttagctgggcatggtggcgcacacctgtagtcccagctacttgggaggctgaggcaggagaatggcgtgaacccgggaagcggagcttgcagtgagccgagattgtgccactacgctccagcctgggtaacagggagagactccgtctcaaaaaaaaaaaagtccagaagaagaaaaatccatagggaaaaagtagattagtggttaccagaagatagtagaaggggaagatggggaacgacttttaatgggtttggagttctagggagagggttaatgaaaatgttcttagacttagataaatgttctagacttacgaaaaatgatgaccaatttctccactaaaaggataaatgaattattggttaaggaaaaaagaatgcattaacagtctgggtgcggtggctcatgccagtaatcccagcacttcaggaggccaaagtgggtggattacctgaggtcaggagttcgagaccagcctggccagcatggtgaaaccccatctctactaaaaatacaaaaattagcccggtgtggtggcacacacctgtaatcccagctactcaggaggctgaggtaggagaagtgcttgagcccaagagacggaggttgcagtgagccaagatcacgccactgcactccagcctggtggacagagcgagactctgtctcaaaaaaaaaaaaaaaaaaaaaaaaaaaaaagcattaacaaagacaaaagcagaaatataatgaaatggtaaaagacaatggatgaaataaatctaagaacttggtctttgaggagatgaacaaaattagcaaatcccttgagcaggtcaaatcaaaggagaaaaaaaaacagaagtaagcaataaaataagtgaaaaagaagttaacaacccatatgcacaagaagttttaaaaatttaagaaaatagaataaatgactgtatatcaataaatttaaagacccaaatataattagtttttcttggaaaactatagtaactgacttaagtagcagcagaagtatgagaaaactacatctgacaagagattaatgaccaggatctcaaacaactctataggaaaaaattcaataatctgattaaaaatgggtaaaaatctgaatagatatttcttaaaagacgacacacaaatagcaaacaggcatatgaaaaagtgctcaacatcactgatcatcagagaaatgcaaatcaaaactacaataagataccatctcatcccagttaaaatggcttttatccaaaacacaggcaataacaaatgctggtgaagatgtagagaaaaggcaactctcatacaccattggtgggaatgtaagttagtaaaaccactacggaaaacagtttggaggttcctcagaaaaactaaaaatagatctaccatatgatccagcaatcccactgctggttatatacccaaaagaaagcaaattagtatgtcaaagaggtatctgcattcccatgtttactacagcattattcacaataaccatggtttggaagcaacctaagatccacagacaaatggataaagaaaatgttaggttgggcgtggtagctcacgcccgtaatctcagcactttgtaagcccgactcaagtggatcatttgaggtcaggagtttgagaccagcctgaccaacaaggtgaaaccccatctctactaaaaaatacaaaaaaattagctgggcgtggtggcgcatgcctgtagtcgcagctagctgggaggccgaggcaggagaatgacttgaatccaggaggcagaggttgcagtgagccgagattgcaccactgcactccagcctgggcaacagagtgagactctatctcaaaaaacaaaaaaaaaatgtggtacatatacacatggaatactattcagccataaaaaaggaatgagatcctgtcatttgcaacaacatgggtggaactggagatcgttatgttaagtgaaatacatcaggcacagaaagacaaacttcacacattctcacttatttgtgggggctaaaaattaaaacaactgaactcaagataatacagcaatggttaccagaggctagggagtgtagtgggtggctggggggatggttaatgggtacaaaaatatagttagatagaatgaataagatctagtattcgttagtacaacagtgactacagtctacaataatttattgtacttctgaaaataactaaaagagtacaattggattgttttaacacaaaggataaatgcttgagatgatggatactccatttaccctgatgtgattattatgcattgtaagcgtgtatcaaaatatctcatatatcctataaatatatatacctacaatgtacccacaaaaattaaaaattaaaaaaattaaaaatatgaggaaaccaacaaatccaacagaaattaaaaaggctgttaaagttctaactctgagttactatactagttttatgaatgctttttattagacataaagtttaatacagcataggagcaaataacatatagttaaaataattttatagcatagaaaaggacaaaaacatctgaatttaatctgtaaaacaagcacagaattagaactaaagtgggttaaggatagtgtaatgaaatagatcgatttcacttatgactatgtagtcaaggatcctaagtaaaatattagcaaactgaatacagcagtgtttttttaaaaaaagtataggcccaaactaaataggatgcattccagtatttccagaatggtcaacattagaaaaataatataatttactttatgataacaaagtaatggaacaaaatagtaaatcattttgacaaatgtcaaaacatcatttgatataattctacacagcttcagtttaaaaagaaaagaaattctcgtagtaagaaaagaggcagtttggtattagggtgaagggcataggctctgaagttcaagtttttggctttgccaattaccaatgtgaaactagcaacattattcaatgcctgctgccttggtttcctcatctgtaaatctggaatgaaattgacttaccttacctcttagacttcttgttaagattaagtgagtcaatgcatgtgacttagaatagttagaataatgtctggcacacagttaacacttagtaaatgttagccattattggtattgttgttactaaacaggtttagtaacctttagttactaaatttctttagtaagaaatacagatgtacaataaaaatatgaaaagatattcggcctcacctgctattcaaggaaatggtatattaaaccaaatggtatattaaaaccaaaagtacagctttttgggtgaactttctcaaaaagcctttgttacatattttgcagatacagttgacgcttgaacagcacaggcttgttgtactgtacaggtccacttaatattcgaatttttttcaaccagagaaagattgaatatattactatactatactatagaatctattactataaatagaaggatgtaccttttaacttttttatttatttatttatttatttttgagacagtctcacttgtcacctaggctggagtgtggtggcgcaatcttggctcactgcaacctccacctcctgggttcaagcgattctagtggcttggcctcctgagtagctgggattacaggcatatgccatcatgcccaggtaatttttttgtatttttagtagacatggggtttctccatgttggccaggctggtctcgaactcctggcctcaagtaatctgcacgacttggcctcccaaagtgctgggattacaggcgtgagccattgcacacagcttttttaacttgatagaaacaggcctgtaatctttgggaggccaagacaggcagatcacgaggtcaggagatcaagaccatcctggctaacatggtgaaaccccgtctctactaaaaaatacaaaaaaattagccaggcgtggtggcaggcacctgtagtcccagctactcgggaggctgaggctggagaatagcatgaacccaggaggcggagcttgcagtaagccgagatagagctactgtaccctagcctgggtgacagagcaagactctgtctcaaaaaaaagaaacacaaaaacaaaaaagtacctattgaaacatacagcaaacctcaaatttaatgagaaaaaaactaaaggaattcctaaataaagttgaaaaattataaaaatcctaccactgttactaagaaactgttgaggtacctgcctagacaatgcaatacaaaaagtaagcagaaaatgaataaacaaattatgattatctgctgatgatataaatacttagaaaatcaaaataactaattgaaaaactgttaataaaacaaattcaccaggccaggtgtggtggctcacgcttgtaatcccagcactttgggaggccgaggtgggtggatcacctgaggtcaggagttcaagaccagcctgacgaatatgatgaaaccccgtctctactaaaaatacaaaaactagccgggcgtggtggcatgtgcctctaatcccagctacttgggaggctgacaaagaagaatcacttgaacccaggagggggaggttgcagtgagccgagatcgccccatcgcactccaggctgggcaacaagagtgaaattccgtatcaaaaaaaaaaaaaaaaaaaaaaaaattgccacattggttgaatacagaataaacataaaaatcaatatttttgtcttttatgtcagtaacaattagaaaatactatcagagaaaaagagattccactcacaacagctacctaagatataatacattgagaaatgaatttaacaagacatatatagaacttatatggaaaaaactgagagttctaaaaaaggatatgaatataacagatgacctgaataaatggagagaagtaccacattcctagacatgaatgtttgatgctgaaaagatctcaattgcccaaattagtctctctttttttaagagagagagagagactgttgcccagattggagtgcagtggcacgatcacggctcactgcacctcaaattcctgacctcaagtaatcctcccacctcagcctcccaagtagctggggttacaggtacataccaccatgactggcttatcaaaaaaatttatttttgtagagattaaggtcttgccatatgatgttgaactcctgggctcaagaagccatcctccctcatcagcatcccaaaatgctgggattaacaggcaggagccatggtgcccagcacccctaaactagtctttaaatgtaaagcaattccagtcaaaatactttggaggaggattaaaagtgcaagaaccaccaataacattttgaaaaccaagaacagaataaacatatcctatcatagtattacaaactataaaactacagtagttaaaaaaagtgttagtctggtagaggacatgacaaatactgggttaaacaataccaaattgcgtttttgtatgtccaaaacttgagtactggcaatttcagttgtttcgacctctatgagttcaaaaacagaaccatgtttgggaatctggtctataataaaggatggatttcatattgcatcatatttcaaaaaacatgtttcattcatttggggaaaaacatcattccatttacctcacacagcatcatataaaattaactttatatgaattaatgacctatatgtaaaaaagttagaaaacaaaaagtaccagaagaaattaagggttatttttattaacctgggagttaaaaagccttccaaataaaaataagacccatgaatattattgccatgaatattattattaattataatattattaatattcatgtcatgaatgttaattatattattaatattcatggatgaatattattaatacagttgtctaagataaaattttaaaactctgtgattagcaggaaaaaaaggtggcaatggggaagagacagttgtcccttggtatatgtgggggttggttccaggacccctgcgtatactaaaatcctcgactgaagtcccaccgtaagacctgcagaacccacctatacgaaagttggccctcctatatgcaggtttggcatcacccgaatactgtattttcaatctttctctggttgaaaaaaattcgaatattaagtggacctgtacagtacaacaagcctgtgctgttcaagggtcaactgtatctgcaaaatatgtaacaaaggctttttgagaaagtccacccaaaaagctgtacttttggttttaatataccatttggtttaatataccatttccttgaatagcaggtgaggccgaatatcttttcatatttttattgtacatctgtatttcttatgttaatggcctattcataacctttattcattctactaaattgtcttccttatattaagagaattctatatattttgctattatctcctcaccaacccatctttattggattattcacatcactatcaaacattaatacagccaattttaataaacaacacacacaaagagaacccagaaacaaaccctcgtctatatggtcaaatgatttcaacaatggtgctaaaaccattcaatgaggaaagaaaagtcttttcaacaaatagtgctgggaaaactggatatccatgggcaagcaagtcagacccttccctgacaccataaacaaaatttaattcttaatggatgaaagactaaaagtaagactaaaagcaagaactaaaactcttggaagaaaacaggagaaagcttcatgacactggattaggcaatgttttcttggctatgacaccaaaagcacagggaacaaaaggaaaaacacataaaatgggcttcttcaaattaaaaacttcaaatgttaaatgacacaatccacagagggaaaaggcaacccacacactgggagaaaacatctgcaaatcatatatgtgataaaagataaatatttaaaatatatacagaactcctaaaagtcaactacaaataaacaacccaacccaattttaaaatggatttaattcacagatgaaagacattggagaggacacaaaaaaggacacccctgccaacaagaaactattgaccccgcacctcctccagcttctacccacttcattgtgaaacttcttttaaagaagttgtgcatttgtgctctggtccctgacctcattcactcttctgctacactactccatgggaatagttcttaaaaaggccacttggcctcttgccttgacacttctcagtgatacttaacacacttaacacaggggtaaccactctacttcttgagatgcattatttttgatttttgagatattatcccttctagtttttctcctaccttaatgattgctctttcaatttcctttgctggcctctcctatttatcagatctttaaatgtttaagtgccacagagtcaaaaattttgcttctccattgaaactccctccaaacttgaccctattcagtcttctggatttaaataatataaaatactattgactcccaactgtttatatccagcattgacctctctctgagtttcaaagttgtgtaccattcacgtgtctatgacattttactaggatatctagcaggtgtctcaaattaaacatgtttaaaaaagaatacccaactttctgcccttacctcctcccaagccccataacctgcttcttatctgatttgcttctcaataaatgataccactgcctattaagttgcttaggccaaaacttaatcataattcttagtttctttctaaatagaactttcctaaaattctatttaggctttttcaactatggttctgagaaagaactcagccctgctgatctaagactggattaacttccctcctatgcatctagaatagaatagcacatccttaagagaactaagaaagatgggaacctcagtcaagaaaggctgctagactgtgaacaagcccctctatccattattgtaactccagaaaatgccatcatatttcacacaagataatgtaataggctgttactggtctcacaattcctgtcctcaacccttttcagacccttctccacacaacaagcaaagtcatctttgtaaagtgtaaatcagattataaacaccccttatttttattctctagaggcttcctccttacatcataataaaactcgaactcctttttgaggttttgcaagactctccctgatctaaattctgcctacctctctctgacttcgtctcctgctagtctcctctctctgctttctttgccatactggtcttccttcaatccttcaaatacgcaaaataaatcctgtgtcagtgactttgcagtttctgttctgtttacccagaacactgcttgccctagatctataaatagctgccaccttcctaaacttcaggtctcaggtcaagtgctgcctcctcacagagactttctctgactaccccaatagaacatgtctcatctgctcctcccatcccactcctcggttgtttccttcacagcaccttttacccactgaaatgatctttacttacttgtctacactttttaatgtctgattcccactactagaatacaagatctatgatgttaagaattttgtcttgtttattgccaaatacagagtaagcaatcaagaaatgttagttctattatatagtaaaaatatacggaatcaattttggatgaagaaaaaagtcacatgtaatttgtagtcttaactcactggaagagtggtatttaaatattattcttttgaaaaaaccagtcatctagtttcccaaataacgtgtggagaaatgacactgggaacatattacttacagtttcgtatgtaacaattggcaactgatgactttgccaggagttccattcccaaatcctgcaatctgccagagttttcagttccacatgcagccagagctgcctggtcagcagaaaaaaggcttgtctgcatgtctccagaagcagcactgctgctttttatttctgaaagtgtattctttacatcagttttcatacatcgaacttcggccatttgagttttgagtctttttagcatctttaaatcagagggcactcgccacattgcctgttgcttcctttggtctttatcttttcgagaatatgatgcttcagagaaattgacaagtcatgttaacataaacgttaatattaatgaaatcatttgtaccatgaatatatgcaaatttgatgtgtaaaataagctagcgtgctttacgtggtatcaacaataaaacatgcactaaattccattaatgaaaataaagataaagaatcctaccttattcacaccttcagagttagaatctgagtcacatcatactcaagttcgaattacacatttaattctaaaagtttaaaagctgccctactgccttgtgctttcttctttaaacttctccacttttctgaaactttctacagagcttttattatgtttataattgaaaaaaaagacaaagaaaaatctagaaaccaaatactttgtcaaatctgccatatataacattatattaaaaatacatatttctggccaggtgcagtggcttatgcctgtaatcccagcacttcaggaggctgaggtgagagaatcgcttgaggccagaagttcaagatcagccaggggagcatagtgacaccctatctgtacaaaaaaaaatttttttattagaacttccatttctgataattttctcagaactgtcagctttctgaaatacggtttgaatctaaccacttctaaaataaaacaatagctctccatgcctagtatgaataaattcctccggctagcatgcaagtcctttcatagaatggacccaacatgactctagttctacttaccactatatgtaccttaaaatctggttcaactagattacctgataccttttacagtactcctttacatggttaagaacatgaagttaatctgacaaatgttcactaaatatgtgttaaataaatacacagaaaaaaataaacatcaaagcccaagcaggccacgtgcagtggctcacgcctataatcccagcacactttgggaggccgaggcaggtggatcacttgagctcaggagttttgagacaaacctggccaacatggtgaaacctgtctctacaaaaaattgtagagcactccagcctgggcaacagagtgagactctgtctcaaaaacaaacaaacaatcaatcaaacaaaaaatgacccaagcaagccttttcaataaaaagaaagtcatatatttctgcacactagcttttattaacatcccttcactgaaaggtattttcatttggcttccatgagtattttttctcctttctaaaagctctttatctggctcatcttcctgacactcagtaaaaacagatattcatcaggattatgttcctggctctcttcttttaaaatattcttaaaactcctttgcaatctcacacccttggttttaattatccagtatcacctccagaaaaataactgtctgtattccagttcatttttttttttcatggagtttcactcgttgcccaggctggagtgcaatggcacgatctcggctcactgcaacctccgactcccaggtttaagccattctcctgcctcagcttcccaggtagctgggattacaggcacctgccacaatggccggctaattttttgtatttttagtagagacagggtttcaccatgttggctaggctggtctcgaactcctgacctcaggtgatccacccgcctcagcctccccaagtgttgagattacaggcgtgagccactgcgcccagccccagttcttaatttttagctgtctactggtcctttctaatttgatgtcacactgttatgcccaactcaagatgtttaaatccaaaacttgctttttctttctactattttccccgccctcattattgccagcattttatcacctaaatttgaaattcagatcatctcatttgtattgtttttacacagaaaactagttttacacagaaatcttactatttagtttgcatttttcccaatgatactgattattttcaaaaacacgattttacttgtctataaaatataccattgcatggttacactgtaatttattcagctataactgtattgttgaatatttttaaacatctgcttgttttctctttggaatatactcctcaaagtgaaattacaagtttaaaggatatagatatttttaaactactacaaaattgtccttcaaaaaggttaaaccaacttacatatctacctacagaatcagaacctgtctgtttcactgggcctttgcaaacaacacttaacatttaagtaaaactttatataaagcatacttggcgcacacataaaaggcaactgtttcataacctgaagatagtcttttaagctgaggatccagactttcaggaagtatatctggctcttaggaaagaagaagcctaaataatctgggctccatgtccctacaccagtagaagagctctatttctctgttatttacacagaggttctgccttggactttgattgaaaaatgagttatcttgccttaaaactacatcaaaatcagagttctaaatcattgatttgatgtatataatactattgtttaagaaggtagaaaaatatttggcatatatttttgaatatactgactatactttagaaagcattccaacaaaaatggtttttaaaatgtagcttttaaaggcaaatacttagttgtccaaaatgactctatccccgagagtttaaaaaagcccatatttgactatacaaatctccattttattatagtaacacaaatgtaatttctatttaacaaataacctttgcacagaaaacagtgctgccaactggcatacatttttaagctactgaacatcaaagaatgagtaagtcacctttttctacgttcaatttagatatagttccacttggaagtaagggaattcatgaagcctgaccaaaaaaagtccattcataaagaagataaccgtatttcatatggatcaaactgtcaggcaaaatctgagtagcaagtcacaaaaaaccttcttgcaggcatttttactttgtttttgcacaaatcacctttgaacggtaatttaaaaactaatttggttgacataaatgtcatttttatggtatacaatgaaaaacacagaaatacaccatgttccacacatagctgaaatacttaaatgaaaatccaagagttcttttagagaaccacagaaaaaaaggaaattatcattgttattattttacctgtgggctgcagaagtgaagcaggtgggcgaggctgtaagccccacaaattttctatactgctccggtccttaaggtccaacaaatgtattaaaattaatggatcaatgtctagtaaactactggtagcagcggagcataaatgtgttcttcttgatattctactactggaacccacataaccatggctactacctgcaaaagaggcgtagaaaatgatatatatatgcacaaacttagctatacttaaatgaaaaaatgaactggttaacattatatgaatacttgtctatggacctatctcttaggagttcaggttcatgataagaagcagaaagaaggaaccagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaagaaggaaccagacagttgtacattagcacagtgattgagtggtggcctcattagtacttagaattcagaagcaagcctcaaccccatcctgagccctagaaaaaaacagatgacaatgtgtacgatgtgcacaattggggggatgagaggtaagggtaaggagaaggagattatatcccatgaccacctggttttagataaaagaagacaaattcccatagtataacagattacaaagaattagacaccaaaatagaaatctcccccaagtctctggacagtaaaatgtataggtcatgacagtttggtagactttttctactttgattaaataatggggtacaatttgaagtttttggactgtcatgttaatgactgatgcacattacagacatctgtaggcagatattatgcctatacccctatattggactatgctctttaagccaagaaaagcatctgacttttctctagcacctagtataatgcataacaaataccagatatggaaatgttgcttaaaactgaccttcttcaataaagctgtttaaatatattttaaagagatagaacattttaaaacaatgctacacgcaggaaagtagataatataaaatattaaaaagtcaggttccaactacccatgagtatttcagagagatccagcaggatataacttaggaggaaagttccattgttcagaagcttcaagccaattaataatttatgcttttcacatcctcatgttctcactgtctcccacttctgcctcctcttctaaggattattatctcactgacagtttttcttcccagcctctgtattactgcaattcctattaaataacagaaaacgatttccccttcacattgaaaactgttctttgttgtgttttgagacacagtctcactgttgcccaggctggagtgcagcggcccgatctccactcacggcaacctccgcctcctgggttcaagcgattctcctgcctcagcctcccgtagtggggactacaggcatgcaccaccacacctgtattttcagtagatacggggtttcaccgtgttaggatggtctggatctcctaacctagtgatccgcccgcctcagcctcccaaagtgctgggattacaggtgtgagccaccgcacccagctgaaaactgtttttacctcttttcttttactaaggaattcccaaattgggttgtatgtcagtcagctgaaggagtttttaaaattacatcctagatacactgaacaagaatactggggtgagaagctgggtgcagtggctcacgcctgttatcccagcactttgggaggccaaggtgtgcagatcacctgaggtcaagagttagagaccagccttgccaacatggtgaaaccaaaatacaaaagaatagccaggtgtggtggcaggcacctgtaatcccagctactcgggaggctgaggcaggagaattgcttgaacctgggaggcagaggttacagtgagccaagatcacaccactgcactctagtctggttgacagagtgagactccatctcaaaaaaaaaaaaaggatacggaggtgagatccaggactttttcccaaaaagctactcagatcgttcttatgtatagttaagtccagtagcccagtgaatggaatctattgccctaatatctgattctcctttaaaaatgtaagttgctcattcttccatgttaaaggcacttacagtagagaaagcggtgtctcctgtttctcactgctttttcaggccattattctcactactgaacaaaaactgcttttttttttaatgtgggtatgacctttggctactcccctttcaaatgttcccagctttcttttcttttttgtttttttgagacggagtcttgcctcccaggttcaagcaattctcctgcctcagcctccctagtagctgggattacaggcatgcagcaccatgcctggctaattttgtatttttagtagagacggggtttctccatgttggttaggctggccttagaactcccgacctcaggtgattggcccgcctcagcctccgaaagtgctgggattacaggcaggagccatggtgcccggcctatgttcccacctttctacccactatcacatttccccacaggcatcaaagactttgggttggcactgatttcagtttctctctttccaagctattctgtgtgtctcatatataaatgtacatcccaatgaatgctcacaaagtgatcacacccagatgaagaaatatattatcagtaccccagaaccccctcctatgcctcctaaaattgctcactactcctactctacaaaaataaccttcatcctaacttaaattacagatgggttttgcctgttttgtatttgtataaaagtagtaacagagtatgctcttatgctcttcttctttggtcaacattattcatgagattcatctatatggctgtatatagaagtatcttattcattttctttttaaatatttttctttttttctttgagacaaagtcttgctttgtcacccaggctggagtacagtggcacaatcttggctcaccgcaacttccacctcccagtttcaaatgattcttgtgcctcagcctcccgagtagctggggttacaagcgtgcgccattgcaccaagctaattttttctactttcagtagaaatgaggtttcgccatgttggccaggctggtcttgaactcctggcctcaagtgatccacatgcctcagcctcccaaagtgctgggattagagacatgagccactgcctcattttcattattattgtgcagcatccatttatgaatatatccaatttatttctttattctattggaaaacaatttgggttgcttctagcttttggctattaagaataaagctatacagccaggcgcggtggttcacgcctgtaatcccagcactttcagaggccgaggcaggtggattacgaggtcaggagttcaagaccagcctggccacaatggtgaaaccgtctctactaaaaatacaaaaattagctggccgtggtggagggcacctgtaatcccagctactcgggaggctgaggcagaattgcttgaacccaggaggcagaggttgcagtgagctgagatcgtgccactgcattccagcttgggcaacagagcgagattcaaaaaaacaaaaaaacaaaaaaccaaaaaaacaaaaaaacaacaaaaaccatgcttctgaagttcacatagaaaaaaaacctcataaaaagacagacggatcggtgacaggttcttctccatttgtgccaagccatatggatcttgctaaaatgtcacacttatatacttgagttcattacagcatactgcctgtatgcattatcatgacactcaaggccctattatagtctagtctcaaactacctttccagaatattctacattttcacatccttcactttgttacaaattacataccgatatttaccatcacaaaatcttgtaatgatcagtgctggattttcatttaaaaattatgctcattcattcttctaacatctgtggtccaggtgcaatagctcacgcctataatcccaacactttgggaggctgaggcaggaggactaattgaggccaggagttggagaccagccagggcaagagagcaagactccgtctctataaaaaattagttgggcgtggtagcatctgcagacgtcttcttatgagaactgcttttagtttattcagttatttgaagttaaatgaaagacaatttatgttaaaaaaaatttgtgctaaaaaggttttaagtatcattctaatccagattattggctcattgaatccagtgagtaggaaaaatctagtttgtatttgctgggggtgtgtgtgtgtgtgtgtgtgtgtgtgtgtgtgtgtgcacgcgtgtgttttaagagacagggtcttgctctgtcacccaggctggagtacggtggcagaatcatggctcactgtaccctcgaactcctaggctcaagtgatcctacggccacagtctcccaagtagccaggactacagccagttgagtcaataaatatttcttgtttcaagctatctccttatttaatatggtctataaaataagattattaagtaaacatttaactttatacctagcttttatataagcccaatcatcccctttttaacgcataacttaacatcgtaattctttagatcacataactctttagacaattgtgtagttctaaaacattaaccaggccaggtgtggtagctcacatctgtaatcccagcactttgggaggctgaggcgggtggatcacttgaggtcaggagtttgagagcagcctggccagcatggtgaaaccccatctctactaaaaatacaaaaaagttagcttggaatggtggtgcatgcctgtagtcccaactacctgggaggctgaggtaagagaatggcttgaacccgggaggcagaggttgcagtgagccgagatcgtgccattgcactccagcctgggcaatacagcaaggctccatctcaaaaaacaaaacaaaacaaaacaaaaacaaaaaacacataaaccattcgaggcttgaaatggaccttcataataagcatattaaaaaaaagcatttccacactctgcccagtgtcaccccgatctagctttttcattgccttggtttaaaaagctttttattggccaggtgcagtggatcacacctgtaatcccagtactttgggaggccaaggagggcagatcacaagatcaggagatcgagaccatcctggctaacacggtgaaaccccatctctactaaaaatacaaaaaatcagccgggcgtggtggcgggcgcctgtagtcccagctattcgggaggctgaagcaggagaatggggtgaacctgggaggcggagcttgcagtgagccaagatcatgccactgcactccagcccgggcaacagagcaagactctgtctcaaaaaaaaaaaaaaaaaaaaaaaaaaaaaaaaggcttttttaatttttttattttagtatagttttaggtttacaggaaaggtaaaaatacagagagttcctgtacaacccagatccaatttccccaatgttaatacctttcattactatggtatatttgtcacaactaatgaaccaatactgatatattattaactaaatcctatactttattgagattttagtagttttcccctaatgttctttttctgttccagagtctcacctagagtactgaaatacatttagttgctcctgtctttttagactcttctggtctatgacagtctctcagactttccttatgtctgaaagtatgtcaaatattttgtagaatgttcctcaattaagggtatgattttttccctcatgattagattgtgtttgtgggtttttagggggaagatactacagatataaagtaccattgtcaacatatcaacatgacttatcacttacaatactgtcaacatgctatcaacatgacctatcacttacaatactaaatttaatcacctgggtaggtaatgtttgccaagtttctctacttcaaagttgtttcccccttttgaaactgtactattcagaagcaagtaactaagcacagcctacatttaaggggtagaagttatatttcatctccttgagaagggagtatttaaatgatttggaattcttttgtatgtacattgtcatattctagctaattgttcataaatatactcacccttaggttataaattacttagtgttgtatgttccaggtaggcatgatatttaacaaatttctgccaaatacataaatttcccaaagcatataataaaaataaactggttcattattatgtcttcaacatctagaatacagtgcctggattattacagaatattcagaattataacataggctccataagaacagggatatcttgttattcaatattgtatctctagatagtaaaactgtacacagctcaagtgctcagtaaatatttgatgaatatataattcaaaaatgtaaactcttctttaccctaagtgtatataaatgttatatacaagaatctctctaccacacagtttaagagaggaaagaatggacctaactaaaagaaaacacacaaggctgaaaagttagtcagtcagtaagacctaatgccataccagacaaggattaagtcacacgctccctatacttaaagaataaactacattctaactgcaacagaatttcttcttttttctagaagctaagcaagcactggcctcaagataagcaatattgaaacaattgcagcttactgactgccagatgctgactgactcactccctgttccacagccgtaactacagctttgactggacaagagactgatttcagtaactttctcctgataggagtcgccaaccatggactggttctggcccgtatacagaggctgagcattgagtgccttcgtgtccttggctttaccttttgacaacagggcctaattgtaatgcatttaaattgttcagtccccactccaaagtaaacatgaaatgcatgtaacatgcatgtttgtctactatgcatgcgtgtgtttcccttttcatgatgttcacagctcctcctatagcctgctgaatcgatttagttgtacttggccaacttattcagcatcaattcctatgttacccttccctcctgcaaagtgcctgcttttagtctttgccagaggccacacttcccagcctgtcaggatggccagtcttttttttttttttgagatggagtctcgctctgtcacccaggttggagtgcggtggcgcaatctcagctcactgcaagctccgcctcccaggttcacgacattctcctgcctcagcctcccgagtagctgggactacaggcgcctgccatcacacctggctaatttttgtatttttagtagagagggggttccatcatgttagccaggatggtctcaatctgctgacatcgtgatccacccacctcggcctcccaacgtgctgggattacaggtgtgagccaccacacccggcccaggatggccagtctttataagaattaaagctcttctctccaaattggtagatcttgtgattctttgaagttcctcctgactaaagaatgatacagaggaatgacagaaataaggctaaggaaacaaacaggaatccagacacaaaggaatttatgtgccatgttaacaagtttggactttatcctataataaatataatccttaaagagtttttaagtagagaaataacatgattagatattatttttcattatttttatttctatttttgacacagggtctcactctgttgcccaggctggagtacagtggtgctatctcagcttactgcaggctccgcttcctgggctcaggtgatcctcccacctcagcttcccaaatagctgggaccacaggcagcaatttagccaccacatctggctaatttttttgtatttttttgtagagacaaggtttcaccacgttgcccaggctggtctcaaactcctggactcaagcgatgcacccacatcagcctcccaaagtgctgagattacaggcgtgagtcaccaagactggtagagaagtaacatgattagatattaatcagaaagaaaaaaacaccctcattctgaatccatgctgtaaaaatacaatggaggggaacaataataaatacaaggaacccaggtgaaagacagaggcctagactagaaatggcaaaggagtgggagtaccaaatgaatttatgcacgatttaggacacagaaccaacagatcttggtaatacactaaaggtaaagttttagggagaggaagaagtaaagaatgtatagcattatcagtcacggtggctactgctgacaggcaggctggcagatgaaaagacagtaatttgtgtttgggaagtgctgaatcacacaccaagacatgggtttggaaactatggaaagacaaaggctaaagaaagaacttgaaaagtaatcagcatatagacagtaactgaaatacaggtgtggataagattacccaggattaaagtcaggagtagaaagaatatagagcttaggttggagttgaaatggtgaggactagtatttaagaaatctttagttatcccagcatattaagaatatgccaggccgggcgcggtggctcacgcctgtaatcccagcactttgggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaagaatatgccagtgttcatactgaggagaacatgggtaaaacagaaacagtagaaagctaacttttaattactctaaccaagattcactacttaattaaatagatccgagaacacacaaaaaagtactcattatataagtcagttcttcccaggagaagcagtgttttagtttgggagaaaaatgctgggtccacaaacccaggacaatctggggttctagtctggttgtactaacaaccagctatatgaccaggtaactgaaaactataaaatgagctctttaagatccttcgtaagtctaagagtcaatgattccactgagatcattctatagtctagcaagatatacaaataagactttatatcagaaagaatagtataaaatatgagcatgggatacaaacaaatctggggattcaattactctcatttactaaattgttaaaagttggcaagttgctttaatttctctatgcatcagtgaatgtatcacacagaattttattaatataaggtacttaaagtgcttctcacagtgcctggtacataaaacatttttcaaatgttagctattgttttaaatatctttagtaataaactctaaaaaatccatattataagatataccacttccaacaccatgaaccatgtacaagcagtggctaccacctatttaaaatataatacagtcagagaagagcagagagaaaacagaatggcttggaggcagtggagtgacctcattacctgcgggtcctgcagcagctgcatcttccatgagttctccctcttctaattccatgttgttatattccacatcattttctccagacctaagaatatacaaaatccatcatttatatagagtgatacaataaacgttgtttttcacacctcaataaattttatgatatgcagatttttctgtgaaataagatatttctaaatacaaaaaggagaaagatttttgtcattttccaaatttaagtagcgttaatgttattgtttaaacaacctttaaaaaatatcggccgggcgcggtggctcatgcctgtaatcccagcactttgggaggctgaggcaggcggatcacgaggtcaggagatcgagaccatcctggctaacacggtgaaaccctgtctctactaaaaatacaaaaaattagctgggtgtggtggcaggcacctgtagtcccagctactcaggaggctgaatcaggagaatggcgtgaacccaggaggcaagcttgcagtgagccaagattgcacaactgcactccagcctgggcgacagagcgagactccatctcaaaaaaaaaaaaaaaatcagccagttcttcttagaaagctaagaaaaaaaggaatttaaaaaaaaaaaaaaaaaaatatatatatatatatatatatatatctcaaggccgggcgcagtgactcacgcctgaaatcccagaactttgggaggctaaggtgggaggatcacctgaggtcaggatttcgagaccagcctggccaacatggcaaaaccctgtctctcctaaaaatacaaaaattagctgggcgttgtggtggggacctgtaatcccagctcctcgggaggctgaggcagcagaatcggttgaacccgggaggtggaggttgtagtgagccaagattgcactactgcacttcagcctggacgacagagcgagactctgtctcaaggaggacaggacaggacaggaaaggaaaggaaaggaagattaaaaaaaaagaactgtgtcaggcaaaaaaatagaaataaatgaaacactaaaaaatctaagaaccactattagaagagattaatctctcctatttaattagtgttagaaacactaataaatacaagaaccactgttagaagaaattacagcttcagagaactggtagcttaatggcaataagcttaaaacactacatgtagtgttaggcttaaaacactacattttaacatccaaaaaaagcccaaattactgtatatgactaaataccatttttcaaaaataatatttcagcaaagagggtattacttcctactcggccatacaaagtctctcatgttaaaaaacaatcactattactttattttaaacaacatactacttgaaacagtaccagtcaatgacagtcttgggtatttaaggaaatctcaagataagcacccagcttgacaatgtaaggagctctgtaggtctgctctttagtcaaactggtgacaattattttaaaaacaaccacttaacgactctggaaatggtcccaagggcatacagcaaatgaagaaacatctactcaaaaaaatctataaaaactgggtaagacaagtgggcatctgcagtatttgaaccaagatcactccacttcctaacttggtgttacagaaattccactccagactggtgcagtgaagaacacaggcctcccacttcccgaacttccaagaggagggctatattcctgggagtggcaaggtatcagcatctctcattctgcccccagctacctattgctgatgctatagtacaggcacacacggccaagaggtggagactcccttctgctgagacccacttgtggactagatgctctacctggatgcagcatgatgagaatactggggcccagatcatccctgccccagcttattcataaggtggaggtcccaagcctgaaaaggaaagaactaaggctactgtccccaacatccagttagctcagcttctaaagtaagagaggtacacctttatccttactccaacttcaaagctttggctcagagattttgcctatggggagaagcagagacacatacaacactcagagaaacatacaacactattaagagcatcaacgaaatatagttggccttctttatctgtgggctctgcatctgtgcattcaaccaactgtggatcaaaaatattttttaagccctggtgtggtggttcatgcctgtaatcccagcactttgggaagccgaggctggagggacttcttgagcctaggagctccgggccagcctagaacatagtaaggcaacatagtgagaccctgtctctacaaaatattaaaaaattagccaggtgtgttggcatgcacctgtagtcctagctacttggaaaactgaggtgggaggatcacttgagcccaggaggtcgaggttgcagtgagctgtgatcacgcgaccactgcactccagcttgggtgacagggcaagaccccgtctcaaaaaataaagccggccgggtgctgtggctcacctgaggccaggagttcaaaaccagcctggtcaacattgcaaaaccctgtctctactaaaactacaaaaaattagtcgggcgtagtggcaggcgtgtataatcccagctactcaggaggctgaggcaggggaactgcttgaacccaggagacggaggctgcagtgagctgagattgtgccactgcactccagcctgggcgacaagagcgaaactccgtctcaaaaaaaaataaataaaacaaaacaaaataaagtcatgcgcagacattttccccttgtcattattctgtatacaatagagtataacaactacttacatagcatttgcattgtattaggtattataagtaatctagagatgatttaaaagtataggggaggatgtgcataggttatatgcaactactctgccattttatataagatacttgagcatcctcagattttagtatccaagggcggggtcctagaaccaataccgcaaggatactgagggacaactgtactagcaaacagaatgcagtaacatataaaaagaatcatgagccgagtgtgatgatgcacaccagtagtcctagctactatggaggctgaggcaggtggatcacttgaggccagagttgaaggttacagggagctataatcatgccaccatactccagcctggccacaaagccagattctcttaggaaaaaaaaaaaattgctgggtgccgtggctcatgcctgtaatcccagcactttgggaggccgaggcaggcagatcacaaggtcaggagattgagatcatcctggctaacacggtgaaaccccatctctattaaaaatacaaaacaaaattagccgggcaaggtggtgggcacctgtagtcccagctacttgggagactgaggcaggagaatggtgtgaatccagaaggcggagcttgcagtgagcggatattgcgccactgcactccagcctgggggacagagcgagactccgtttcaaataaaaaaaaaagaaaaaaaaaattacggctgggcgaagtggatcacacctgtaattccagcactttgggaggccaagacgggtggatcacgaggtcaggtgtttgagaccagcctggccaacgcagtgaaacctcgtctctactaaaaatacaaaaaattagctgggtgtggtggtgggtgcctgtaatcccagctacttgggaggctgaggcaggagaatcgcctgaacccgggaggcggaggttgcagtgagccgagatcatgccactgcacttaagcccgggtgacagtgcgaaactccgtcacaaaaaaaaaaaaaagaaaaaagaaaaaaaattacacactatgaccaagtgggatgtgtcccaggaatgcaagcttggtttaaaaatccaaaaatcgccaggcacagtggctcacacctgtaatcctagcactttgggaggctgaagtgggcagatcacctgaagtcaggagttcaagaccagcctggccaacatggtgaaaccccgtctccactaaaaatacaaaaaaatagccaggcgtggtggtgcacgcctgtaatccttgctactcgggaggctgaggtggaaggatcacttgaacccaggagatggaggttgcagtgagccaagatcgtgacactgcatgccagcctgggtgacagagcaagactccatctcaaaaaaaaaaaattatccacattaatgaaattcattagttcatcaattaacagggcagaaggaaaagctcttccttaaattgcaactaatgaatgagtaagaaataatggaattagaaaaacaccacttggcaatcaacacagtaacctttttcaggcaacactcatcaaagggtgtcaaaattcataggaaaaagtaggatgaaaaataggatatttacagtcccatacataagatacttattaattataaaggaaaaagtacaaattttggagtgaagaaacctggcggatgctacctcaactaagtgatcaaaattaaccacaagtaatgggacatactgacatcatgctccactctgtatgacgcagtgaaaaggatacattatcatttccgtagtatccctgccaaaagtgtgtaacctctatctaatcatgaggaaacttcagactaatccaaactgagggactttctacaaaataaactattctgtatttctcagaaagtattagtcatgaaaaacagtttttttttttttttgagacagagtctcaactgtcgcccaggctggagtgccgtggcgtgatcttagctcactgcaagctccgcctcccgggttcaccccattctcctgcctcagcctaccaagtagctgggactacaggcgcctgccaccacacctggctaatttcttttttgtatttttagtagagacggggtttcaccgtgttagccaggatggtctggatctcctgacctcgtgatccacccgcctcagcctcccagagtgctgggattacaggcgtgagccaccgtgcccagccgaaaaacaaatttttaaaaaagtaacccagattggccaggtgcggtggctcacgcctgtaatcccaacactttgggaggccgaggtggacggatcatgaggtcaggagatcaagaccaacctggctaacacggtgaaaccccgtctctactaaaaatacaaaaaattagctgggcgaggtggcgggcgcctgtagttctagctgctcgggaggctgaggcaggagaatggcgtaatccggaaggtggagcttgcagtgagctgagatcatgccactgcactccagcctgggcgacagagcgagactccgtctcaaaaaaaaaggaaaaaaaaaaaagtaacccagattgaagataactaaatcgatttaacaattaaatgcaacatgatcctgacaaaggacattactggcaaatttttagaaggttacagtattacatcaatgttaatttccagattttgataactattctatagttatgtaagaatatccttgtttttagaaaagtacacaatgagaagtatattcgatctcaagtgtttcagaaaaaattatatacagagaaatataaagcaaaatattcatagggaatgaatctgtgtgaaggaaacatgaaattctgaacttttcttaagtataaaataatttcaaaattcaaatttaaaagttaaaacacaaacaaaaattattggctaagagcccagagattagagagagaaaactgactattgattcaatctttcaaaaaagtgctgaatatccctacatttaagtgtgagttagttaatatgcttctaataattaccacttaaatgctttacagtagtaaagtgggaaactcacatagtttcttcatcaatatcattttcttctgtattacttgttgctgtggaactagcagaggaactgctgccatcgagctgatttacttcatcctcataaacaagatccagatccagatctccatctgaaagctcgtgctagatcaatgccaagaaaacaagacgtctattccaaatgtttctactcagttgatcaccccatccagcccataaaccaagcaccaaagaataatacagttttcaaaaatctattttctgctcctgtgcctcagctgctgagccctgtagagaaaaatcacacaaccacactgactgatatcattttactaacttatgcgtgccgccttcagctgggccctcagtgtgactggaatccttcacatattccacatcagcttcctcacagagtaacgtttcaaaccatcactcctcaattctacctaattttaccattatcaaggtcattaattaacactgtcacctatctgcacagaaaaaaaatacccactattaagcaaaaacttccccaacttttcagctgccttacctgcaaactccacccttcctttaactcagtttatcaaaggttaactgcttcacctgactgctccattccaaaccctattatctctagtttatcaaagcacttaatctgtgcattctctcgacccactgggtccttcattttaacttaaaactgaagtctctcatcttaaaaattactacaaaaaaaccaactgtctatgcatcccttcttatgtaaaaatatcaactacttcttgaactcttattctggattctgactgttgtttagctgggatagaacctggctagctaccgaatcctaaatcagtctacctacgtaagtaatgataaggcatgtactagtttcagtgaatgaaaatagaacaccttttttttttctttttctttgagacagagtcttgctctgtctcccaggctggagtgcagtggcacaatcttggctcactgcaacctccgcctcctaggttcaagtgattctcctacctcagcctcccaagtagctgggattacaggcaagcaccaccacacccagctaatttttgtatttttcgtagagacagggtttggccatgttggccaggatagtctcgaactcctgacctcatgtgatccacccaccttggcctcccaaagtgctgggattacaggtgtgagccaccgcacccggccagaacacatttttaaaatccacaatgtatggtagtttaggttttaaaatgtgtatcacggtttgttttatacaatgtattgtttttttcacaaccttgaaatgctttgattcaacaacttctgacttattaacatttacataagggcatacatacattactaatggaaatcaatggacaatatttttagcctactgttttagcacataatatgttaaaagccatgatgctactgtttttttttaatcaaacacaaaaatctaaaactggcctcattattacatgataatcttcattctgaatcttctcctcatcttcttcatcctctttggcctctcttacagaagctgtagtaggaccaccttcgagaagcatgtcagagcatgcagacttcttagctcgtgtctccagagcatcatcattttgggggctaagatggttatctggtggtgacaaatctcttgacttctgagttcgagacagctcaatagtaagtctcttttaaaacaagaaaagcacaaatattagccacagctcactggcacagtaaaagatgtctcaagtgaaaaaaaaatgcatccagatgtttctaaaaccattgctttatttattttttgagaatggtctcactctgttgcccaggctgaagtgcagtggtgccatcatagctcactgcaagccttgaactactgggctcaaacgatcctactgcctcagcctctcaagtggctgggactggaggtgtgtgccaccatgcttggctaatttcatttttatttatttttagagacggtatcttgctatgttgctcaagctggttttgaacccctgggctcaaatgttcctctggcctcggcctcccaacatgctgggattacaggaatgagccacctcacttggcaccatttcttaaaccatttctctgaatccctactgccttttatttataaaaaaaaattgatgacaaagataaactgccccatttatgctcatcctccttctttcatatccagcctaagctaaacatacaattagcaaacagtatagtgaatacaggcagttttaaatagcacatttaacatgaaaatctctgaaagcatgtatttattcacattttcctccctgacctattaacgactctcagcactccaaacctcctgccacaccctaacttcctaagggaaatgaaacattccttagtttaccactgtaaaataaaaattcatcaattaatcttccccagtgctcattcaacaatagtaagagttcaagatgggacaacttttaattgtgctatagcctagaatcctctaaatccaagataacttgtggaagagaaactaagtcactgacagaaacacaaacagcttacctcaaactacagccacactgttcaaaacaactttatgcaatgatggaaatgctctagatttgcagtaaccaatgcaagcacttgaaatgtggctactgcaactaaggaactaaatttttaattttaattaagctaaatttacagaccaggcacagtggctcacacctgtaatcccagcactttgggaggccaaggcaggcagactgcttgagcccaggagttcaagaccagcttgggcaacatggagaaacccatctccacaaaaacaaaaactagccatgacacatgctcgtagtcccagctacctgggaggctaaggtgggaagatcacccgagcttgggaagttgaagctgcagttagtggaaattgtgcctggcaacaagagtgagtccgacctgtctccaaaataaaaaaaaataaaaataaagtggcagggcgtggtggctcatgcctgtaatcccagcactttgggaggccgaggtgggcagatcacgaggtcaggacatcgagaccatcctggctaacactgtgaaaccctgtctctactaaaaatacaaaaaaattagcccggtgtggtggcaggcgcctgtagtcccagctactcaggaggctgaggcaggagaatggcgtgaacccaggaggcggagcttgcagtgagccgagattgcaccactgcactccagcctgggcaacagagcgagactccttctcaaaaaaaataaataaataaagtaaaataaaaatttacatggccgtatgtggctagtgtctactaaactggacactgcagaactggtaaggatggggaacaagataactagattttttttctaattacaaattacaaaattacaaatagcaataaaatatataaaatctaattacaaatataacaagccaaaaggacaataggaaacaccaaaacagaaatagatattttcttacctctttaaggttgtttatttgttggatataactagtctgtgcagcttccaactgagtaatgtaccaatgctggtcccgggatttttgaaagaaagttggtgaacgtacctgaaaccttaaaagaattgtgccacattaaaaaaaaaattcaaatagtaaaacattatcagtctagcactgaattctgcaatttgggttaacttgattataaggccaaaattcacataaacttagagctgctagtatttgttgtttatagatgtagtccacagattatgacacaaggttctgaaaagccagttgtcctcaaactacctttctaaagaaataacattgtacattgtagttaagcttcccaaactaacctactcaggcatatttattataataatgtaactaaaatacaatgatgatcatgagttgggaagaagagagccatatactatgcagtttcctcctataaggaggaagataactcttatccctttcttccctaaatgaggccccagcaaaatacaaagttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtagcaaaatacaaagttttaagtgctgctctttatatttctctattccatctcacgttcccgtatttcctgcccctcagaaaaaaaatcacttcctggctcaaccacccaggattgctttactatcccccaaggagttacatgctctaaataaactatatcctgaacccttcaagatagcaatcaaaactgcccttattacaatatggcattatttcagcttaggttaggaaaaaaagtactgcacctacataaaatcgtattaatatataaatgacagaatcttaatctatccagagttgttttaattaaaaaaaaaaaaaaaactattactaaagcaaacaaacctctacctttgttacatagcctaacgtgactatatttaaggtgaaaaaattgcagtgcatgtgtgaaggtgtttttgaagaaaggaaaaaccacaaggcaagactaatttggacatctacatctctctcattccttccagcccttttacccggctacacaatgttagctgttcatttttttctaggattttacaccttattgtaagaacctactgaccatttaacagttatctggcagtagatatctagttttagtgaagaatactaatgcaagaaaggacagaacataaacactgactataaaacaacagtcctatttaatgttgggatagtctttataggtcagaagtttttgggcatcattatatgttataactggatgatcaaaatgagaacttgagtattaaaaaaagagagagattggccgggcacagtggctcacacctgtaatcttagcactttgggaggccgaggtgggcagatcacctaaggtcaggagttcgagaccagcgtggccaacatggtgaaaccccgtctctactaaaagtacaaaaattagccgggtatggtggcgggcgcctgtaatcccagctactcaggaggctgaggcaggagaatcgcttgaatctgggaggcaaaggtggcagtgagccgagatcgcaccactgcactccagcctgggcaacagagcgaaactctgtctcaaaaaatcaaatcaaatcaaatcaaatcaaatcaaatcaaatcaaatcaagagattaaattacgttctgaacggaactgagtagagatgattcactcaactgagcagagacgattcacagtctaggaagtacccactggtaagacattaaagtaagaccgtctaaacactattattttctttgaatgatttaaaccactggttaactctgcacattagttctaatattttgccattaaaacaaaaccaagcagcaggtaaaatttcttaactttctgttttaatgaaagaatgaaacatacattcatagttatagaaaagccttaaataactttctaataaatacatacaaaattccaccagaatcttgaaataaaaggtttaaagtttgagcaatgtctcattaataggataatgtgaagccccctatccacaaacttcatagcaatttacttacggtgctactatagcattattttataataagagagtagtaaattctgtttttatctgccaatttcatcttgagttccctgtggacaaaaaccatgtctatatttttcttattagcaactcagtgtcaggcatatggtatagactcaatgttgcttaaaaaaaatgatgtcataacaggaatttgtttctgtactaataagtaacgctaataaggatgaaatcaaggctataagaaaatgggtcttttataggttggtaaaattgatgtttgaataattttgtaattctctctatggctgaagcatgaaatagcaataaattatttctcttggtgaatagttaaaccccaaaagtctgaaaagctatacgaagaaaactaaaataatccctcccctcaaaaaacatgattccaggcaccgtggcatgcacctgtaatcctacctacttgggaagttgagacaggaggatcacttgagcccgagaattctagactagactgggcaatatagcaagacactgactctaaacaaaacaaaacaataacaaaaacatatctttttccctacactgaaaatcatatcccttgttaaacttctttatacttccagaaaagctacggaaaacacataagagtaaatgctgatatgatagcaactcatctgtccagtatgctcaagaacaaagagctccgaataagggaaattcaggagtacattaaatcactctcaagaaaaaaatgtttaaaattgttgtgatgagaactttttaaactgttaaatactctgaaacttctcagttcagaacatattttaatcttttttaaatattcaagttcttattttgatcatcaaattataacatcatgtaatgatacccaaaaacctttttttgtttgttttttgtttttttaagatggagtttcactcttgtcgcccaggctggagtgcactggtgaaatctcggctcactgcaacatctgcctcccggactcaagcgattcaactgcctcagcttcccaagtagctgggattacaagtgcctgccaccatgcccagctaatttttgtatttttagtagagacagggtttcaccatgttgcccaggctgatcttgaactcctgacctcaggtgatccacccacctcagcctcccaaagtgctgggattacaggcgtgagccacggcacccagccaatgcccaaaaacttctgacctgtaaagactaccccacgttaaacagggctgttgtttttatttactttattattatttttgagatagggtcttgctatgtcgcccaggctggggtgcagtggcataatctcggttcactgcaacctccacctgccggattcaagcgattctcctgccttggcctcctgagtagctgggattacaggcgcgtgccaccacagcccggctaatttttgtatttttagtagagataggatttcaccatattggccaggctgctctcaaactcctgagcccaagtgatctgcctgcctcagcctcccaaagtgctgggattacaggcgtgagccaccacacctggctaaatagggctgttgtttgagtcagtatttacgttctatcctttcttgtaaatactacaccaacaatcaacaataaaaattgatggttttggccagacgtggtggctcatgcctataatcccagcactatgggaggccgaagtgggtggatcacctgaggtcgggagttagaaaccagcctgatcaacacggagaaaccccatctctactaaaagtacaaaattagccaggcatggtggcgcgtgcctgcaatcccatctactcgggaggctgaggcaggagaatcgcttgaacctgggaggcaaaggttgcagggagccaagatcgcgccattgcgctccagcctgggcaactagaaactctgtctcaaaaaaaaaaaaaaaaaaaaaaaaaaattgatggttttcgcaaataccacatgttctcacttattatttaagagctaaatgggccgggcgcagtggctcaggcctgtaatcccagcactttggaggctgaggcaggaggctcaagaggtcaggagatcgagaccatcctggctaacacggtggaaccccatctctactaaaaatacaaaaacaaaattagccagatgcagtggcaggcacctgtagtcccagctacttgggaggctgaggcaggagaatggtgtgaacccgggaggcagagcttgcagtgagccgatatgtcgcctctgggcgacagagggagactccatctcaaaaaaaaaaaaaaaaaaaaaaaagctaaatgatgagaactcaaggatataacgaggggtaacaacaacagacactggggcctacttgagggtggagggtgggaggagggagaggataagaaaaaataactattgggtactaggcttagtatctgggtgatgaaataatccgtacaccaaatcaccatgatgtgagtttacctgtataacaaacctacacatgtacccctgaacctaaaataaaagtttaagaaaaaagtagaaaattgctggttttcgtcaactttcatcttgactcttctacttttaatttgctgttattgacaaagaactgatagttgctttataaaattaagttgtaaaaccagtcactcaaatataatatgcactgtgaagtgaaaaaaatcagcactttatccctcactattcttagatttccaaatggtgaggtcactagaagttcaacagacaaatggaacattactatacttactggaagttgtagtttcccacccacccccttttttttttctttttaaaaagatggggggtctcataatgtttcctaagctggtctcaaactcctgggcccaagccgtcctcccatcttagcctccatagtagatggaaacaccggcgcaccactgcacccagcttatctttaatggaattgctaactagatgtcaaaaaaagtttgactttttgactacaaatttttgattattatccacttaaataaaacagttaagaaagtgataaggggccgggcacggtggctcacgcctgtaatcccagcactttgggaggccgaggcgggcggatcacgaggtcaggagatcgagaccatcctggctaaaacagtgaaaccccgtctctactaaaaatagtaaaaaattagccaggcgtggtggcgggcgcctgtagtcccagctactcgggaggctgaggcaggagaatggcgtgaacccgggaggcggagcttgtagtgagccgagatcgcgccagggcgacagagcgagactatgtctccaaaaaaaaaaaaaaaaaaaaaaaaaaaaaaaggtgataaggttatagttagtatgaatttcaatattcatctttgttaaccaaatgatctttgaaatatagttctgatgatattatttccccacaataaaaaccacaacatcaaatttttcctgttaccttaaaatcactgtatcattttgtggattcaagtatccttcatttgcgagtaagtccaaacggaaaaatctattatagccccagcattctccaacttcaaagtcagatgcaaattctcgaatgatattttttgtaggatcattacaggactggtgaaccatctctacacgatattcatatctaaaattgaaaaacagaccattactatacagttagtaaagtaagaataaaaaacaaactcatctaaacattaaggtcactaagtaattacctgagaagaaaccttattgatatacgcagttacatttcttttatcatttataaaaacagcagtattttggggtttttttatttatttaagatggagtttcactcttgttgcccaggctggagtgcaatggtgcaatttcagctcactgcatcctctgactccaggttcaagtgattctcctgcctcggcctacagagtagctgagattacaggcgtgtaccatgcttagctaattttgtatttttagtggagacgggggttcatgttggccaggctggtcttgaactcctgacctcaggtgatccacccaccttggcctcccagtgtgctgggattgcaggcgtgagccaccacacccggccagaaaaagagcagtatttttttgtttgcttttttgagatagagtctcactctgtagcccaggctagagggcagtggcggggtctcagctcactgcaacctctgccccccagttcaagtgattctgctgcctcagcctcccaagtagctgagattacaagtgcacaccaccatgcccagctaattttttgtatttttagtagagacagggtttcataatgttggacaggctagtatcaaactcttgacctcagatgatccaccctccttgacctcccaaagggctgggattacgggtgtgagccactgcgcccagccaaaacagcagtattttgaacgaaccaccaaaacatgaatggcaataggtccttttttcctcgtaaagatgtttaccgatatatcaggtataaaacaacacctcaaaaaataaataaattttgaataaacaagtaattcaaagttgcttttgttttactaatgcaatattttttccatatattcactacatatgtttcctcataaatattgttatttctattatcctttgaggtttatcaccttgcaattttaaaatataaattttgaaatactctactgtattttgccagtacaagtgataagaaagcaaattattgtgtattcagaaaatcaaaggctataaaatttcctaatagaaaataagtatgcagccataaaaaagaacgagattatgttttttgtgcaacatggatggatggagctggaggctattatcctcagcaaactaacacaggaacagaaaaccaaataccacgtgttctcacttatattgtgggagctaaatgatgagaacttatgaacacaaagaaggaaacaacagacactggggtatgcttgagggcagagggtgggaaaaaggagaggagcagaaaagataactattgggtactgggcttaattcctgggtgatgaaataatctgtacaatgaacccccatgacatgagtttacctatgtaacaaaccttcatacgtaacaccaaacctaaaataaaagttaaaaagaaaagaaaaaggaaaaagaaaataagtaagctggacacagtggctaacacctgtaatcccagcactttaagagaccgaggtgggcagatcgcctgagcccaggagtctgagaccagcctgggcaacatggcgaaaccccgtctccataaaaacaaaaaacaaaaaaattagctgggtacggtagtgcattcctgtagtcccagctacttgggagactgaggcaggaggatcacctgggcccaggaggttgaggctgcagtgagccataattgtgccactgtgctccagcctcagtgacacagcaagaccctgtctcaaaaagaaaagaagtatacattgggaaagccaatatattctaatttatatatccaatcttgtaaaattttcaggtttacaaaaagacaaagaagatagcctataaacttttgtgcattaatgcacattatcaagaaaatgaaaagaaaacctaccaaatgggagaaactatttgcaaatcatatgtctgataaaggtttagtatccaaaatatataaagaattcttgaccgggcacagtggcacacacctgtaatcccagcattttgggaggctgaggtgggcggatcacctgaggatacgagttcaagaccagcctggccaatatggtgaaaccccgtttctactaaaaatacaaaaattggctgggcgtggtggtgcatgcctgtaatcccagctattttgggaggctgaggcaggagaattgcttgaacctgggaggcagaggttgcagtgagctgagatcatgccactgtactccaagctgggtgataaagtgagactcaaaatacattaagtaaataaataaattgagacagggtctcactctgtcattcaggctggagtgcagtggtgcggacacagctcattgcagcctcgacttcctgggctcaagcaatcctcctgcctcagcctcctgagtagctgagacgtatgcagggtctcaccatattgcccaggctggtctcaaattcctggtctcaagcaatcctcctgccttggcctcccaaagtgctgggattacaggtatgggccagccagtctggcatattaacctttgactgaacacaagacactgtaaattttactctgttggatgttagatacttcagcaaccttataaattttcttgagcttccttctgggatgcagttaagttacttgaaaacaatttgatcctttcaggtctcacttttgttaggtgggtccagagcagtgttcagtctagggctaatttctgctatcgagacaaaaacttccttagtgttatacccaatcagtgacccatgaattataaatttctccaccgtggcaggttgcaatagacacagttcctggccccgtgtgaacaccagtcactcactattccctctaatcctgtcaaggagttctttccccaatctcaggtagtttcctcagacatatgccctgataagtactctgctgaatactcaaggggaacccattacggatctctagacttcagtctctgcagctttctcctctctggtattttgtccaatgcgctctagctgtattgtcctttctagactctcagcactatcccctcaactaagtctgccagattctccctcagtcccagctcctccctgtgttgcagcctgaaaactctctcaaggctgtaagctggagaaattgtagagttagtttgtgtttctcatctctcagggactactttcatttgttaccaccatgtccagtgtctagaaaatgttgtttcatgaggtctttttttttttttggttgttgcaggaaaatgggtagatctcatccctcttgcttcatgttagctgaaagcagacattccatactaaactaacagatttcatgtaacagagttaaaaaaaaaaatcattaatatgattccagatcccacattgtaaataacatttaacaacctaccacttgttcagtttggatgtaatatcaaagaagatccacaattatctaaaaccactttaaaaaatattcctccttgtcaaaaagtacatttgtggttctcagggactgagggaaacggggaatgggaagtgactgctaaggagtacagggattccttgtggagtaaatagaatgttataaaattagatgttggtgatggttgtagaactctgcagacagatttcatacatgtatttcaatcaaaatgatattttaaaaaaattgaatataaaagcagacatgagaatccagtagtcttcttctaagccagatagtaaagagatttctaaaaacgcaaagcaatacaagttttcttaaaaatattttgtttttagaaaaataccatcctatgatgccaagaacatattattctacatcttaacagacataccaatacagtaattaacaaaaataaaaattaacaaaaattgctagggggaaggtatgtaaatgcacattaaggttgttatttaattacacttcttacttagaagtttcaggcaagccagctgagagctccagaaacacagataagtagtaacctcgcacaactccatttccatcctaaaagaagaataatcagtttgagtgtaaaaaaattaagccacaataaaacaaaatgcagataatatctgatatctagattgagaagtacttctaagcctcaaagcaatggaagaaataattaaaaacaccaatagatttgagttcttaacaactttaaacttttgtgcattaaaaaaaaagtgaaactattaaggcacaaaaatgaagggaaatatcaacaaccacaacaaaggttaagagttttaacatatatagaactcttacaaatcaaccttaataaaaaaacaagaccctaatgggaaaaataatttcattagaaatgagtgaagcaaaaaaaaattttaaaccaaaaattaatttttaagaccaacatacaaaaaggtaataccctatgctgaaagtaattaaatataatttctatatgattttaatattagaattccatataagattctgtctagagattgagaagttgtttaaatctctactatagattttatttttataaagataattactccctccctttttgtttaatttggcaagactcttttaaaaaaagagaattacttcctatgtatttccctagtacttcaggtgtctatgttttaaaagaatcacatttattataactacttgtttaaacatctgttcccccaacgagacaatgaaggctgacaacagagatccttatacatctccagtgtctactgggatatgactacagagaggtacaagtactattaaccccttcatttttagtctactttgcttgaaaggacctgaggcaacttttgaggttcgacatgataatcactcagtagatatcaatgaataaatgactcatcagctaggtgaataaagccagacataaaagatgatatattattgtgtaatgccattatacaaaacttttctaaaaaaaaaaaaataatctgaaactacatattgaaagacttcaatgtgtaactgagaatactaacccaggagggctaaaatgtgtaatagtaaattactggactcaaaaagattatttagcatctaggcaatatcaccaaacatctttaaaggtaaagaaaattagtttattatcagacttttcctaaagaaaatggaattgcatattgaagatacccaatgaaagaaaatatgagccaaggattttatatccagcaatactagccttagaatataaaaggcaaaaactgttttcaacatatgagaactcagggaacattgtttccaataggccttccagcagaatgtattagagaacaaggtgtggacaaacaaacagttgtctaatatgggggaagaaggggaacagggaatgcggacagcatatgtaacaaaaaaaagaagagttaacagttctcagtaatcaaattagtatactacagaactctgaaagaaagaccttggtttcaaaatttattagaaatatgaaaaacttactgggtaaacttttaacctccagcaaagtcctgaaacttgaagaggtggactgtaaacaggatctgctctctgacgcaaagtgctaacgaaaaagaaaaccaaccaaatcccaagatcaaaactgttgtgaaatggcaacaggcaaaaagaaagaccaaccagtttctttgttacatacttgaaatcctagacaaataacaaggtgactgaacaggtcaaaattccactgtaaaagtttagatatgcttacatcctgaaataaagaaaatttaaagatactgaaatattcagcaatatcttttaagtttcaggggaaaaaaaaccctcaaaattgtgacatttaagggaaaaggaatgtatcaccaagtctcccaaaattaattaatgcttcaacaagcagtcttcaccattaaaaataaaacaaaacccagaatgtttcttcctcgcttctctgcagtataatcatcttttaatattgaagaacaagagtacactaaaccttaatacgtgtgggaaaaacctcaaagagactatgttttagccacaaaagtaaccctaagaaaagacaaattaaatgggaagagggataaattctgtgtggctttttttttttttgagatagagttttttcagacagagttttactcttgttgcccaggctggagcgcagtggcacgatctcagctcactgcaacctccacctcccggtttcaggcaattctcctgcctcagcctcccaagtagctgggattacaggcgcccaccaccacgcccagctaatttttgtatttttagtagagacggggtttaccatgttggccaggctggtcttgaactcctgacctcgatgatccacccgccttggcctcccaaagtgctgggattacaagcttaagccaccatgccctgcccagtgtggccttattttgatggcctttgcctattatttggagtttctctcctgaagaccttatagtccttgtttccacttccatgctgccctcaaagacaaattgctaagaacctttgcatgttacgatcttcacttctgatcttaagagaaaaagtagtaaaagctaacaaaattaacatacaactgacaaagcctacacatttcttacaataatggccccttatccacaattcttcactttgagctgagataaatggatctcaatggatttcttcccagcacttttatttctgaggataggtaagagggggctcatcaacctctaactgtccagccccccaccttagtcaaagctaagtgatctctcttatttaaaatggttcctcactttgggcagggcaccgtggctaatgcctataattccagcactttgggaggctgaggtgggagaattactggagcccaggagtttgagaccagcctaggaaacacagtgagaccccatctgtgtggtggcacacgcttgtagtcccagttacttgggaggctgaggtgggaggattgctgcagcccaggaggttgaggctgcagtgagcaatgatcacgccactgcactccagcctgggtgacagagcaaaacccagtctcaaaataaaaagaaaaggttccttttcccagactagagaagcagtcagtctaaagatacaatataatccagcacaaattatctctacatttctaataggaaacttattcttctaagacttctaaagtgagtgacacagttcactagattactgtcttaccaaagaatacctttctggctcttccttatatacacatacaaaaaaaccagaattgtcaaaaactcttacctgaaattctctaaaacaaaagtagctgaatcgtaagatggcactaattcactaaaaaaaaaaaggcaaaaaaaattatttagcttacatgtttaaaattccatttgcctaaaaaagccaagtccctcactagtatcttaaaaactttattaaactaaaatctaagaaatatttttaaatctttattgaacataacattaaatcaaatgaattcataaaaccatcaagtttgcaattaaattggagatacaaatactttataaaagttttttggctgggtgaggtggctcacccctataatcccagcactctgggaggccaaggtgggtggatcatctgaggtcgggagctcaagaccagcatggccaacatggtaaaaccccatctctgttaaaaatacacaaaaattacccagatgtggtggtgtgcacctgcaatcccagctacttgggaggctgaggcacgagaatcacttgaaccctagaggtggaggttgcggtgattcgagattgcactaccacacatctctattaaaaatacgcaaaaattacccaaatgtggtggtgtgcgcctgcaatcccagctacttgggaggctgaggcacgagaatcgcttgaaccccagatgcggaggttgcggtgaatcaagattgcactaccacactccagcgagggcgacagagccagactctgtctcagtcaaccaataaatcaataaataaatactttataaaagctttttttcctaaaagaaaaaaaggcaacacattatataattattaaactaagtacaagaaatacactttaaaaagtactcatggaaatgggaaaaagaaactgacgcttagggtgtgaatctgaattatgaaacagatataaaacatcctttaaaaaatgaaacaacagtcagtgataacacaattaatccccaaacttcctactctggaatggattatgggaaatattaacagacctcaaatactttgaaactatttactagcaaataaatctacacatttttataggatgaatacctcatcacctaaggggcaactgtgatggactagcacactcacactttcttggcaagtcaaaactacttcaagcaactttagtcccatccaatcttcttcagagagaactgtattataatcacagaatggactaaaagtcactttgctgctaactacctttaatcatgtggatggtttgtacactttcattagaacacctcaaaactcattaaaacactatactatgaaaaagactatcatacgatgttttaatagtgttataaatttgatatataaaattacaaatttcccaaaacaataaactgcaaaccatttcaccacatcttcagatatattttctaaagttcaattcatcataattttggttattatcaaaacaagataaaatatacatctatagcactgccacactatgatagtgtctaaagaaattagtggcttgcaatacaatatagacaaataattctttatttcaatgtaagtacgtatagctaaataggtcacgtcttttacacagtaagcagatgtactttgccctgtgattaactgtatagctactatccaaattgactatgtcaagaattcctatgatatccctagtcagttgttatccttcttagaagactcacattcctcatccccatatccttttgcctggttaacccttactatttcttcagataacagattagaagtcacatactcttggaggtttgctctaaggtcttcccattatatgatctcctagcactcaacatacacaaactccaattagcaggaccaatgcaattagtgcctaggaagcctttctggaaccataaacctagtaagagctctaagggagtcttcccagtatagccttcaaatttgacatgtttttgaaattttgtgcaactttcaatcaggtctctcatcaagtacagaatatcctccacaacatgcaaagactttaatcaatccccagttgcctgctaatctgcatattatttcttctgccatgtccagtgtaatttatttcctgtgttgttgttactgttatttctgctctaagtccagactatcattatcatattttattggccattaagggtcaaaagacttcagcagaacccaaattaaacaacaagagatgccattttcaactcagaatggtgaagtagaaagcttccaggctaaagagcataggttactaacactcatgaaccaagagagtacagtccagtttaccctagtctcacttgctaggagaaaatgaccacattcagagcacagaaaacaggtactgtgatatacttttacatatgtacattctcctagggaaaattttttggacacaaatagtataatgacaaattagtggtatggggcagcattaaacaggatacttacttcccctatcaccagttaccacattaattttattactgttccaataacctgtttttctaaatcataattataaacccaaagagctctgtattatgcttaatgctagcacttaacacatgcctaaaatatagctggcatatattcactgaatgaatgtttataaatacttgctggcagattcgtagagttggaaatatttgctcaaaaatttcttttgcgaaagaaattactttgctttttaaatttaaattttatttatttatttatttatttatttttttgagacgcagtctcgctctgtcacacaggctggagtgcagtggcgcgatctcggctcactgattttgcattctttatatgtatatacaaagctattgctactgctaggccatctaattccaccaccacatctccatattatgctcattcatttagagattatcttcaatcatactgatgttatcattctgtgtctgcagatgaggcactgctttatcttttcatagttttaaaattttctcctcctctcttagaagtgtagactgctctggttatgatgactggattcatctcatgatggtgtcagtgaatctttgtcttcacagaatatgggaaactaccctcaaaccatctctagcccaggaatctggaagtcactgatctgcaaatcttcagaccagtaacctcatcataacttcatcaacaaagggaaaaaagggagaaccacaagtatccatttgtttcttaaggaaataaactgctgagctatataaaaactggttctccttatcaacttgactatttctccctgaaacataaaactctctatgaactgacagctatactattgtatcttttattttttcttttctgcctcagcctccggagtagctgggattataggcatgcaccaccacacccggctaattttgtatttttagtagagatggggtttctccatgttggtcagactgctctggaactcctgacttcaggtgatccgcccgcctcggcctcccaaggtgctggggttacaggcatgagccaccgcgcccagcccacagtaaaatatttagttcctcttctcccatgcagcacctacaacaatactgggcacatagtctttaataaataacacttcactgatttagtgaccttttcttctccattgtggctccatcaccaattactaactgatagaactaaaggcaatagaaacaccactgctttgcatatctaaagtttcatgtgtaacttaatgtcacgaatgctgatctttcttatttggccctcttttcctgtatgttgcaactaataaaacaggtttctaataagaattaaattaaaagccaaagtttccaataaggtagtgagcattactggagaaagagagaaggccctgaaagtgattaattaacagactagcgagcattgttgcctgcctgatgagctgctgaaagtggtataagaatgggaatttacatacatcaatggttcccaaactttagtgcagtattattacttagagtgctcaagacgcatttctgaataccacctctaaagattctggggacattggcctgggaatttgcatttcagacaaatgccacacatagccctgacttaggtcatccatgcaccacactttgaattgaaaaatactaatttttatatatgacccttaggtcaaaatctgtttcattccacaggggatgaaatggttcagaaaacaaatcttcaaaactgaaatagctgaccacagtatcaatgaagcagcctagggattttggtgaacattcttcaaccaaatctacttaatgacagcaaatacatagtccttttaataatattcagtgctgtcattcagaaatgagatttaaacaaaaaagtcagtgctttaaaaagatatgaatattttatgaggttgttaatcaaaaagaaaggaagacttctactggtcaatgagaaccactggagttctagctgtcagaaaaactttgcccttctgtttataggactgtggcatctataacgagtaagaagggcttataacagtgattctcagtcaggggtgattttgtccccaaggacatttggcaatgtctggaaatatttttgtcacaactgcaaggtggtggggtggggagtgctactgggatactgctaaacatcttataaaacacaggaaagctcaccccaccccacaaataattattctgcttaaaatgtcaacaatgccaagattgaaaagccctggcttatatgatatactctagtacaatgaatgcggccaggcatggtggctcacacctataatcccagcactttgggaggtcgaggcaggcaaatcacttgaggtgaggagtttgagaccagcctggccaacatggagaaaccccgtctctactaaaaatacaaaacttagctgggcgtggtggtgcatgcctatattcccagctacccaggaggctgaggtgtgagaattgcttgaatccgggaggtggaggttgcagtgagccgagatcacgccactgcattccagcctgggtgacagagtgagatggagtataataataaataaataaaataataaattaaaaaaataaaaaataaaatagtacaatgaatgctctgtggtcatcagaggcatcacatattagaggaaaaagaaaaggcagctcaacatataaacatttttataacaaagactgttttctaaatgtgccacagccctcaccatggtaggaaaacttgatagtattccataagtcatctctctaagataaagtctgtcacaccaaaatgtttatctgaagcagtggcttcacccctcatcatagaataagctaaggagattttaaaagaacaaactgaaaatgtccatctgaaccctatgtcacaggctgaattgtgtctccccaaattcccatgttaaagccctaacccccaatgtgactgtatctatagccagggcctttaggaagataattaaggctaaatgagttgataatggtgggtctaatacaataaggcttgtgtcctcataaaaagagaaagagacaccagagactgatctctctccaagcaagaacagagaaaaggtcaggtgaagacacagaaagaaggcagctgtctgcaagctgaggcaaaaaagtgaattttctgacaccctgatcttggaattcttgtttctcgaactgtgagaaaatacatttctgttgtttaaaggcacccagtatatggtattttgttatagcagcccaagtagactaatacacacccaaagattttctttcaaatggcctggggtatggtatgacccagcactgattaattttcagccaaatcccaagtgattccaacatctagtcagaaaccaccagtctaacaccacagaatgattacaaacatgcttgaaggaatatgctgttcagaaaaattctaaggtttagcccaagatgaaaactaggatactttttgccataattatttcctctctctatcttttagtatccggagataacatggcgtcaccttcaaattcttttggcatttcatcagtttctgagttttgtgttaggagatatagttcaattcaaaaggtacactgatgaagctaatgtaatcaattatttttttctatactacggaagatggagctcttggaaaaaaaaatgatttctagttcattgtcattttctcttaagagtcaaaagtatcagtctgtgagacttttcaggagaactagatttgtatgtatacaacagagcttgccagaccactccattataaacaagaccttaaaaagctatggagtggccaagtgtggtggctcatgtctatgatccctagtaatttggggggtcaaggtgggaaaatcacttgagtccaggagtttgagaccagcctgggcaacaagtgagaccctatctataaaagaaaagagagagagagatggcattaaaaaaaaaaacattcttttgaaacaagtatatgcatttccacataaatttcaaatgaaaatgaaattaaaaactgtgtcatacctggtaaagtctggtggaacaggagtggtaacaaaagatgccatgggcttccgatgaacttgctgaaacatcataaggatctctgagctcttagatatcaactcactcttactacaagaccgcaactgtgtgaggaaaaaaattatctgaacaaacaaaattactattcactgccacctcaaaattcttaagaaattacaaattattctgattataaactgaaaaaaatgataaaaataactcaaagtgagcttgagaattaagaatgtacaaagaatctaggtttatttctataatattctaacagtaaagtcaatgaataagtatacttaatactaatgcatttttctctccttacattttaggataaatgaggttttaagcaagtacaaatatactttcaggctggtacagtgaagttcttatgaatgtattaatgaacaaaccggtaagttgaaagcttttttttttttttttttttgagacagagtcttgctctgttgcccaggctggagtgcaatggcgcgatctcggctcactgcaacctccgcctcctgggttcaagcgattctcctgcctcagcctcctgaatagctgggattacaggtgggtgccaccatacccaggtaatttttgtattttttagtagagacagggtttctccatgttggtcacactggtcttgaactcctgacctcatgatccacctgcctcggcctccccaagtgctgggattacatgcgtgagccaccgtgcccgaccaaggtgaaagcttttaaaagcaatttctcagattgtattctaggtgacagaatacaaaacgtacacacatacacccgtgtgtacacacacacacacgcactatctgatactaatttgggaaacactattttgggaaaaagtaacaaatctaacttcagtaacataaccatggtagataaaagataagactactaattttttcttcaaaaaaaccagtttgaagtaactcccaattctgccactgactaattacataactctgagtctgtttacatacaaaactaaaatagtaatatccaccactgcttacttcgtgaagtttgttataaggattatgaagctatagtgaaaaagctttgtaaactatctgttatgtgctgaattttgtgcccctttcctccataatttatatactgcaggctcaacctccagtacctcagtctatctggagataatctttaaagaggtgattatgttaaaatgaggccactggggtagggccttaatctaacatgactggtgtccttattaagaggaagagactctagggctgcacaaccacacagaaaagtccatgtgaggacacagtaagaaggcagtcatctacaggccaaggagagagacctcagaagaaacgaaacctgccaacacctgaatcttagacttccagcccctagaatactgagaaaacaaatttctattgtttaagtctcacagtcattggtattttgttatgacaggcctagcaagctaatatactatcaaatgccatatgaatgatattcataaacccacctacaggtgagtttatatcttttaaataacagttgcttaaggctcaccaaaaataacatatcatatggctgggcacaatagctcacacctgtaatcccaggactttgggaggctgaggcgggtggatcacttagggtgaggagttcaagacctcatgacctggctagttcaaggcctggccaacatggtgaaaccccatctctactaaaaatataacaattagctgggcgtggtggcacgtgcctgtagtcccagctactcaggaggctgaggcacaagaattgcttgaacccaggaggcggaggttacagtgagccaagatcacgccactgcactccagcgtgggcgacaaggcaagactctgtctcaaaaaaaaaaaaaagtatcatatatcatatgatatatatcaaagtttatagtcttgggttaccaagaataatgatatcatgtttgagctactgcatcaaccaatgacataatggtaagtggtaacagcagaaaacaacaaacagctgcatattttgtcattcatattattatgtgtcaggcattgcccaaggcattacggttttttgaacaatttatataaaatgatctaaagttatttgaactgtttgcttaagatttttaaggtatgctaaaaatcactgtgtatatgtacatacatacacacataatacaaaaaaatttaacttatattaattgaatgcttactgtgtatatccttccttgacaccatttcttccaaaagcaacttgctcccttcaacagaagtttattatcactatacatgtgtttccacaattactatgtgtgtacatacatccataaacaatgttctgaatgttttcaaactttacataaacactatcaggctatatcaccatgtagcctacatttttcagttaatattatttactttttttttttttgagacagggtctcgctctgtcgcccaggctggagtgcagtggcacgatctcggctcaccgcagcctctgcctcccgggttcaagcaattttcatgccttagcctcccgagtggctgggactccaagcatgtgccacctcgcccagctaagttttgtatttttagtagagacggggtttcaccatgttgcccaggctggtcttgaactcactcaagtgatctgcccaccttggcctctgaaagtactgagatcacaggcatgagccaccacgcccggcctatttctttacttttttaaacagatgggtcttgctatacttcccaggcgagcgccgtggctattcacaggtacaatcatagcacactgaagccttgaattcctgggctgaggcaatccttccacctcagcttcctgagtagctgggactacaggtgtacaccccatctcaatactgttttgttaaaaactaagacaatggcctaggcctacacatggtcaggatcatcaatatcaccaccttccacctccacatcttgtcccattgaaaggtcttcacgggtactagcacatatggatctacaatgctaacaatgccttcttctggaatatagtcaacgtttttttaaaaagtaggagtaaactctagaatatattctagaataatgaatggtatggtatagtaaatacataaaccagtaacacagttgtttattatgcttatcaagtattatataccatacataataatgtgttatatttttatacaactagcagtgcagtatgtgtgtttacactagcatcacaataaacacatgattaatgctttgtgctactacattacaatggctatgatgtcattagacatcactactaggcaacagaagtatttcagctccattttaatcttgtgggaccactgtcacatatgcagtctgtcattgaccaaaaggtcataatttgacacatgtttgtatatgggagatgtgtataggttatatgagaatactatgccattttatataagggacttgagtatctgcggattttggtatccattaaggtcctggggccaatgccctacagatatatatgtgtgtatgtaaaaagaaaaggaaaaaagaatggggataatgaagaaaaataagagtatttagtaaatatttatgtgctgaatcctacaagccaaattgtcaatcaagtacaaagataaaataaaaatattttcagacaatgcagtcaagaaaaatgtgttctgactacccttcctggaaagctactgagggaagtgtgatgttaaaacaaaacaagtaaaccaagaaagtggaaaccataggaatcaggaaacatgagattcaatacaagaaagatgtgaagggaattcccagaatgattaagataaaaatctcaggagacagctgtgtataaggcatagagagaaattacaaaaagcaaattccagacaagtgaatgtatcagatatttatgcaacactacatattttatttactcatttactatatgcttcatattcacccaccctaatctaaaatataaactctatgaggacagaattttaccattttgttcactgctgtatcaccaatatctacaatgatgcctgctatctatttaggacttaatatttcctcaataaataaaaatgctaaattttagagtaataatcgctacatgtaaagtaactggcaataatatctcaaagccaccacttaagtcacagtgtggggagattttaacctcttatacattcagatttctatggaaatagttctgttcttacaaagcagaatgtagttctaatgcagttcccaaacatgaagaaaaaacttggcaagaatcagctgattcctaatttcataaaaatctccattataacacaaaagatcaacagatcttttgatctcatacagataatctctgtcaaaaaaaaaacgtttataatatacagagaaggccgggcacggtggctcacgcctgtaatcccagcagcttgggaggctgaggcgggcagatcaccaggtcaggagatcgagaccatcccagctaacatggtgaaaccccgtctctactgaaaatacaaaaaaattagccgggcgtagtggtgggcgcctgtagtcccagctactcaggaggctgaggcaggagaatggtgtgaacccaggaggcggagtttacagtgagccgagatcgcgccactgcactccagcctgggcgacagagagagactccatctcaaaaaaaaaaaaaaaaaaaaacaactacagtatacagagaaaaaaggataaagactatttcattacatttaatatttcatcacctggtgctccacctcctgaagtaaggattccaaaagctctgtttcttgggttagagatgtcttctgacctgatgaaaaatagtgaatcatcaacacttgggttcattattggtttaagaatgaaattaacttccaatgaacatatttaataacaagaaatacacttcaagtaagcaaaaattcttcattacagctaccctaaaaattctcattcaactttaagaggctgaatattatagtagccttgaaaatggaacttcagaaccaattctaattagttttagacaagataccactgagatcaaattcatctaagaaacgaaatgtgcaatgacaatatactttaagcaaaaaatttacttttctagattttcatattcccttgggaagaagcaataacatgaatttcattcaatcagctattctgaaatcatttttcaccaaatttaactgtggcttaaaagagaatacaaagtgggccagatttttaggttaaatgtcagcaaaaggtctgtcctgtgaatatacaaggacctgtttaaaaaaaaaaatgcccacagaggtgaacagtctcaaaaagttggagacagaaaaggataaacaaattattactggccggggccatggctcatgcctgtaatcccagcactttgggaggccaaagcaagaggataacttgagcctaggtatttgagaccagcctaggcaacatggtgagacccagtctctacaaaaaagtaaaaaattagccaggagtggtggtgcatgcctgcagcccaatttactcaagaggctgaggcatgaggatcacttcagcccaagcggtcaaggctgcatgcagtcatgcaatgagccttgattgcaccactgcagtccttcctgggcaacagagtgagaccctgtctcaaattacaaacaaaaaaattataattacagaaattatccttatagaaaaggaagaaagtgctttatatgttttgaaacaaaaagaagataggtatgcttaccaaatcaggccattttctttgtaaacccaaaatttgaaaaactggaagtacatccatgaggacagcaaaagttttatcaatctgtagtgttatttgataaggaaaaacatttaataggtagaacttttatttattttatttatttattttttgagatggggtttcactcttgttgcccaggctagaatgcaatggcacgaactcagctcaccgcaacctttgcctcttgggttcaagtgattctcctgcctcagtctcctgagtagctgagattacaggcatgtgccaccatgcccggttaattttgtatttttagtagagatggggtttctccatgttggtcaggctggtctcaaactcccaacctcagatgatccacccgcctcggcctcccaaagtgctgggattacaggcatgagccaaggcgcccggcctttatttatttttatttatttttttgagacagggtctcattctgttgcccaggctggagtatagtggcgtgatctcggctcactgcaacctccacctctcaggctcaagcgatcctcccacctcagcctcctgagtagctgggactacaggaacacactatcacacctggctaatttttcttttttttttttttttggtagagatggggtttcaccacattgcccaggctgggcttaagagatccacctgcctcagcctagaacttttatttttgaaacaaaactcagaatttctaggttgcaaaaagagttaaaataaagtattagctagaatctaatattatcagacataatttctactataaccacatcccacaatcctaaaacattagcctatggacaacattacaatacataattaaacttaaaaatgagtggcagaggccgggggtggtggctcacgtctgtaatcctagcactttgggaggccaaggcagacagatcacaaggtcaggagtttgagaccagcctggccaatatggtaaaaccctgtctctactaaaaatacaaaaattagcagggcgtggtggcacgtgcctgtagtcccagctacttgggaggctgagatagaagaatctcttgaacctgggaagcagaggttgcagtgagccaagatcacgccactgcactccagcctgggcaacagaacgagactccatctcaaaaaaaaaaaaaaaaaaaaattagtggcagaggtcaggtgtggtggctcacgcctgttatcccagcacttcgggaggcggaggtgggtggatcacctgaggtcaggagctcaagactagcctggccaacatggcgaaaccccatctctactaaaaatacaaaaaattagctgggggtggtggcacgtgcctgtagtcccagctactcaggaggctgaggcaggagaattgcttgaacccaggaggcggagggtgcaatgagccgagatagtgccactgcactccagcctgaatgacagagcgagactccatctcaaataataataataataataataaattagtggcagatattatggtatgaattaaaaatctgaggcttataagactattctaaagataaactaaccctgaaaatatccttttccccacctcttatccttagaaagaatcctatttaatcataaaagctaccttggaaatcacaaattataatttttcataatgaaaaataatttgaaagccacaaaagcagggcaagttcagttattagaaagggaagttatttcacagttatacaggtagtaaaattaataaacttaagagatctgtactgtggtattatttgacttttagttgattcaattaaataaatgaagcaatgaacaaactcactcaagaaaaacaagaccacatgcaaatgtttatttggctacgactgaagatcacatcaacagtcaagatcccctcaattttaaagtcctaatacgtatcaacatccagtactctacatggcttaatgaacttaaagagatctcaaatattatctagagttctgaaaaactaagatcacctatatgtatgactgcaactgaggatctaagaacaattacgattttcatttacatgaaatatataagtggcattgtgaccagtacaatcaatacctacaggttttgtctaattgctccactgggtggatgaactgtgctttccaatctaactactagaagaatgattgtttaagactatttgctacttggtctgtgggaaaaaaactaaaaatcagatattaaatagtataggattataatagaaaagcaattcatgaaatgatatacaaatatacaaactcaaagatatttgcatctcatttttaaaaagttaaaaataaaatggataaaatcattattttggatgacacaaagacatggctaaaatcttggagaatcaagatagccaaaaaaaaaaaaaaaattctttgttcacaccttatttaaagtatatatatttcactttggactatgataaaaaatgcaaagctggtttttagtcagcaaaacactggaaggactaagatcaccaaaacaaatcaaacaaaacaaaccatagcattggattaaattcttacttaaaatttaagttcaataccaggctccacaatcaaagaagaatgaaggaatcttcgaaaagcaaaaaggtcagcaataaatataattaagcatatgtaaaatgaaccctactagaaatcaaaagctgagactttaaatctctaagaaaatgctggcaggggatgacgccgatgtttacaaatgtcagtttcttcatccccaatgaaaatggatggaaaggatatggaacattagtagaaggaattctgttagatttggagaaaaagctacctaacaatgatgcccactggccattaggattttcatccaaatggctatgaaaacttggattttcatccaaatggctatgaaaatttttctctcctatcatttctaaatacaagtctaacatttatctgtctaaattgtaacaacatggagttgcctaaaatctcaagattccttcctaggatgatcacccttattcttcaaagactgaatctcaaagaagctgaaagcaccaggtaccccagcagcatacataaacacttacccatcagtgttataagcttattcttcagctgtgtgtctaaccgtgcaatcatcatctccactgcattcctaatttcccgaacacgctcatcttttgcatttcttacagcttctacattcctttcctagaagataaagaggtaagaataattttaattgggtaaattttaaaaacagaagcaccacattataatattgccaagaatagataatatgaaaaaggtagttagaggaaggtcaaatggaaatgacccaacttgcttatatttcaaaatggcagacatgcaatcaaaaacacaaattttctgcataaagaatgttataaatgatcacttggttcttgattcctaaagaggtaaaacaaagaagacatctgcttttaatttaggatatggtccacaaacttcattttaagttaggaaatggtccataaacctcatttatgactgtcattctaacaacttgaaacaaaatgtattctaaaaacatgcttagtatttcattcttgggggcttatcacattttttcacagaaataacattataaatagctcactaaagctgtttgacctaaacaatatctaaacagtaatgttaaatattgcactttcaagtctgtggagttctaaatcaggacatcacaaatagttcattgcttagtaaaagaaactcacccaaaagctggggatccaaagagtgtataacttaatgaatgactgtaaaagtcaatactgattctgtttagaagtaaattattggggccaggcacagtggcttacacctgtaatcttagcactttgggaggccaaggcaggtggatcacgacgtcaggagtttgaaaccagcctggccaatatggtgaaaccctgtctctactaaaaatacaaaaattagctgggcgtggtggtgggcacctgtaatcccagctacttgggagggtgaggcaaaagaatcacttgagcccgggaggtggaggttgtagtgagctgagatcgcgccattacactccagcctgggcgacaagagtgaaactccatctcaaaaaaaagaaaaaataagttaattattgactctgtaacaaacagactttttaaattcactgattttctaattctgcataagtggtaattctctgactccaactgcttccttacaagccaggggctttgtatgcaaatttctcagatactctgaaatttatggaatttgactataggtacagcctatcaaatttgcaaatcttgaaaaccttgatttcaacatctgattaacttatattatataaatatattattatatattacagattaaaaacaaaataattatattttagtagtagtcttaccacttcttgaactaagctgatcagttccatgagacgccgacgaagtttggctacctcttcattcactttagtgacgtgttgctcataaatttctgccaaaggtttaaaggtatgtccgccatgctatttaaattagagtagctttagaacactttcacatatctcatctgcatttacattcctttgtaacactctatggacactaataaactggtaaatctctcaaatgaactttaccttattagctaatttaattttgttgaagcaggccagtgcccgcttaaaatcacttggtccaagtaggaactctttcaagattataaataaagggctttagcaaaatattcatttaactagaaattaacttattaaaaagaaccaagatctttaaccacagcccaaatcatctgccacaaccttatcagtcagtcactcttctctaaggcaaactagtcttcttccatgtcctcaaacttctttccaccaggactttacaaaaattactccctcttattaaaaaataattattagccaggggtggtggctcatgcctctaatcccagtactttgggacgctgaggagggcagatcacttgaactgaggaattcatgactggcctggccaacacggcaaaaacacgtctctactaaaatacaaaatgtagccacgcatgttggcgcacacctgtaatcccagctactcaagaggctgagacatgagaattgcttgaacccgggaggcagagcttacagtgagctgtgatcgggccactgtactccagcctgggtgacagagactctgtcccccccaaaaaataataattttttaataataaaaaccaaaaaaaaaaaaaaataaaaaaaaaaaaataataataataataataataatgctgggcatggtggctcacgcctgtaatcctagcactgtgggaggctgaggcgggtggatcacctgaggtcaggagttcgagaccagcctggccaacatggtgaaaccccatctctactaaaaaacacaaaaattagctgggcgtggtggcatgcgcctgtaatcccagctactcaggaggctgaggctggagaaccacttgaagccgggaggcggaggttggagtgagctgagatcaccccactgcactccagcctgggtgacagagtgagactctgtctcaaaaaaacaaaacaaaacaaataataataataattctccatcttccctctcccatcttggtttgtcttaatcctactcatcctttgcacttagctcagatttacaggatcagctgctatagttatgcatcctcatcagctctctgtatttattcctataatttatcaagccaattgagtatgtaattgtttgatatgttcatcaccaaatccctagtctttaccacagctgaatgaattagaaagacacttgaagaaaaagcccaggatacaaaattaacaaaagcaatgaacccattttccatcccacagagttactacagagacagaagactgatacaagttagcctcacaaatccagttgcattcagctcaaagaacaatttttatagctaactacctaaaaataattttgatttgtaaccagaattattaaattttaatataagaaacctcctataagttcttactagaattgtcttatttagccaaagtatcccattattgtctccaaaaaagatgtagatttttacatgttcactttaagtatagaaaaaaacatttctactgtctcttacaaaacctatgtatttaaagtattaaatgtgagaacttaattttttctagttagcacattaatattcaaattctagcagaaagctctgaattgagctctactcaaccaatctggcctgccactctctccgtaaaacatactgactgatgcccacagaatgatcaattcttatagcaactctagatacctacccacttccatttcacccataacttatttttcctaagaatctattgtgtttattctcaacctatttatgccaattgtacttattattgtaaggagatcatttaattaagtattcagaggctgggcgcggtggcttacccctgtaatcccagcactttgggaggccaagtcaggtggatcacctgaggtcagcagttcaagaccagcctgaccaacatggagaaaccccgtctctactaaaaatacaaaattagccaggcgtggtggtggcacatgcctgtaatcctagctactagggaggctgaggcaggagaatcacttgaacccgggaggcggaggttgcagtgagccgagatcccaccattgcactccagcctgggcaacaagagcgaaattctcaaaaaaaaaaaaaaagtattcagtaaacaacagaacacgactttaaaataaaaaagctgcttctaagaaagctaacttcaatgcttcaggctcaataatggtagactgtctttaaaaactgctcttgaattcaattggaaaaaataatctaaaaaataaaaaataattataagatctagataggcgtactcatgttgtttcacaagtgtctaagttcgtgctccattttaaaggaactaaaattggaaatgttggccagtacatctgatcaactgacctttaatgaaaaaagtgacctagatcctacaacgaaaagatctgcaaatgaatagaggatatgttttataggtgttacagattaaaatatttacataaggggtccatcaaaccacacaaacaagattcttctggaataaaagtacaatacctttaataaagcgtatagaaagcagatgcattttaactttcattctacgagagcataatgacactattttctatctgaataagtatttcagtgccttctagcctctaacttaaaaaaaatactgaatttgttctgctcaccattcctccccaaagtgcacactgatggcagatacacttcttacaagtccagcaaaatacactaagtttttcatggtgattttcacatctatacattatgaaaagaaaatgaagttataaattaaattggaacataatcacctccacaaattcttaagcttgggcaaacaggtcagttttaaatgattatatctcaagaaacacagtataaaatgtactccatggcttctgaaaaggaagctaaagaagtttatgcggacaattttttgtaaagtactgttttcattgatctggactttataatcacatgcgaaatacagatttgcttcttaaaaacataacacatattgcatcatttccacacagcactacagatgatatattctattgtactactacattttgggcatgtgcttaataatcatattgattatgcatctatacctacatgagcatgcacaagtacttttcctacatgtggtcaacgataacaataatcaagacacatgattaactgcacgatttaatactagaccctcatggaaaatgaacaactcaattttaaatgttcttttaaactggatattcacatgaaaaacaataaagttagactctgttatggattaactatgtcccccctcaaattcataggttaaagccttaacccccagtgtgaatgtatttgcagacagagcctttaaggaggtaattaaggttaagtaaggatcacaagggcaggacccaaatccaacaggactggtgtcctctataaagaggaggagacaccaggcatgcacgtgcacatagcaaagatcatgtgaggacagagctaggtggtggccatctataagtcaaggagaaagggaggcctcactagaaaccaacactgctagcatttaatcttggacttaacacctatcagaactgtgagaaaataaatttctattgtttaagctactcagttagcagtattgttatgaaagacctagcagactaatacagaccctcactttataccatatacacaaataaactacaggccgggtgcagcggtggctcatgcccgcaatcccagcactttaggaggccaaggcgggtggaacacttgaagccaggagtttgagactggcctggccaatatagtgaaactccttctctactagaaatacaaaaaattagctgggcgtggtggtgcactcctacaaccccagctactcagaaggctgaggcatgagaatcgcttgaacccgggaggcagaggttgcagtgagctgataatcacaccactgcactccagcctgtgcaacagagcaagactctgcctcaaaaaaaaaagaaaagaatgaaggtttaacatccagaatatataaataacacctgtaactcaacaaataaactttaaaaactctaatttaaaaatgagcaaaagatctccagtaagcatatgaaaagatgctcattactactaatcactagagaaatgtgaatcctaacctcataccatattaggatggttgctatcaaaaaaacaaaaaagagcaagtgttggccaggatgtggagaaactggaacccttgtgcactactggtgggactgtaaaatggtacagtcactatggaaaacagtatggagattcctcaaaaacttaaattaaaaatagaattaccacatgatctagcaattctacttctgattacataaccaaaagaactgaaagcagagtctcaaagacatgaacatccatagtcatagcagcattattcactacagccaaaaggtggaagcgacaccaattttcactgagagatgaatggacaaaaaaaatgtgacatatacatacaatataatattattaacccttaaaaaggtgggaaattctgacacatggatgaaccttgaggacattatgctaagtaaaataaaccagttacaaaaagagaggtactgtatggttccacttatatgcagtatctagagtactcaaacagatagaaacagaaagtacaatggtggctgccaggggctggtgcgaagaaggaatggggagttgtttaatgggtacagtttcagatttgcaagtttaaaaagttctggagattggctgaacatgtgaacatgcttaacataactgaactgtacattaaaaaatgattaagatggtaaattttatgtatattttaccataattaaaatgttttaagtattctcttgtttataaagtagacatactcttgcaatttttttttttttttttgagacggagtctagctctgtcatccaggctggaatgaagtggcgcgatcttggcccactacaacctccaccttctaggttcaagcaattcttgctgcctcagcctcccaagtagctgggattacaggcacatgccaccacgcccagctaatttttgtatttttaatacagacagggtttcaccatgttggccaggctggtctcgaactcctgaccttaggtgatccacccaccccggcctcccaaagtgctgggattacaagcatgagccactgtgcctggcccactcttgcatttttcaaaaagcatttcattgatgaaggacactgagcttagagaaaatacttacataagtttatattttatatttctaattcataagtaatcagaatataaaatgggaaatgaataagagttagaatacatcaggtactgtttggaagctcatttagcaagacttccaaaagaccaaatttataatatagcttttacaatatagaaaatttgccaaaactcctcttaattaacagcctgtattcacttgcagcaaggggaggccagtaggcatcaaacagcaagtaagaaagactagcaggttagcaaattgtagcagtctattccttttgagaggctctaatagaagaggcccaaaaagaggtaaaaggtctttccaaacagtaatacccaccacttcagaggaaaaacacctaagtgttcaccaaagaaatgtgccattgtatagaaaagaaattaaataattatttttggtgagacctctacaatgctacaagtgacagaattccttaaaagtccagttaaacttgaatagcaggtttttggttttgtttttgtttttttgggagatggagtctcgctcgttacccaggctggaatgcaatggcacgatctcggctcactgcaacttacgcctcctgggctcaagcgattctcctgcctcagccccccaagtagctgggattataggcgtccaccacgacgcccagctaatttttgtatttttagtagagacagggttctccatgttggccaggctggtcttgaactcctgacctcaggtaatccacccacctcggcttcccaaagtgctgagattataggcatgagccaccacacccgcccgaatagtaggttttaattctgattatgcattaatgtgttatactaccataattaagcctctttctttttttttttttttttctttttttaagagatgggttcttgctatgttacctaagccatcctctgggctcaagagatcctcctgcctgagcctcccaagtatctgggactacagatgcacaccaccacaccctgttctcttatttctatggttctatttcctcagtataatgaagaaacagataaatttttttctaatgacctgtgaggtttcaacctcttgctttaccatgttgtgactctacagaaagtgacaaggctttatttctaaacattcaggggtcctggaatctcacctaattcaagttattttattattgctggacagtgaagccttacaattaaccatgttgtagcttcttcatctataaaaaccaatcactgccacatcactctttcctttctttacctgctccccataacaactctccagatatgttcaaaattcttcaatcatggaacataagaccatttattcattcttgtcccttaaatgacttaacactgtattatcactgtgtccccattaaacagttaacagaaatcatgtctcatttacctttgtatgcctatcatctagcaaagtactttctgtgtggggggaggggagggcgagaggtatctgtgtatacatggcatgaaataactgttgttaaataaacacaataagaatatgttacttaacagtaacagcgcatgactgaaagaattaaaaacaagaaatataacactacttattcataaataactaaaaggcaactaccaatatagtgtcattaaacaatacaaaggcaaaatccattcaatattgaacaaagaaattgaggacatacttgtccttttcattttcttcatgtttggtgagactgcagagttgaagagtatcaagctgttgtgttacttcttctgcccaacgacaatttactagttctcgtagctggagtggagcactggggagaaaatccatacacatacactaattcaggaatttgagattattttataaaataaatacgtttctcaaaatagagagcacaataatactcataccataacactattttttttttttaagagatgagtctcactctatgacccagggtggaatgcagcggcatgcatgatcatggttcactgtagccttgacctcctaggctcaagcgatcctcctgcctcagcctcctgagtggctgggactacagcagcacaccatcaaacccagctaattttaaaattttttgtagagacgggaatcttgctatatttcccaggctggtcttgaactcctggcctccagtgatcctcccaaagtactaggattacaggtatgagccactacctggccccataatactattaaaactaaaaaaataaaaaataaaaaaaaagacaatgaaaaatattatctgtgacttattttcaccacattaacacgtcatttatgaaaagaaacaaaaagctaaacaaaaacatatgattcagaatatggactgaattctcaacttctgagtctaaagctgtactgttggcgtagtggctcgcgcctgtaatcccagcactttgggaggctgaggcaggtagattgcttgagcccaggtgttcgagaccagcctgggcaacatgatgaaaccctgtctctataaaaaattagccaagtgcaatggcatgtgcctacagtcccagctacccatgaagctgaggtaggaggaccacatgagccagggagattgaggctgcagtgagccaagatcatgcctctgcactccagcctggggaacagagtgagagcctgtctcaaaaacaaaacaaaacaaaacacaaatccacagctgtgctgtccaaaacgatagccactagccacatgtgactcttttaagttaaaattaaataaaaataaaattttggccaggtgcagtggctcacacctgtaatcccagcagtttgggaggccacagcgggtggatcacaaggtcaggagatcaagaccatcctggccaacatggtgaaacgctgtctctactaaaaatacaaaaattagctgggcgtggtggcacgtgcctgtaatcccagctacttgggaggatgaggcaggagaatcacttgaaccagggagtcagaggttgcagtgagccaagattgcgccactgcaccccagcctggcgaaagagtgagactccatctcaaaaataaataaataagtaaaatttcatcatatagccacactagacacatttcaagtgatcgacagccacacacaactagtggctaccatactggacagtgtagacatagaacactttcatcattataaaaagttctacttgataatgctggtcttataagataatgtaagaaaggtgggacgaggcacagtggttcacgctgcaatcctagcacttcgggaggtcaaggtggtaggatcccttgagcccaggaagtcgagaccagtttggccaacacagtgacatctcatctctacaaaaaataaacaaaattagctggcatggtagcacacaccagtggtcccagttaggaaggaggttgaggtaggaggatcacctgagcccaggaggtcgaggctgcagtgagctgaaatcacgccattgcactccggcctggacgacagagcgagactctgtctcaaaaaaataaaaagaaaagtgaatacaaaaagaaaaatggttaacagatggcactccagcattattttttgaaaccaaaagtagagataacctaaatgtctctcaatatgggcataaataaatcaaggtatagtcataaaactgattatcagtcacttttttaaaaaatgacttatgtatacatacaatcaagaaaagatatctaccatattttacatgaaaaagcaaactgcaaaacaatattatatcattggtacattttaagaaaaagcatatgggaatcacatacgcatatatatatataaatataggcacaatcatactggattagggcattacaaaatacatgcacaaaaaacagtctagaagaatagataccaaacccaacaatttcttctgaaagtattattaagtgagaagacagggtagggagtatcagaatcagaaggctttttattttattttatatttatctctaccatctggatttttttgtttgttttttgtttttatttttttgagacagactctcgctctgtggcccaggctggagtgcagtggcgtgaccttggctcaagtgcagcagtacgatctcagctcactccaacctccacctcctaggttcaagcaattctcatgcttcagcctcctgagtagctgggactatagtcgcgcgccaccacgcccagctaatttttgtatttttagtagagacaaggtttcactatgttggccaggctggtgtcgaattcccgacctcaggtgatccagccgccttggcctcccaaagtgctgggattacaggtatgagcgagccactgtgcccggccaagctatctggatttttttaaccagaaaacattaaaattttttgcttaattataaaagataaattatgccctaactatctggattttttaaccagaaacattaaaaatttgttgcttaattataaaaggtaaattaagaagttatacaatgattttctgagaggcagagtacaacatagtaaacgtaattttaagtcacatgaattagtccctgcatttctttttctagtcaaattgcttatttctactcaactatcttcacgaagaagagaaatgggcagactgcaggaaaactgcctttatgaatcccaaggcacattctgatcttactattttcaaaattcacaaataatcgtaaggaaacacttaccggcaatgaggacattgagctctctgctctgtcagccagcgctaagggggcaaaagattagatatcgattagaaaacatcattactatatatatatattacttaatattttatatttatatataatatatataatattcttaatatatataatatataaatatataatattcataatatataatatataatatattattatataacatatcatatatatataatgtataatgtataataatgtataatatattatacattatatatataatatatataatgtataatatattatacattatatatataatatatatataatgtataataatgtataatatattatataatatttatatatataaaatactacaaatctaatgggtttaactctctagtgcttagttttagagatacttataaaagtaacaggcaatctactgtttccctcactgtcatcctcatagggataaacttttgaagggacaaaactcaacacaaaatagctgttaaaaggctactctcacacaggaaaagcaatgatttcaggactaactgattctcacagggaacgtctatataatcttattattgtcttataataatggcactgtctcctttgcactcaaaaataaaccacagtgatgatttatttctatctagtttactactaaatttattttttgaaaagctaattcgaaaaaaaaaaggaagctaattctgagttacatacattatagacatgtaaattaaaccgaaaaaaatgaataagcaatacagcacaacttttaagtcttaaaacagtttcacagggctgggcacggtgtctcacgcctgtaatcccagcaatttgggaggccaaggtgggcagatcacctgaggtcagctgatggagaccagcctggccaacatggtgaaaccccgtctctactaaaaacacaaaaattagccaggcatggtgatggtggcaggcgcccataatcccagctactcgggaggctgaggcaggagaattgcttgaaccaaggaggcagaggttgcagtgagccgagatcctgccactgcactctagcctgggcaacagagcaagactctgtctcaaaaaaaaaaaaacaaaaaaaacggtttcatagttcagtaattgaagcttctagatatcttggtttcctcataattataaaaaggttttagaagagaataatgtctctactaaaccaaaaattatattaataatttattaggaaactgagagcaatgttataccacatataaaggagatgttaagattttctgactagttttcaggaaacaacaggtttataataaaaaaaactttatgttttaattgtctgataaataggttcagaggtaaataactatgatcctacaccaacgtactcccaatatctgttatttgtttatctctttctactttttaaaatgaacatgagctttaacttgatgccaaataattaacttagaaataaaattcccaaggaaaccttaaaggacagtaaaagacttaaaatgatagcaagcaaggtacttcagagcaaagaaaataaagctgaaagaaaaagcatacagagcacgcctgtaatcccagcactttgggaggctgaggcgggtggatcacgaggtcaggagttcgagaccagcctggccaacatagtgaaatcccgtctctactaaaaatacaaattgagccaggtgtggtggcatgagcatgtagtcccagctactcaggaggctgaggcaggagaactgcttgaacccaggaggtggaggctgcagggagccgagacagcgccacggcactacagcctgtgtaacagagcatgattctgtctcaaaaaataaaataaaaataaaataaaaagcctatggaaaaggattcctccattcttaataaccttgaacattattattaccttggtccctaggcaaaaacgaaatttgggtcaggtttcttcccctgaaacaatggcatgaccatgccactcttctgttaaagtcacagctcctctccagaactggtctcatgaactcctctccagaactggccctataacccagcaaggtaatgtctttacatgtttcctctctctgcctaagatattcttcaaaacctttcttcatctgggttactcctactcattgtttagatttcagttcataagttgctttctccaaaaagctttccctgacactctgcagactattttagatacaattgccatgctctaccacagcaacctacacttcccccttcagatactttattacgacgacttatttgttggtctcctttgccctgctagactataaaacttataaagactgggactatgatagggagtaaccagatcgtattttaaatgtctccctccctcccagtcaaaacaggcttactgctgcactatataacactgtcgatatatctgtgcatttgcttatatggtccctccctccatatcccgtctcatagaaatgtcactggatcatgtccataaaatttcctgcctttcccaggctatagtgagttttacattctctgaatatttgtggtatttttatcttgtattccacaatctaatttatttatttattttttgagacagagtctcactccctcccccaggcttgagtgcagtggtgcaatctcaactcactgcaacctctgcctcccgggttcaagcaattctcatgcctcagcctctcaagcagctgggattacaggcatgcgacgccacacccagatggttttcgtatttttattagagatggggttttcccacgttggccaggctagtctccaactctgacctcaagtgatctgcccgcctgggcctcccaaagtgctgggattacaggcatacaggcatgaaattgctcagcctccacaatctaatttaattacaaaataaatatgacaatgttaatactttgagaaaagcaatgtttctctcaaaccaaaaccaaagaaccagtggtacaatattaatgcataatattaaacaaatatctttagagcattccccctcattcaattaaaaaatcataaacataaaataaaattaaaattaaaaattattttctctccttcattaaactggaagaatcacaagctttagaaagtattcagatctgtgtctgattcccagctctggcacttatggaccacatgacattggacaagtgactgagctcgtctcctcatatgcaacaagagaatcaacatatctaccctgcaaaaccgctctaagggttagagagaagctgttagcaatatatactaagtatctaagataatcttaaaaaaaaaacaaactggctgctaacatttatagttcaattactactggatgtgaggaaaaaggaagattaaggtgagctaggtttttggataaaaaactgggttcctgactggaaaagaaacagatttggcatggtgaaaaacaaaaacaaaaacaaaaacaaaacaaaaaaaaacctcttatagagacgatatatttcagatgcatactacaagtccaaatgaaggtagttagatactggaggcagagaaaaggccaggactgaaaagataaagttgggaagtttaagtctagaggtagtgttaaaagtcatggaccagtcgggtgtggtggctcacacctttaatcccagcactttggcaggccaaggtgggaggattgcttaaggccaggagctccagatcagcctgggtcacatagcaagataccatctctacaataaatttaaaaattagccgggcatggtggacacgcctgtagtcccagctactcctcaggaggctgaggtgggaggatcaactgagtccagaggtcagggctgcagtgagccatgatcatgccactgtctctagcctggatgacagagcaagactcggtctcttaaaaaaaaaaaatccatagaccatgaagttactaggaagatggtatagctattatggcaaagataccaaagataacgtttcaagaaaaacagatgaagtaatttatgctgaatgctccgagaaggaaagataaggccaacaaaaggttcattggatttagcaaaactgagtctacactttgcaggagctatgtgagtagtgtggagggagctaaagccaagttagaatgggttgaagggtaagtagatggcaaggttgcagggaaatggagtggaaaacactcttttaaatacttttagctataagagaaaacaggcagtaaataggaaatttgttaacaaaggacttttattcccaaacagctcaaaattgcaaggaaactaggaggccgatcatagaggatcttagatgccttgtgaaagcatacaaaatttcttacatcccctaatgtactgtttgaggcaaactatatatacatacaaaaacatgctaaatactttctggggttgtttttgtttttgagacaagtctcactctgtcactcaggcaggagagcagtggcccaaacacagctcactgcagcctcaacctcttcatctcaagaggtcctcccacctgaccctctgaagtagctgaggctacaggtgtgcccaccacatccagctaattttttaattttttttgcagagatgggatcttgccatgttgctcagcctggtcttgaagtcctgggctcaaacaatcctccatctttgggcctcccaacgtgctgggactacaggcatgagccactgtgcccagactaaaatagtttcttacaaacatctataccactaaactataacaaaagtccacttcttatggtatgtctaccaaagaaagggaaaagctgtccttttgttcatttccaaaaacctgtaagaatgagtaattatcataaagattgtatatattaattatctagcatacagaactaaataagccagatggtaaataaaattactgttagtgtaacaggagaccaaaaaaagagagtttaaaaaaaaaacatcagccgggcacagtggctcacgcctgtaatctcaatactttgggaggccgaggtgggtggatcacctggagtcaggagttcgagaccagcctggccaacatggtgaaaccccgcctctactaaaaatataaaaattagccaggcatggtggtgggtgcctgtaatcccagctactcgggaggctgaggcaggagaatcgcttgaacccaggaggcagaggttgcaatgagccaagatcgtgccactgcactacagcctgggtgacagtgagactctgtctcaaaaaaaaaaaaacaaaaaaaaaaaaaccaactttgtaacagaaaacaaggtctttaagaaacattaattacagcaattattaaaaatcttagatcatgggctcatgattgattaaatactatttccaatgcctaatcctgcatttgaaattaattaaaaatataagtatttattaaattccttccatttcttcagaatataatcagagatatcattattgacatgtactgtgcatcctcattcataatgctatatgaaaaattttaatgtatatgtggtctgggagtttaagatatttactagagaaattgtgctagggaaatcctcaacaaaatcccaataaaactaattcaacagactatttaaaaaattatacactgtggccaagtgggatttattcctagaatagaaagatgattcaactacaaaaatcattcaatgtaataaaccacttcatggaaaacccccactatgatcatctcaattgatgcagaaaaggcatctgacaaaatccaatatcctttcatgataaaaatactcaatagaaatagaagggaacttcctcaacttgataaaggccatatataaaaactcataaaaatcatagtcaacgattcaaaggctaaaaactcttccccttaagatcaggaaaaattccccttaagatcaggaaaaagacaaggatgccagcttttaccatttctatttgacataatacaggtactaaaaattccagccagagtacttaggcaagataaagaaataaaaagtatcctaattaaaaaagaagtgaaattatctttttgcagatgacatgatcttatctgtaaaaatccctaaagagtccacaaaatattgttaaagctaataaacacaacagttacaggagacaaacacacaaaaaacactggcatttctataagcttgcaatgaacaatctaaaaacgaaattaagaaaataacacatttgcaacagcatcaaaaggaataaaatgcttagggaaaaaaaaaaccaagaatttgaaagacatacatggaggctgagtgtggtggctcacacctataatcccagcattgggaggccaagacaagagggtctcttgaacccaggaagttgaggctgcagtgagccatgatcgcatcactgcactccagcctgggtgacagtgagatcctgtctcaaaacaataaaaaacaaaaagaaagacttatacgtgcaaaactacaatacactgctcaaagaagttaaagaagtcctaaataaatggaaagacacccatgttcaaggatcataagatttaatattgttaagacagcaatattactcaaaggcatgtacagaatcaatgtaatccctactaaaactccaatggtactttttatattggtagaaaactgcatttaaaattcacatggaatctcaagggatgccaaatagtcaaaactatcttgaaaaagttggaggactcacacttcctaatttcaaaacttactacaaagctacagtaatcaaaacagtgtggtactaccataagaacagaaatagagactaatagaacagaatagagaggtagaaataaacaaaaatattttatgattccatttatatgatgtacttagaatagtcaatgtaaagacagaaggtagaatagtggttaacaggggctagggggaagagaataatgagaatttattgtttatcaagtacagagtttcagtttgggatgatgaaaaagtactaaaggtggatagtggtgatggctgcacaacaatgtgaatgtacttaatgccgctaaacagtacacttaaaaatacagttaaaattgcaaatttggctgggccaagtggctcacatctgtaatcctagcacttgggaggccaaggcaggcagatcacttgagcccaggagtttgaggccagctttggcaacaaagtaaaaccctgtctctacaaaaaataaaaaaattagccaggcacgatggcacacacttgtggtcccagctactcaagagtgtgaagcaggccaactgcttgagcccaagagattgaggctgcagtgagccatgattgtgtcactgtgctccaacgtgggcaacagagtgagacactgtctcatttaaaaaaaaaaaaaaaaaaaggctaattttacattaggtatattttaccacaattaaaaaaaaattaacagaataccatatgacccagcaatttcacttctagatatatattcaaaagaaatgaaagcaggaactcaaacagataattgttaacaacagaactattaacaatatccaatatccaaaaagtgaaaacaacccaagtgtccatcaagagataaaaatggataaataggctaggcgcggtggctcaacgcctgtaatcccagcactttgggaggccaaggagggtggatcaccaggtcaagagatcgacaccatcctggccaacatggtgaaaccccatctctactaaaaatacaaaaattagctgggtgtactggcgcacacctgtagtcccagctactcgggaggctgaggcagcagactcgcttgaacctcggaggtggagggtgtggtgagccgagatcgcacgattgcactccagcctggcgacagagcgaggctctgtctcaaaaaacaaaaaaacttaagaaaaaggataaacaaaaagtggtatatagccatgtgtcacataaagatgtttcggtaaatgatggaccgcatatactacagtagtctcgtaagattagaatggagctgccctacataggtgtaccattttttatcttttatactgtatttttaatataccttttctatgtttacttatgtttattttcttttttctttttttttaatgggtacagactttctgtttggggtgatgaaagattttggaaatagtgatatggttgtataacattatgaatgtaattaaagacaccgaactgtacccttaaatatgggtaaaatggaaaattttgttatatttattttagcacaaaatggggggcactgaacagaccccttaccaaagacaacatatggatggtaaataactcctggaaaagatgctaacatcattactcaacagagaaacgctaactaaaacaaggagatacctgtaagaatggctacacgtccctgagaatggctaaaattcacaaaaccgaacacaccaactgttagcattaatgtggaggaattggaactctcataaacttctggtgagaatgtaaaattataaaactatttccttttttttctttttgagacagagtttcgctcttgttgcccaggctggagtgcaatggtgcgatctcggctcaccacaacctccgccttctggattcaagtgattctcctgcctcaggctcccaaggagctgggattacagacatgtaccaccaggcctggctaattttgtatttttggtagagacagagttctccatgttggtcaagctggtctcgaactcccgaattcaggtgatccatccacttcggcctcccaatcctttttttaatttaaccttcatccctctcctcctctccctcttttgaagtccccagtgtctagcatttccccctttatgtccatgtatgctcattgtttagctcccagatacaagtattttagaaaatagcttggcaattttcaaaatgttaaacacacatctaccacataatctctatccgttccattactaattatttacccaagagaaaagaaagcttcttgtacacgaatgttcgcagcaattttcactgtaatagcaaaaactgtaaacatgccatatgcccatcaacaggtgaatgcataaacaaattgtggtaaatacatacaatggaatactacttagcaataaaaaggaatactactgatacatacagtatttttgctgagtgaaaaaaagccagatccgtaagagtacatattgtatgattttcatttgtataaaattccaaaacatgcaaacttatcttttttctctttttccatcccccttatctctgaagcaaacttatctatcgtgacagaaagcagatcaatggttgcctggggacaaggcaagtagagggaggaattaccaagaggcacaaggaaacttttggggatgacagatatattcactaacttggatgcaatgattgtctcacaagaatacatatatgtcaaaactgtacacttggccaggctcagtgactcacatctgtaatcctagcactttgggaggctgaggtgggtggatcacctgaggtcaggagtttgagaccaacctgaccaacatggtgaaaccctgtttctactaaaaatacaaaattagtcaagcgtggtgatgcatgcctataatcccagctacttgggaggctgaggcaggagaatcactcgaacccaggagatggaggttgcagtgagcggagatcgcgtcattgcactccaggctgggcaacaagagcaaaacgccgtctcaaaaaaaaaaaaaaaagaacaaaacaaacaaaaaaactgtacactttaaatatgtgtagtttactgcatgtcagttatacctaataaaaaatgactggcttgaaaacaagtaggcaagcaatcaatatttgctgaatgaatgaacaaatgattagtgcattcaggaaccaagacagccctagaaagaaaggtcagaaccagatctggatggtctgaacacaaggctaacattcttggattttatcctttacataatacatttctgaggcttctggggaaaagaaagagatatcagtgaaaaatattaatatagtagcaggacagaaaatggactggagataagaaaagactcaaacctgagagatcagacagaaagtaattaaataatctaagcatgaggtaaccaatgttcatacttctctattagcatggtaatgataaaaacagaagggtaagacaaatataagtgaaacagggagataataactaattgcacttaaaaatcattggtataggccagaggcagcggctcatgcctgtaatcccagcactttgggaggccaaggagggaagatcagttgaggtcaggagtttgagaccagcctgggcaacatagtgaaaccccatctctacaaaaaaaaaaaaaaaaaaaaaaatatatatatatatatatacacacacacacacacacacacacacatatatacatatacatgtttatatatatacatatatacacacacatatatacatatatatatacaaaaatagccgggcatcatggagtgcgctgatactcccagcaacttgagaggctgaggcaggaaaatctcttgaacctgggaggcggaggtcgtagtgacccaagatcacgccactgcactttagcctgggcaacagagcaagaatccatctcaaaaaaaaataaaaaataaaaaataaaaaaatcattggtataaagtttccagtttgagtgactagcagaacagaacaaaaagaatgaacttagaatcggtttgagaaaataatatgaataatctgatcttgaacaaagttcaagatgctagaaggacaagacatccaaaagtcagtgctgaaggaatagatttaggagccatacacacagagatgatagctaaagctgctaaagtaaatcaaatttcccaaagtaggtgaatactcccagaaacctcagagtagagaacgacagcaacaagatcttaggaaattaagaaataaatgcatttaaggggcaggaggaagaagatgtaacaatgaaaaaatacagaatcaatgaggcataaggtaacaaccagagaccataagcacatgggaccttcatcaaaagaaatgcgcccagatccagattctaccacttaattaactataacggagtccaattacttaatttatctagcatcagtttcactgtttattaaaacatgggtaagtgttaatgtgtattagttgctattttaacaataaaataacaccttacaaacaagtagatatagtatttcataatttctgaattactccttaggttatctcatttaatgccataaccaccctgtaaagcaaatcatatctgaattctacagctgaagaaagaaggccaagaaagagtgaatctcttagttttagaagtatgagaactaacatcatatttaactgggtcttctgcgcatggtacagtgacaaagaacaggctatagagttcttgaacttaatgggttcaaatccagtaccatcaattgtgagctgtgtgactagaaaaaaattatttaagtgttacggataatactcttgacaaaggcatatgtatcttccttaggcaagaataaggaaacagaaattttttttttttttgagacgaagtctcgctctgtcgccaggctggagtgcagtggcaccatctctgctcactgcaacctctgcctcccgggttcaagtgattctcctgtctcagcctctcgagtagctgggactacaggagcatgccaccatgcctggctaatttttgtatttttagcagagacagggtttcaccatattggtcaggatggtctcgaactcctgacctcaggtgatccacacacctcagcctcccaaaatgccgggattacaggcgtgagctacctactgcgcccagctgaaacagaaagtttgaggtgaagagcatgtgacctctttgattttctcaggaaaataaataattgaaggggaatgtgaacaaggcagttttcaactatgctctgtagatgtgctattggactctcgcatacacaaccaaaatcttggacttcctcattttgttattttgttttttgtttttttgagacagagtctcgctctgtcacccaggctggagtgcactggcatgatctcggctcactgcaacctccgcctcctgggttcaagcgattctcctgcctcagcctcctgagtagctgggattacaggcacacaccaccatgcccagctaatttttgtatttttagtagagatggggtttcaccatgttggtcaggctgttctcgaactcctgacaccatgatccacccgcctcggcctcccaaagtgctgggattacaggcctgggccaccgcgctcaggccaacattcaagttttttttttttttttgagacggagtctcactctgtcgccaggctggagtgcagtggcgctctctcggctcactgcaacctctgccctcccgggttcaaacaattctcctgcctcagcctcccaagtagctgggacacaggtacatgccaccatgcccagctaatttttgtatttttagtagagacagggtttcaccatgttggccaggatggtctcgatctcttgacctcgtgatccacctacctcggcctcccaaagcaccaacactcaagttttaaagccactagattatattcatctctagagtgtcttgtaattgtaagattaaacactttttctctatcttactcaccaaacacatataaaccagtcctcttctgagccccacagcacttctttagtgcctccttatgataccgcacattcttcaaaataaacattctaaactccattccctcaattagatttaagctccttcaaggcaggcaatttgtcatttatcttagtattcctcaaccccaagcacagtgcaagcaagcactttagggcaaaaaatgtaaaataaaaagataagggaaatggttaatccttacaatatatactatatatactaactgcatgtaaaaagaaatacaacttaccctaatacagctgaaacaacacagtttggagcaatgaggacacaggcgtgcatcccgcaatttctccatacaaatgaaacatcggaaaacctcagcaatgctctgaaaacagtaaaagatgtaaggtccaccagtttaggctactgaatcaagagtaaaaggcaagctcaaaacaacttgacatttacatttattttgggctgatctctcaattttaactattccatatcaggatttggttggtcaagatacagagtacctcaaaacatctggaaaatgtactcccgtttggtttcacgatgattctattctaaggaaaatataggaaatgcaaacacagacatgcagaaaaattttcactaaagcagtaattataatggcaagaatctaggtacagcccaaatgtccaaatattaagtaaattatggcagttacacatagattacagtcaccagaaatacttcttcatctaatgatatagaaaaatgcatataatgtataacagcagggaaaaaaggcccaggcatgatggttcattactgtaatcctagcactttgggaggctgaggcaggtggatcactcgaggtcgggagttcgagaccaacctggccaaaatggttaaaccccgtctctactaaaaatacaaaaattagccaggcgtggtggtgtgcacctgtaatcccagctacacaggaggctaaggcagaagaattgcttgaacctaggaggcggaggttgcagtgagccaagagggtgccactgcactctagcctgggtgacagagtgagattctgtctcaaaaaaaaaaaaaaagaaaaaaggaaaaaaggcagactatatgactgaatacacaacatgaacttttaactttttctgcaatttccccaaaaggtataaactgattttataatttagaggaaaaagaagtttaaaaagacacatcctaaaggcagtgtactgtgacccagaaaaaaatgaattcagaatccagaaatctgaattgctgccctgatgttacaacagactagctacttatttgaacctgagattctgccccaattgaaaatgttgacggtagttcaaagcgatcttgggaacaacaacaacaaaaatatgtaaatacaagaaacagtattatgtttgcaagcctcaatttaatcaatttaggaagtaactgaaaagtttttaacaagaaaaaggatacaattaaacgtatacttattgtattgtatactttgtttttatattactgacatttactttcactccattctagaattaaaccctcctaaaaccaagataagtttacaaaacctttataatactttatatgaggaattaaggagaaaattactcattaatctcatcatgactctgtagggccagaaagaacctgggagatgcagattctgtaacctgcaacggggtggacaataagactactgaatgactagtttcaagtggaatatccataacatagttaccccttactaaaaagcaaggatttcctatttcagtatctgaaaggttcaaaatttgataatgattacacaattatgttcaataaacaatcttttaaaatatattcctagcctttacttacatatcctacatatcccaactattttaactcacagcttacaagaatcagttataaaaagaagagtttgttctggaaactacacatgagataatatatgctgattcaatctaggaaggaagggcagaagcctgcaaaatgtgccactgagagggaaagatgactatccatttggaaggagatttagatcagctcaagaactcgcaaggactggtggcgagtggcagggtacatccatctgatgaatctgcagttttggtcggaaaaggatgctgtttgcaaacacccggtggggatgagtacctgtgccaagacatccttgaaaactccaggatacgcaccacctgactgcggaacagtgagcacaagacacccggagcgctgcagaatgggcacggcatccttggtaccgggccagccctctccacagcggcaggggcggggtaggggtgccctactggagggaggacatgggcacgactccccgaataaaaaccgctcatcgggtgggggcggggactaaccaccaccctcacaaccccctcacctccacgctctgttcatccattgcctccggctctcggcggggccgctggcgacccgcaggctccgcagtctgacctcttaggcgccggcccgaggtcgccagatcaaatcgccgataaaagcccggcgcccacgtcagggggctctgacaaccgccccacctgcgcgccccatctcttcaggtccagcgccgcctacccccatttcgccatttttaccggcgcgcccgccccgaggcgcagaagtagggcgaacggtggccgcagctcctttctcccggctcagccgccggccagcagccgcgccggaacctcggcccacgtgacgcgggcgcgcgcctatggaactgacggtggagttcagcgaagaaggtgccgcagagaattcgcaaacaccaaccgtaaccagagcagctgggggcgcggcggcgagagaagctgcgaagcgcatgcgcgcaggacgctgt

SEQ ID NO: 2842 - DNA, 91111 bp, Homo sapiens
  source 1..91111: mol_type = genomic DNA
gctgtatttttgttttatttcagaaagttcaagtctttccatcataattgaaggaattgcatgatcaattaaatattatcagcattattttccattaatgtttttaaatgcattcacacacctgagtgtttggaattatataaacatatccattagagtctagtctcatcaacatttatattatgctttttcaacagaattggagatgaatcactagataaataggttacaagattatttggattttatgatgaattggtttgccgaactttagaattcatagcaagaattaaatctttgaatttgatttttaacaaaagaaaattgtgcattgtgctaatctacttttgcatattacatagaaaatggctattaaggctttattgtaagggattacagtaaaagatattctattgtgcaccatgcaagatgcagaaaataatggtttacaaataatgttaagcaaccaaggcaataatggttttcctttcattctggttttcccaaattaaattttttttttttcagattaaaatcaggtttggagttaacagaaaattgcattcctaacttaaaaacttcaacttctctagattcctttagaaaaggaataaatatagtttaaaaaaatgttgctttgggtagaagtcttgattcattgcttcattcttacagctttttctttgcttccttactataaaataatccaatgttattgtgaggacaatctctgattcagttccaatgctcttgtatctccatgagttttggcattgtttaccagcacctatgggaaatcacatacaggaacgtcagtattttgtttattaacaatatctatattttgattcattgaagccaagtaatccaagggcggcagtcttgaaaaggcaacatcaaactatactaggaaaagtgactctgtgcaatctttcagtcacttttgcagatataaattgtttaaacgaagctaacatcagagagatgcacaattcattcaaattagtatagatgccaacattctgattgctttttttttttttttttttggacggaatctctctctgtcacccaggctggagtgtaatcgtctgatcttggtggctcactgcaacctccacctcctgggtttgagagattctcccacctcagccttccaagcagctgggattacaggcgcccaccaccacacctggctaatttttgtatttttagtagagatggggtttcaccatgttggccagaggctggtctcaaacttctgacctcaagtaatctgctggccttggtctcccaaagtgctgggattacaggcgtgaggcactgcgcccagcctgattgctatcgttattagcactgcataaaattaaaggttttgtttgttggctttgttaataatactgtcacctctaaactcttactcaaaaagactactttatgcatagaactgttcaaatgaaattgttcctctttgaaaccacagctcaggatctaggctataggttctaggctttatcaataacttttccatgattttacctatttcacaaactagaagattcaatttcagctgatccttcatactaaaacattttttggttgttcattgtcaagcactgtgaagggtctgagattctgctctatttggaagctaacaagttagcctgccacagttccatagatactgccagaagatacaggatttttaggtcacagagaaaagtcttcattattcaaggtacggcaaacagcatgaacatcaacatatttgcctctgttcttcttgtcctctcagtctgtgacgtggatggactgatatagtttcccacatatgcagtcggttgcattacaagaagggaaccctaagcctaggatgcttaatcttttataatggacaggaatatctaccctttgttctggagggagatactatctctgtcttccaaggatgttcactatacgaatatctttgaaaagatagactagaacaaagagtaatcaggcctcctgctcacaggatatttagaaatgcaagagatccacggcgaactgtctcccaacattcatatatgttccacctttttgatttggaatatgttgattacaatgcctttctccaagcattcttttctttactatttctttcagcttttacgtttcaccaaaaggcaaacagtatttcaaaatgctgtaggtactgaaaaagcttttcagtgattttcattgtgtttttaaaattgttggctaaagctatgaaaattttaacccaatacatttgtatattctctacattattcaaaataattttggatacatatatatttatatatttagatgccagagccatagcatgagaagtagagtagaaactgtcacatgtattttatagtaaaggcaagaataaggcaaacaatttttttaaagataatacgaacattccattaggattctgttacctctaactccatcctatctgcctatttgcctccactgcaatggctgcaaaaatacaactaacacctagcagaccaaggatactgccaaatatccaacattgcataggacagtacccaccctcaacccacacctaagaaaaaattgtgcattccacaatctcagtaggttgagttgagatctctgaagatgagaaactctgggttaaaaagactataaggggtatatcatatcctggtttcaggaaaagagaaatataggcaggcaaaaatagtataatcattgtgatgttaatacaagaccagtgacaattcatgcatggacattctctcctttggtttaccagctggccatttttacttagccttgcttcttgcttaaatacagttaaaaccttcaacttctttagagtcctttctttaaaaaagaaaaggaatgaataagtatagttttaaacaaatgtcgctttgggaaaaactcttgattcattgcttcattcttacggctttttctttgcttccttactataaaataatccaatgtttataaaaaactggacaaaatattttatccatcaatttataaagaaataacaacggtaaataaataatatgaaagaaagtatagttaagtcattcccttctggccaaaaaagggaaagaaaatgttgatttttgatactgctttaggttgggtttagatggtcatatatttgtattgttataaacttcactaggtaagggctttagatcagcagttcgcaactctttacaaacctcagtacatttaatggatgacttttaaacttgtgatgttctcattggttcaaagataaagtcctgcaattagacaagctccttaaaattctacccttctctttcacttaaaaaagcttataggaacgcattaatagagagatatataaaaatatccatgaatctattatattttattactgaaaataaaaaagtaaaaccatttgtcacctctggttagtatctaattacttacaacatgcttcacaactgatcacgaccccaaggttgttggtactcaaaaagtgtcagattttggagcatttcagactttggatttttagattagggatgctcaacctgtatagtttccccatataaaggcatcttgtacatatacaggttaaatcaacattaaactttttttaaatacaggttttaacagttctgttatttatgccaaagagccccagcttttgatgttctaatatcgaaaggagaatgtcataactaacccatggtaagatacaaactgtatatttaacctttaaaccatatgcataaatatttctcattttcaacagatgtaacagtagacattgtagtcttttattagccaaaaaattacacactcagtttttaaaaattcaatcataaaagtgaagtaactttgaacaataactctaaaacccttagatcaaagataaaacattttaaataaaatcaatgcctcaaacattttaaataaaatcaatgccttacgtcaataagctcatagtcatctttggcatataagtgtctcagtaggtaccaacgtgcagttgatgcaatagatttgggatacccaggctgatataccactctttccaaaagacgccgtgtctctctggaaaaaaaaaatttacatttagtccaaagcatgcaaattaccataagatatttcctatactaatctcacacacacattatctttctcatatttttgcagatgtagtgtctgattatgattttttaattcagataacaataaaggtaataatggttaatatctattgagtgtttatcatgcactaggtaccatgctaaatgtttatacatatggctgtatttaatgttcaaaatcttattaggtaggtagttattattcctatatggcagagaagtaaattattccaagttatcctcattccaaagagaacagagagacagtcgctattttataatctactttgagtgctctacctccaatctttttgaaaagtaggcagaaactaaataagtcactaaataatgcaagggtgataaagagtggaacaagaaatattcaatgtctacattacaggctatgtatatcatatcaggcttttagcatatgttttcaaggacgtgtatgataatgtaaacccatgtaataacaggctgatttacagctgtgttctaattttttctttcctaatttactaacatctatgactccaaaacttctgtactgctaaaaacaacataaaccattagtatattcagaactgctaaacagaaagatcttctaagtagcaattagtttgaagcaggaactaaataacttgtcttgaagatgcttttgcagagggatcacgtagtaagcacgttgttatttttcttagactgcatttttatttgggctaggttttgaaggcgataaaaattatgggaggtgttaacaaagattattggggtagggggtgaaggggagatagtactctctaagttaccaacactgagcatgagcagaagtagttcattaggaagtttaaattatagcctaaaacatttcttagtgaaattagtcacacataaaaatggccccaaataaataaatgttaataaatagtgctggagttgctaatcagccatatggtcttaatcttccaccatccctattttgtgatgtgtcttttgctacatatttatatgtactaacctccatttctaccatacctattctgttccagtgatgtttgctcctcaatcactgctttacttacagatgctttgtattatatgtagtatatattagaactagatattttcaaaatattaaagtattcttgcctgtattttttacccatatgatctttaagtaattttcttcaaatttaagtacacttctttcaacataaacattgctatagaatttttgtattttaatcagagcagcttttggattttctagataggaaaccacatcatttataaacaacatatctctgccttttcaatatttattacttttttcatagcttataacaatagcaagaactgataatgtagccttgtgttggggtcttttggttttgtttgtttctagaacccacatcacactgttggtgcctcctaacacagtgaagaacaaaaactccaagaccttcttcactggaaatgctatcatgccaaacccctcatgccctataaatatgtatcaaattgcctttttaaacaaatataaggctttgtttctcccttactggatttctggaaccagttcttccaaagtagatacagatatataaataccccccaaagtttgttaaattggtctgttacaaactttaaagtttataatctttccttgattatttcctagaaagatttaaagtgaagaagcatttataagaaaaagatgaagattcttcataccttgcccccattttgcgtttgaattgtaacaaagcttgtaaaagaacagccagtggacaaaagcaaagcttcaaggcctcagttgtagcctcttgaaccaaagatggccagtgatcattggaaatgttagcctataaaaatataagacaaatattaactcaaagatttggcatatttatttgaaaagtattcaattcaattctttttttttttttgagacggagtctcgctctgtcacccagcctggagtgcagtggcgcgatctcggctcacttgcaagctctgcctcccaggttcccgccattctcctgcctcagcctccggagtagctgggactacaggcgcccgccaccacacccggctaatttttttgtatttttagtagagatggggtttcaccatgttagccaggatggtctcgatctcctgacctcgtgatccgcccacctcggcctcccaaagtgctgggattacaggcgtgagccaccgcgcccggccaacaattcaattcttattgagtacctatttgagcccgtcaccatataaataatacaaagagtataattactacaaagagatttaagatctgatccctgctctaaaggagctataaaatggggtagactgggataaaggaggttttcaaagaggagatatttaaaaaacactaaaatatttgtttaaagaaaatgcactattatactacataggtgaataaaatctatcagtcttgtgtctaccaaatatacaaaactcaatttaacataattgattctttaactggtagtgataaatatagagttctacatttcaaaaattatctaaggagagaggaaaggctgaaataaagtattttaataaactcccaatataaaaaagtacaaaacagatcagagataaaggtattaaatcaaagtaatcagtactaaaaactttttaaaaattttactttatggctaagatattaatgtatctatatattacttgggttacaagctttattctctctcatattaggtactgactcagaaataacaaaggtaagtatttctgaagaaacagtaacaaactaaagtgatgaacactttactgaattatgtaaagagaaaaaaatgcattaaaaagtttcatttaaaaaatctcaaattttgacgaagatttcataaccacaagtatctaaaatatgtattttaataaagtcaatatagtgagtcaatatatatagtctatttcaaacattaaattatataacaaaaattagagcaattatctctgagtgcagtataggcaatagcaatttgtataatcaagtaagaggaagctataatgaatgtgaaaatagacaatagtggttatgatgcatcttctataaatagtggctactttgggtacatctgacaaagaaagtaaggcaaagcacattctaatacaattattcttaacatcttactaaaaaccagtaacataaaactctcactggatgcttttaataatatactctctaaattctatgaaatcatataaaacactctgtaaagttagcccaaagatgactttataaggaaaaagttactatatatacctggcatattaaacaaagtgatcagaatgcacttctgttttcttttcccactacctgttcaacatttatttgagagatactttttctgtgtccctggatgtaaattacattaggccccatgagtcttattccatttttcttacattcatccacaaatacagtctcaattagaatgtcctcttttttttttcaacacttcagtctttgctgaaaagtaatatttgcacatacttccctgccccgccccaattcccctcagctcccaggctagagtatggttacaggcagtagcaggtggctggttccttttccctagtactgccaactcctgtggctaattgtagcttcaggaccctactgaaatactagaaatttgcatttaactggtgccattgtaaggtggtgccaagctctccagggttgacagatatttaaagctctttttctcaatctggctttagcagagactcccaacttcatgggtagtctctcatctgcaggcccagcaacataagctgtggggcccagtgcaaaataaagtgtagggccctttgttgaaaaattacgaagagtttcaagatagcaactacagaacattaaatcaagtatgatgccctgtgtaactgcagaggctgcatgcccatgaagccagccctgctcatctgcagttccactaatctagcaaatgtattctattcttctcactctctccacatcctctagcaatgtggaaacttcagattcctttctgctgacatcccatcatccctctaggtggccttagtgaacaggatctaggataactcctacaccaacccactctcaccactggcattgctcatttctggatctaacaaactctgagagtgttgctaattctgtctgcagcaactctccttcattccttcctccctatagcacaaggagatactcctgcctacccttgggattaatctactgttgaccattctctcccagaaacatgggatcactttctaaaacgctagcaattctcctcttctctgtcctaacacctaagactgagtgccaccgtctctgaaacagttagatacctgtttatatgcttctagacacatgcttccaggaccccggaggacacagattgaagcctccctctctctggtaggacccccttcctcaactttgtgtgtatctgtctgtagaagcatgccagggggaaaatgggtgaggcaacagccctctccaaagaaatgtcttcacaaatccttctctaactccactctcctgatgccttttttttttttctaaagtttaacttcagatacagaggatacacgtgcaggtttgctccatgggtatattgcacccagttagggagcataatacccaacaggtagtttatcaatccctgtcccactccttcaccctcagtggtccacagtgtctgttgttcccatgtttatgttcacgtgtgctcaatgtttagctcccacttacaagtgagaacatgcgtatttgattttctgtccctgtgttaattcacttagaattatggccttcagttccatccatgttgctgcaagggggacatgatttcgttcttttttttatggctgtatagtatttccatggtgtatatgtaccacattttctttatctaatccactatatggcaccgaggttgattccatgtctctgcattgtgaatagtgcggtgataaacacatgaatgcatgtgtcttcatggtatgatgatctattttcctttgagtgtatactcagtaataggattgctgggtcaaatggtagctttaagttgagatatctacaaactgctttccacagtggctgaactaatttacatctccaccaacagtatataagcatttaagcattcccttttctctgcagcttcaccagcacctgttatttttgttgttattgtttgtttgtttgagacagggtctcaagctctgtggcccgggagagagtgagaaggcaagatctcagctcactgcatcccaacctcccgagctcaggtgattctcccacttctgcctcctaagtagctgggactacaggtgcatgccactacgcctggctaattttttctatagagatgggattttgccaagttgtccaggctggtcttgaactcctaggctcaagtgatccacccgctttggcctcccaaagtgctgggattacaggcataagccaccacatccagcctgttattttttgactttttaataatagccattctgactggtgtgaaatggtgtttcagtgtggtttttatttgcatttctctgatgattaatagggatgagcattttttcatatgtttgttggccacttatatgtcttcttttgagaagtgtttgttaatgtcctttaactgtttgttaatggggttatgcttcttgcttgctgatttacgttccttattgattctggatattagatctttgtcagatgcatagtttgtgaatatttatttcccatactgtaggttgtctgtttactctgtacatagtttcttttgctgtgcagaagctctttaattaggtcccacttgtcaatttttgtttttcttgcaactgcttttggaggcttagccaaaaaattctttgccaaggccgacgtcaaaaaaggtatttcctaggttttcttttagaattttaatagtttgaggtcttgcatttaaatctttaatccatcttgagttagtttgtatatatgctgaaaggtaagggtctaatttcattcttctgcaaatgactagccagttgacccaatgcaatttattgaataggggagtcctttctccattgcttatttttgtcagccttgtcaaagatcagatggttgtaggtgtacagctttatttctgagttttctattctattccattggtcaatgtgtctgtttttgtagtagtaccaatgaattccctcagtatttgcttgcccttcacttatttagtttagtttcgtgggatatgaaattcttggtcagaatttcttttcattaaggatgcttcaaaacaagaaaataaagaaaagaaaaaaggaaaaaaggatgctgaaaataggtgccaaactcttctgcttctagctcgtaacatttctgcagaggtctgctgctagcctgatgggattcctctgtatgtaatttgaccctcctctctagctgcctttaagacttcttcttcttttgcattgaccttggtaaatctcatgctatgtgccctggggatgatcatcttgtacagtacatagctggggttttctgtatttcttggatttctatgtcaacctctttagcaaatttaggaaaatttttgtggactaatatacattttccaagttgctcatcctctctcaggaatgccaatgagttgtagatttggtctctttacataatcccatatttctcagaggttttgttcattttaaaacattcgcttttcattatttttgtctgactgaattgattaaaagaaccactttgtgagctctgagattctttcctcagcttgatgtattcttcttttaacgcttccaattgtattatgaaattcttgtagtgaatttttcagctctggaagttcagtttggttctttcttaggatgactatttcacatttcagctcttggattattttaccggattccttggattgggttacaactttcccccaaatcttgacaagcttccttgccatccagattctgaattctatgtctgccatttcagtcacttcagattggttaagaaccattgctggggaaccagtaggctacatttggaggtacagggacactctggctgcttgaattgccagagttcttgtgctgattctttctcatctgggagggttggtgatatggcttggagctgtgtcccagcctaaatctcacgttgaactgtaatccccagtgttggaagtggggcctggtgggaggtgattggatcatgcaggcggagttctcatgaatggtttagcaccattcccccttggtactatacactgagtgagttctcaagagatctggttttcaaaagtttgtggtacatcccccctctctctcttgctcctgctctgaccatgtaagacgtgcctgcttcccctttgccttccaccatgattgtaagtttcctgaggtctccccagaagcagaagtcgctatgcttactgtacagcctgtggaactatgagccaattaaaactcttctgtttataaatgaccctatctcaggtatttctttatagcaatgcaacagacgaatacagttggtgttcctttaactgtggtataaattgagtatagtcagttggcttatttctggatgcttccaaagagccagggctctgtacaggatctttatgtgaaggtgaactcttgcacttggtttcacaggcgtatacattagcaagataatttttggtgttgtagtttgggctgcaatccagtagatagctagtgcataagagtaacggtgggtaactaggctaacacttagccacatggctcttctgtacttcttcacattcacaggcatgctcttcagtggtgatggcggggacaggatagaaaggaccacctcaccagctctgctccagggccttaggggaagccccctctgatcattcactccatgcccacattacttttgttaggtgatttgggttgctgggtccccttgtgcagggactatgacagggagatatgccaaaacttttctggactggccctgcaaagggaggcatgccccactcttgtccttgcccaggaacccatgcatctcacccctcttagctcttgagggtaggggctcctccccaactcaagtgccagccacagatctcagctctgtactcctgagttgaatgccgcagccctgggggcactggaatgtcccatggctcaaggctgagttcaggttatactggaggattctatatgctacagcaatctatcttgatctgatatctcactttggaatctgatatctagtatcttagccaacttgtcaattttacatccagatcacatattatcacatataataaaactttcaaataaagacttttataaatgtcttattttaatatatccatcctccccatactgccagctgtttaccatagaaatatggcataccttttattcctttataattattggatgtcaaatgttttttcaagaacaaattggattgatagcactttaaggtttacaaaggcatgtgtaaacattccttcattattcaaacaatgccacaagaaggtaaaataggtattctgatctccactactaagggctttaaacagtttaactggctgaaggtttcacaggtagtaaatggcagaaccagaacatgggctcttagagaaaatacttcggtggtatagtacaggtaaaggtggggtgggggattcagggggacaggtatacatgggtattactgaactgcaagctaatttcttcatctgtcaaatagggttattgtgattattaaataagttaataagagtaaagcatttataatagaacctagcgcagactaagtgctatagtttgctattgttaaaactattattaatttgttctattccaggtcagatttaatttcccagcatcaacaaaaatcaataaataatactgaaaagtaaaaagtaataagttatgctaaaagagtgtctacttctccagttcacatattgaagggcatgttataggtactatgtgcagcttctgtggctcaccagttaccaaggtcataaagacctttgttatatacaaatatggggcaaacaaaataaaatagtgaactacaattagttggccacattattattatttgtccattcactcaaaaccatttatagagaaccccctatgcacaaggcagactgacagagcaaggaagcaaaaatgaacagaaatagtccctgacataagaatctcttaaatgtgctctacagtaatggcaccaaagcaaaaaaaaaggcctaattctacatttcattgtcaaatgcctagttaaagtgagtaactaacattctcatggattactatggtaaaaacaagagttactttagggctgtctaggataatttcttctaaccatgtaaaaccaaaagaataacaatttaacttttaattacaaaataataaggaacgacaaaaaaatccaaacactatcaaaagatataaaatgaaaaattctcctctactatcctttaaaacccccagtccccttctccaaataactgccattatatttcttatatatgtttccatataattacatcttcatgctttaagcatatgcacaaacacacatggtatatttagagatatacattcttaaaaattcataccacatatatgaacactccattagaattatatcatacatcctgctctgcagtttgccctcactcccacttaaacatgtatcttgacaaattttccctaccagcatgtaaaactttcagattcatatacgtaaattggtatcagaaaatagcttgttaggtcataagttactagaaatccctcttagagaatgttgaattgaaatgagaatgactgaaatgttcactatacacatttttgtcacagttgagtagctaaatttaattctaatacaatttgtttcaccaagaaacaaaaatgtatatcctaatataattcaacttttaaaactgtaatcttttttccccaaacatcgacaatattctgctgtagtctatagatttatgttgctctatgtccatcacaaacccaaaatacaaagtgtatcaagaagccacactagaacacaatgaaacaacaggacttcaattgaatattactatgtaaaaagccttcacgtcaaagaaagataaaaaaatcaatttttcatgatcataattataacatgatcttaccatacagacttttaatgcaagtagtgctagtctcaacagacttgagagcttcccactccaactgccccgttgggatgccaattgtagactctttctgtaacacatctctgcagctctcatcattccttgggattgatacacatgtgccagccactaagaaacaaaaaaggagaaggaggcaaaggattttagtttattatgcagtctgttacccctacttccaacaaattcaataaactttgtcgtagtaaaaatgtttttagttattggtaagttctgtgcccaaaaaacaattacaggtcaaaaaagggctgtcatattgccaattcttttaacaacagctgcctattagcaaattgaccccggcaatatataaaaacaataatatataatgatcaactagggcttattctaagaatgcaaagttggcttaatatatgaaaatcaatgtaatctaccacattaacagaataaagaaaaagattaatagatgccattaaaaaagttttaataaaattcaagacccattattttttaagaaaaaactctcttagcatattcaaagtagaatcttcttaatctgataaggatatttataaaaacctatagcaaacaccatacttagtaatgaaatagtcaatgctttctacctgaggtaagaagaagacaagaatgtttacttatcaccacttttgacattgtattaaaggttccagacagtacaataaagcaaaacaaacaaatcaacaaaaaaccttaatatgtaaatattgggaagaaaaaagtaaaaggggcataactatatacaaaatccaaaacctttcaaagaataagtgaatttagcaaggtgctggaaagtcaacgtataaaaatcaactgaatttttaaatgtttggaaatgatttaaacacacacacacaacagaacaacaacaaaaaataccaaatacctagaaataaatttaacacaaaagtataaaagacctctaggttgaaaattgcaaaacaatgctgtgagaaatttcaaactaaattaaatagaggaatataccacatttgtggacagaaaatattcagtagagtattactttgtcaattgtccccaaattaaactgtagattctaaacaatctcaattaagatcccagcagagctttgttgggtgagaattaacaatttacagtagaccctctccttaactgtggtttcagttacctgtggtacaacacaataaaatactctgagagaaagagggagaccacattcatataacttttattataatatagtgttataacttttattattattgttgttaatctcttattgtgcctaatttataaattaaactttatcataggtatgcatgtatgtataggaaaaaacattgtgtgtgtgtgtgtgtgtgtgtgtgtgtgtgtgtgtgtatagttcattactatttgcggtttcaggcatctactaagggtgttgggacatctcccccgcagataaggtaggactactgcatttggaaatgcaaaagacctaagacaaacttgaaggagaacaaaaagttggaggttttaatgttaccacatattaagactaattataaagctatactcaagaataaaaaacaaaagattaaaaaatagaccaatggaaaataaggaggcctgaagacccatacatacacagctgatttatgacaaaggcatcactgtaattcaatggggactgaatagtcttttcaaagattggtactatgttaattacgggtaaaaataaaccttaactcctgcaatattcacaaagattaatccaggataaattatagacctaaacatgaaaagtaaaacaataaaatttctaaaacaaaatattaaaaaaaacttcatgaacctagagtaagcaaaaagttcttaaatagaatatcccaataaagcattaaccatcatcagacttcatcagaattaagaactattcattaaaaaataacattaataaaggcagccataggtgtaagaaaatattttcaataaaaatatccaaaaatgtgctcagattcaggaaatataataaattccaataatttagtaagtaaaaaatgaagactccattaaaaattatgcaaagcactttacacagaggatatccaaaggctcaataagcatacgaaaagttgtttgatgtcattagatatcaggtaaacacaagttaaaatcactacaatatattattacctacatattcaccaaaataggggaaaaacatgacaatctagcaatatcagcacctggaatgctcatgcactgctggtgcaagtgtaaagtggtataaccattttagataactctttggcaggatctactaaattaaccatacatataccctatgtcccaccaaaaagcatgaccaagaatggtcacagcagcattattcatgctagacaaaacctggaaacacccaaatgcccatcaacagtaaaatgaataaatattatcgtatgtccataaaatgaaatgaaaaaaattatggtacatgaaaccaccaaatgaatctcacagacatcctgttgagtgaaagtaaccagatacaaaagagtactactccattgatatgaagttcaaaaacaggaaaaactaaatagaggtcagaatagaggatttccttgttttggggtggggggagtcaagcaagaagatcaactgacagaggcctaggggaagcagttgggttgctagaactgttctgtatcttgatatgggaggtgttaaacaggtatgtcatatatagagtagtacttttaagatttttacactttattccttgtgaattatatcataatataaaagaaaacacacacatacacacacacatgcagtctcttaagactttacttattgatatggtttggctgtgtccccacccaaatctcatcttgaattcccatgtgttatgggagggatctggtagaaggtaactgaatcatgaggggaggtctttcctgtgctgttctcatgatagcgaataagtctcacaagatctgatagttttaaaaaggggagtttccctgcacaagctctctctcttgtctgccgccatgtgagacacgccttcctccttccatcatgattgtaaggcctccccagccacagagaactgtaagtccattaaacctctttcttctgtaaattgcccagtctcaggtgtctttatcagcagtgtgaaaatagactaatacacttatgatataatttatccttcaatttttcccttttagtttgacaatgtatttctccctttgataatgaatatgaaatcaacaacatctagttgttgattaagtatctaaggtcagctagatgttctgaggtcaactagatgttgatcttaaatcctaaatctcatacagaaaacttactctaagaaaggggaaaaaagaattacagtaaaagggaggcttagttttcataatccagtaattttatgccagataattttttcaaattatctaaagcagggatataaaaaagctgatataataaaagatcagaataaaaaacaaattatagtaagataataagcgtctataaatctatatcaaaaagcccttttgatactttctctggggcacagaggaaatataataaattgtataaaataattatgtgcttccttgtattttaatatcaataagaacaaagcacacagtgatcattgtgcatttgtcactgtggataaccagagccacctgaaagagcagatgatctgttgattcaagcatcaatcctgaaaataattatttctaaaagcactaaatacaggttatctgtaaagtagctagggagaaactatacatatctcctgtaaaagcagagttaaacaccattatgatacccttattataaaatgtctataacatatcaacccatataaaagacagtattttcatcaccgttttaaagtgagaaaatttagaatcaataacttaaaaagctttaaatcatcattgtagcagatccaaaactagtgttaaacttccttagttcctctaaccacaataccttttagatcttgaaactgagagataacatggtgagagtgacagcaagccaaataaaaatggagcatagccctgacattaactaatattatgaagtgttttaattgaggactcaagtaagaaaggagaaaacttacctgccaagctggaacagaggttgagttggacatgactgttttttgtagttcttcaagtacagcatctgggagtggcttttgtgactccaggagtggtttacactgaacttgtctcaaaagtaagataacggctggctgatcagggttactttttaaattctagaaatcaaatcccaaagaggaacacatcaaataggttcttaagtgttaaaagtaaaaagcattattctccaagttgggaaaataaaattctgaaggtttataccttttcttattaaagagaaaacaactgcaaataattaaataaacaaaacaatgaacagcctgtaaatatcaaactttacattaaaataacctttaaaatcagtaatgctattactgtagtctacatgtatttccctttgacttagtttactcttaagtgatatcctgaaaaatttaggttctaaatgtaagtaaatagttgaactaagaaaatataaatataaaattaagtgggaatgctatcactattccatactggaataaactatactatgtaagaagaaaagaggcatacatttttttctttcttaacctcttaacaaaggtattcactctacatgtctttcttctaggcacagccttttcaagtactgcgagtaagaaaaatgacctattttccccatttccttaagctactgtttctatcttaaaatacttacctacatacatacataaatgtattgtatatacttatattctctgtatgtgtatatatttttatatatatgaagaatttctgtaaacaagtcctcccactattgtttcaaatatttctttattgcttgtccctcaatagcatacttttctattttttactcattagatcttaaatgtatttctaaaatttatttgattgctttcttctaagtaagagattgcaacaacaaaccgacaaggaaaggttcattaggcatcacttattctatcagagggcacatagcaactgtcaatttatgcttagtaaacacttactgtgtaataccctgtcctgaacttagatggaattccttaaataaaagaaaaaatgtatcactctgcttttcatagaatttaagaaccaaagaaatcttcaaaagtccattcttctttctctgtaaaatgtatactgatctttccaaaaaaattacacaacctccatggtaagcaattatgaaatacgatgttttcaggaaaagtcacgttcaaaactctctttaaccattacattatttctaagtgagctttggaaactaattcattctttcagtaaatatttattgagcccctactatgttctaggcaaggtaatacacatttattcacagagcctgcaagcatagagccctccaatcctggcatgtaaaaacagactactgagtagattccagtcacccactcaacaatctccacagtcattctatgtgatccagaactttggaaaactgaagggatactggaaaatatagcattaagaaggaaccaatcagaaatcaaaggaaaatactgcctctctaatgacacccaaataaaaaattttttaaagacctataataagagcttgagtcctagagtcagacaaatgtgagttcaaatcacaactctatccattcctaattgtaagctcctgtgcacattacttatcctctttaagtcttagtttttcttatctgtaaaaatgaggataataataaatacctatatataagattgttgtgaagttcaaatacaaaatgctaaatgcagtgactggtttgtggcaagtacagtaatcaataaattttagttgttatcatcataattgtcatcaccaccactacctgctctttaaacaacatgcattcctctttttttttttttttttttttttccagacaggatctcattctgttgcccaggctggagtgtagtggtgtgatcatggctcactgcaacgtcaaattcctgggctcaagcaattctcctgcctcagcctctcgagtagcaggaactacaggcatgtgtcaccaggaccggttaattttttaattttttgtagagacagcctctcgctatgttgcctaggctcgtctcaaactcgtggcctcaagtgatcctcccatctcagtctcccaaagtgccaggaatacaggagtgagccaccgcatctagcctcatacattccatttttgaagttattttcccagtaagataagaatccatgagtttcaatgcacattccataaaatacctttgtgcagagagtttcagcttcagatattcttcctgtgtctattagaccagtgacagcttgtgagagagaccacttttcaagggactggttgtaattttcaaagaatttttcgtctttaactgtaaacaaaaaatgtcaatgttactttcttctgcaatttataatgtgttcttagaggagtaactggttgctaaaaaattaccgttgggcttatcatccatacacagtttttcaaagttacatgtgccacatgtaccatagactatcctgacaagtggcaggtttctgaaaagtttcatggcaggagtatttgtggctaaataactcaaagcctcatataattgtgacttctaaagaaaaataaaataatttgctgaaaacatgtaaagatttactatgatataattgatgtaaaataagctgcacattttcaaactatacaatctgatgatatttgacatgtatatcagtgaaccatcaccacaaccatgataatgaacatattcagcattatcaaaattttcctcttgtccctttgtaaccacttctgtccccaacctactccatcctcccttagcccctgtccccagtcagctcctaatctgttttctgtcacataggccaatttgcatttccacaaatttcatataagtggaatcatatagtataaactctttggcatctttcacaggtgctaatatggcaaattaccttcattttcaaatggtacatcaatcttgcattcctgggataaaccataattgatcataatgtattattatcatttttatgtattgctggatttgaattggtgaagtgttgttatgaatttctccatctaccttcacaagcaatgttgttctttgcctggtttgggtattagggtaatgctggcctcatagaagatgtcagaagtgttactatcttagattttctgaaagaatttgagtagaatgggtattatttttccttaaatatttggtaaaattcactagtaagtgaatttaagatagctattcaagatagctgattagatgcattcggtgctcgcctcgtccatggaaaggaaccaaatagcaagtagataatcacacttcagatatattatctaagaaagcacactggacctcaacagaaaagtgacaggaaacaccaaaagcaaggaaggagaggggagtgaggtcgtctgctcggctgggatcagctgggagcctagaaaggctcctgaatgcagggaaaggataggaaagagacccctaacagtttacattcctaccatggactctgataattctagccataagacaacctcgtgacccttgcaggccctaaaactaacatagggagtacataataatggcattggtccaaagtgggagctcacgctgagtcccacaaacccctgagtcctaagcagctagagtgaggcactattttgagagcccagccctctaccaggctgtgtcttgccatgcagcccaacagcccctgtatctccacagtcctagagccccactgatattccctgcccacagccactgctgctggagctgaggtgagagccactgtcaaccaccatgagctgctggtaaggagcagccatgcatattcaagtgccctgagaacaaattccactgccctgcagctaccactgcattagaatacagcagagctgaggcatcactgaaggctgcaaccctatggctgctcacactgaaagcaaccccaccctacctagtagcagggtcacagtgcagcagctgctgctcccaacaaagcatttgctggcagcccggcatcactctgcccctgcctatcacagccagggcccgcatgcaccaccagggagcctaaggacagtctacctggcctggctccattccccagagtacccaagcataccctcctggggcctcgggattgcccagctcagaccaccaccattagtatttgagcactcctctggggtctgaggttgggcccatccaatctgccgctaacaccgcagctggcactcacttacatgtatcacattgttggcctggagactggtgtgctcagtccattgcagccaccaccaatgccagtgtggactgcttgggtcccagagggttggtcccactgccactaccatcacccacaccacgtgtgctgcccagggactcaagaacacacccacctacccagccgaattgtgatggttaatactgagtgtcaacttgattggactgaaggatacaaagtattaatcctgggtgtgtctgtgtgggtgttgccaaaagagaataacatgtgagtcagtgggctgaggaaggcagatccacccttaatctggtgggcacaatctaatcagcttccagcaaatataaagcaagcagaaaaacacgaaaaagcaagaccggcctagcctcccaccctacatctttctcccatgctggatgcttcctgccctcaaacatcagacttcaagttcttcagtgtgggggctgggactggctctccttgctcctcagcttgcaaacagcctgttgtgggaccttgtgatcctgtaagttaatacttaatgaactccccatatatatatctcctattagttctgtccctctaggagaaccctaatacaccaatgctgccattcctggaacctgggcaatccatctaatagaggcacaagaatgggcctgtctaaacccactaacaccaggacattgctctggcatccaaggacaggcaagcttagccaactgctgccaccactaggacccaaagactggcctatctggcatcccaggccccaccataacttcaccaagcctccactaacaagtacatcctaacaaaccaaagaaatcacaaatatcactgatgctgtctacagccaaagaaatcagagactacattcagaatcaaagccaaagtgacctacccaaacaacaccatggatacatcttcaggaaaaagtgctcccctacgaaagaaaattccaaaattggaagtgactgttagactagatatgcatatatcaatgtaaggacaaaggaaacaagaaaaagcaaggaaatatgacacttccaaaggaacataataattctacagcaacagatctcaatcaaaaagaaatttatgaaatcctaggggaaaaattcaaaatattgataataaagcagctcagtaagatacaagagaatactaaaaaccagtacaaagaaattagaaaaagcaatttaggacattaatgaaaaatttaccaaacagatggatatcataagaaataaccaaacaaattctagaaatgaagaattcattgaatgaaatacaaaatatatctgaaagcttcaacaacagactagatcaagcagaagagcctcagaacttgaagacagatcttttcaaacaacctagtgagacaaaaatgtaaaagaataagcaaagcctacatgacatatggaacaccataaaacacccaaatatttaaattttcagtgtcctagaaggcaaaaagaaaacataattattttgtttaaaaaaactatttaacaaaataatagatgaaaatatcccaattctagcaagagatttagacatctgaaaacatgaggaggcttagagatgcacaaatatttacaattccaaaagatgttctccatggcacactatagataacccatcaaaagtcaaagacaaagagagaatactaaaaacataaagagaagagcatactacttataaatgaacacccatcagactaacagcagatctgtcagcagaaatcttacaggccagtagagaataagataatatatccaaactgctgaaaagaaaaaaactgtcagccaaggacactatacccagcaaagttattcttcataaatgaagggaaaataaagttttcccagacaagtaaaagttgaatatcaccactagaccagtcctacaagaaatgctcaatggaatctaaacctaaaagagaacagacaacatttaccatcatgaaaacacacaaaagtaaaaactcactggtaaagcaaacatacaaaagaggaagagaaaggacacaaatggtaccactacagaaaagcaccaaaatacaataacacacaataaagagagaaagaaataaagaatataccaaaaaaaaaatcaactaattaaacaacagaaataaggcaacacacatcaatgacaaccttgaatgtaaatgaattaaactttccattgaaaatatatggattagctgaatggattaaaaaaaattacccaacatatgctgcatacaagaaactagtctcacctatcacaacacatataggctggatgtggtggctcacacctgtaatcccaatactttaggaggccaaaacaggaggactgcttgagcctaggagtttgagaccagcctgagcaacatagcaagacctcatttctaaaataaaaaaattagttgggcatagtgacttgtacctatgacttgggaggcggaggcaggagtattacttgagcccaggagtttgaggtcagtctgggcaacacagcaagacctcatctcttaaaaaaaaaaacaactaaaataatgatagcaacaatgtatttgattatgtgtgcttacgtgtgtgtggatgtatacagactcgtatgcttatgtgtaagcaaaagagcaatgacataaaggacaataattaggattgttttactataaggacttgcactatccataaagcagtatagtgttagttgaaaatggagttggattaattctaaatgtatattgcaaccagtaaaaaagggcaaccagttaaaaaaaaaaaaaaaaagtagaaaaggaaatacaactgacatgctaacaaagaagagaaaatagcatcaaataaaatgcacaattaaaactacaaaacacagaaaaatagttggacaaaaatggaaacaaaaaacaaaggcaacaaatagaaaatggtaaaatatatgatagatactaaaccaattatatcaacaatcacttcaaacacctatagtctaaacataaccaatgaaagaaaagagattgtcaatgcggataaaaaataaaaataggtagattgttctttcttttaatctgaagagcatggcttcaaaataactatgttataggtatttctgaattaccacttaataaattcattttattaaaatatttcaatcttatataatctaataccattaaacaaaagcctacttttcttaatttgccctagtagtcaaaagacaggcagtaatgatgcttaacatttactaaaaaatgattaataacctaaaattaattcagtgaaaagctaatgtcccaagacaaaagtaggctaatctatttattaatttaagtaggttaatctatgtcacctttcagtgaagaaatttatagatttacaaaacaatgttaactaaatctgattagattaacagcttattctgaccaagattcccaggaggaatcatgggacaatttcaatgctggtttcagtaaaggactctttccaggtcacctttatcctaaaatgctggtaaagtctcaaagtaagtaaatgctacaaaacaaagatttcagctaacagaacccattgggcttttaagctatctggaagagaaaatacatatgcttatcacacttctgtacaaacattttactatggatttttaatgaatatatatatatacattatttaaatatatatattcattaaataatgtatatatatatttaaataatgtatatatatattcataaaaatatacatatatatatatatatttttttttttgagacggagtctcgctctgtcacccaggctggagagcggtggcgcaatctcggctcattgcaagctccgcctcctgggttcacgccattctcctgcctcagcctccagagtagctaggactataggtgcccgccaccacgctcagctaattttctgtattttttagtagagacggggtttcaccatgttagccaggatggtctcgatctcctgacctcgtgatctgcccatctcggcctcccaaagtgctgggattacaggcgtgagccaccatgcccggcctaatgaatatattttttataacaacatatgctgaagccgtttgtattctggatttaaccattcaagaaatctgaattaaatcatgtataaagatgcttttaaaaacttacttgaagcagaaacagcagataacagtgccaagtataaatctatcctctttggctgagtgttgttcactaaggccagtttatcatcagcgtgacaggctgccattagcccagcccagatagcaggatcacctgaaaacaggaaatacacagtgataagtcttgttaaaatcaacatgttgcttaaaaactatcaaaaatgagattaagagtttacaagttaaaaaaaaattgtatctaaaaaaaaatttcactttctcaaaggaaaattaaattgcacttgttttcagagacacattgctacattcatctttccagatttgccaatttttccaaacatatcagaggatgataaacatcctattaagctgttcatccatggctggttagctcagctgcctagagtgctgtattactgtggaaagggcaattagattcactttcactggacaccaaggacaagtctcactcatcttcatgacttagtagttgctgttttaaagactcagtcctaggacaaggaagataacacaatttttcagttcttaagaaaagtttaagccaaaggaaaggctcaagattttaattatattctaataggcaagcagaaaagtcacttcatcattccaagtgaagcatttatatgactatctatccctcattcatttgatcttttcttctttccttcatccttcacagcagcttcagggtagggagaaggagaaaagtccaacagcagtgagttggaagggaactttttatgcatagaaaagattatgcataacgacttctctttttaagaaagctgtgaaaaaaagaaacgtgaagggaatatggaatttagaagttttttcttttcatttgtttggtcatttatttttataaagcttattttgctgtttacttcagcaagttaatattttagtcctgctactcttaaaaaaacaaatgaatgcttttaatatctcacaagggggtgctagttaacaatatagacacttgatcatacttattagctttagttttctattttttcttatctgaccaccccacccaatatatgtttcttatcatatatctgaaatatatatatacttcagttataggtgaccagtattattgctaaaagtacaaaaatcaacaaaattacaagaatcattaaaatcttatgcagatcaaatacttttacaaaaagttaaatgcatacctccatattatgaaacaatttctgctccaaataataactaccttattttaaggaacacagacatcatcaaattccagaataaacaaatggggactatttcctagaatttatgatgaaatctgattactatataaagaaaggcacatgacagccttagatctgggtttcaggtctagccgtgccactaattaatgtgtggtagttcttcctttaggattcattttcctataaaacaagacaactggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaaaaaaaaaaaaaaaaaaaaaaaaaaaaaaaaaaaaacaagacaactaaactagataacagctgaggtgccatagggtcttaaattctatgattccaactgaagtagactcaatctctgaatattaacttaatcctaagattaaggggatagctactttagggatcttacagtattgtatagtttgcatttctgattggagaatggacaatagctggcagcaatttcttctatcacaacacaaaataattactgtttccatgaactcttccatagataaccagcaacccaaattccctataaaataaagtgactctaagataatatataaactacaaacctaaaaattttaaaatatagcttgctaaagataacttttagtatcacaaaagcactaatctagcagaaattggatttttttccattcagttctaaattcttgtaattatctttaaattcctgacaagactccctggaatagcatctatcaaaactgtgctttgttcatctaaagatctacaaggactaagtgtacagccactacacataactacagttatattcattttcattggactctaaggacaagtctcaaacaggcactcatctttgccactcagtcactgttttagcatcttatgggatgtctctgcttccttgagtatgtatttatccagataatctgggaacatcagagatcattagagaggacctaatctgggcaatctcacctttctaaagtttatgtccttacacaatcaaaggctaatagatcttttatcattctggatccatgataagaattattgagagtaagtctatctaatatctgcttgagaactccaaaaataaaaaacctaccaatatatatataacatagacaaatcaaaatgtttagtctctttttgtttctatgtcaaaatgaaagaaaagataaacaacagaatattgactttttttacttagtttacaaaataatccctgaaatgttaactattttgcagcttaatgagggtctttacaatttattgtgaagataacattgaacttgttcttggtgtaatttttttcccaacagtgcttaggcaaaagcaatagcattctgatctaacacatctgaagagttaaaagggaatacatttaatacattatttcatatttaaaataatattatattatataaaaatataccttataaccctatactgctagacattccagtcttctatggcatttttccagtagtggtgatggaacacgcttaagtaacattcctcagtacttttgtgatcaacagcctatatatgacacagttagctcaggtgaggccataactgtggcatttctaacagttaccacataagatacatccccatccttcaagaagctaactacacgtaaaaatatctaaatatgtatgttaaataatttagtaactataggtaaaactctttaaaccatattgatgcaaaatggaaataaaactgtttcttgaaaatatgtgtatagttcagattttcagtaccaggtaataaagtatcattaagcagacattcctttaggcctctttcaataattggtgctctcttaataatcagtagccaaaagcagataatcaaacgatatgcaaaatcttgaaatattttcttaaaattcccttttgccttatttcatggaaatataaactttgctcctataaatcacaaataaatgcaagattgatagaatctaaattcaagaatgtaaatgtactgaattatcacatgcaccttgaaactatgtaaatctataatgcatcaatttaaaaagtcctttctgatagcattatatattgtattaaacacttacatagtgcaaagtactttaatcacccaaactcctgttgtagaagatctaaattacacacatttttgtctggtataaacaatgccaataaaatatatattgtgtgcaagatttttcccccacttacaaaatatgtatttagaaaaaaaaagaattggaattaatgaaatagatattatatgcacctggagaaaggagagctgccttctgaatggtctttagtgcagtatttttttcatcttctgctgaactgcttcccatagccaactgatttaccgcagtgtacagtaatgccttctaaataagagaaaagatgttagccaattttcctgatagctccctctctttcaaactgactaaaagactctatttgatatgacataatccctaagactatgaaaactattattccttcatcaatattatttaataaattcaacatttcctttgtactaggacaaactaacctttccatgatttgagtccagaatatgagccacatttcctgctacaacacctccctagaacagaaaatattgatgatttatacaaatgcagaaactttcatgaaaaagaaaaaattaagattgataagacctttccactaaatcactggaaaggttcagttttaccacattcacaactcctaaacttcttaaaagtatcaatttattattgttgtttgaaaagactaataatcttgtgaaaggaaatcttttctactgtgaccaactctactttcaaaatattcatttgaaggttcaaaagttatataattttaccaacgaaatgtacacattttctaacaatataaaatataaagactgagagagatcacaaagataaactaacatggcttactatatgaaaatacatagtatttttaaaacttacatactctagtaaaataaataaagttcaaggcaccgtgaagctcatcattgcttcaataatcaactcaatactaaaaataagaaaaatacatgtagcatcacagtgttttcattaggtcaatttgaaatctataactttaaataattgcagctacttcaaatggctgttgagattataaaaatgctgatagctgacacataataaagcactttattcaggtaattttagagtcgagtaacaatggtcttccaggtcctttgagccaacttactcactaaaaataactaaaaatatgaaataaaaccctgctgatcaaactgtggcttgtgcatctgcagcgtccacactctctaagaggttgttagatgtgcagaatattgggtcccatctcaagcctacagaattagaagctgcattttcacaagatgaccaggtgacttcagttgcacattaaagtttgaaaagcactgagataaaagattttaaaaacatattcttaaaagcactgaaaaattgacaagatattaaggacttaccaggccaaaactgaaagggaaaactggaattcagagagacaagtgagcaaggaagccgcttctgccatttgcaaatgctaacaatttctttctttttttttttttttaatagatggagtcttgccctgtcacccaggatggagtgcggtggcatgatctcggctcactgcaacctccgcctcccgggttcaagtgattcttctgcctcagcctcccgagtagctgggactacaggcgtgcgccaccatgcccagctaatttttgtatttttagtagagacggggttttaccatgttagccaggctggtcatgaactcctgacctcaggtaatcccccctccttggccttccaaagtgctgggattatagccatgagccaccgtgcctggcccaaatgctaacaaattttaattttaatcctgaaagatgtatgggctagtaggacaaaaattaaggcccaggttaacacaaggaggggagtatagaggagacctacatcagaataagctgagaccccaacaggccacaccctaaggttcaaggtgaatcagaattactccaggtctcaagaactagcaacccaagcacaaagtagcctgctttgtccaaaaaccccaagttctaaactttgtataacgtagtcccagattgatggacctcccaagcacccagcagaagcaagtacaaattatttctgtagaaaggcaccttaattctaggcctcaaattattcctacaaataattttcaagtacacacaattgggtaaacaaagaaacaaagccaccaagaatgaaaatcagtaggaataacgaacaagactcacagatgtcaaacaagtctgtgggtcttgcagacttcagatgttggaattattagtcgtggcaagtgttcaaaacattagctattaccattatgtttaccaactagtgaagtgaactatgagaggatatattaaccacagaagttaatagaagaatagactcctgaaaatatctggatgctacaaactaaaatatagtatataatccttcatagagtgtcagtgacttcatatttataattacatttttgtatattagcagtgttctagttcttactgccttatctttaagctgattttaaataaaattatattttgggattcaaaaacacatagctaatgattactatgtggcagtgttacattactttatcacatatcattaacataatctgcatgtgttcaaagagatcttcatacttctttgtagctcccacttctttgtacgtctttgtagctcccacaacatctagaacagcacaaccgtatatggagaaaactcagtctagtattcgttgaatgactaatggaaaatttagttaataacagaactttcttcattgtacaaattatcttgcagaagaataatgccatagtttaaaattatcatatttaccatatcacaagttattttatctctttgctagaatttgaaacgttactttacctttgcatttcgttgagcatactgtgcaacaactcgagacaacagagaccaaagagcagggtcaccagggttgctaaaggaatcaaaagtagcaggcttagggacaagttactttaaccacaaaatgtacaagcaaccaacaatttattaagtttaaaacttttcttaatatctaaaacaagttcatattaattgcgcatgtttggttgaaagtatttttagaaaacatactttatatcacctatatacaccaacagtctttatgaaaataagaagaaaaaaatcaacaatggatgattataaagtcatgagataattaagaaaagttaaggaaatttaacacactgtgttcaaacacaaagagattaaaaattataggataagtaatactgcatggcaggaagatgactactaataaaaatgacataaggaataagctttatattaaaataactaaaaaaaaacccagcaaagattgttaacaaaaatgaactctaaaaggaaaagagactacagacatgacactttactgctaaaaataaaacataataattaaccactgctactaatgacagcttccttttattaaacttttgaagaaattaatgaatctttaaacggctgaaaattactaaaaccatcaatctagacagtaccagacaacagactaagaatattacaaacttgggaattaagagctttaatagtaaaacaaagtttgggccttaacctgactaagggccaaatttatcaattgaattaaaaaaacacaatccttataggtaaaataatatatacagtcagttacctggtcctgtgtaaaatttcataaaaccagggtttggttttcaaatgtatattcttaccttattttatagtattaataaagtcccaatgtcaaatgcaaccatatcaagtataattaggttccaggttcacaaatacagaatttacctgtgaacagctttagatatttgtttttgcacagccacactgcggccttggagtgcataaatcgctgatgtaagaaggcacctctgataattactgtctttgtgtttgatgtgcttcagtaactcattaagtgctgcttttgacagtgtagcatcctgcattgccaaccctagagcacacagggcttgaaggctttctgtggttggttcctttaagatagagctgtaaagatattttaaaattacccattagttagtcttttttttttttttttgagacggagtctcgctctgtcgcccaggctggagtgcagtggcaccatctcggctcactgcaagctccgcctcccaggttcacgccattctcctgcctcagcctcccgagtagctgggactacaggcgcccgccatcaggcccggctaaatttttgtatttttagtagagacggggtttcaccatgttagctaggatggtctcaatctcctgacctcgtgatccgcccatctcggcctcccaaagtgctgggattacaggcgtgagccaccgcgcccagcctatgactagagtagtctttatctgtaactatcaaaacattatttagtataacaagcaatttacgtaaagagtcaccaaactaaactcaactttaagattaatataaaagcaaatttcttggtggttaagagatagcaatttccctgactgaagcagttaaaagcatcaatgacttttcacagaccaacaaaagccaaacttattttctggtcattacacctaagtgatatggtttggacctgtgtctctgcccaaattccatgttgaattgtaatccccagtgttggcggtgggtctagtgggaggtgattggatcatgaggcagagttctcatgaatggtttagcaccacctccatttggtactgtatagtgaattctcacgtgatctggttgtttaaaagtgtgcagcacttttctcttcctcctgctctggccatgtaaaacatgcctgcttccccttcacttcctgtcatgattgtaagtttcctgaggccgccccagaagcaatgctgccatacttcctgtgcagcctgcagaaccttgagccaatttaacctcttttctctgtaaattacccagtctcaggtatttcttatagcagtgtgagaactaatacactaagttttagaaacaaatataaattagcttctttgagtttcagctccaggtaagtaattagcacaattttgctaaaatgttgagttccaataaaatcttagaaggtataaataataaaaaaaactcttcaattaaaatatgatttttatctttctgataaagatttgtcctatttgctctatggtattgaaaccagcactttacataataagtacaaattgtctctatatccactatactccaaacgagtatttttataatttaaggataatttacattttataggtaaacatctagcattttttttcctctttcaactataaaatctgacttagccttatggaggaaaattcattaatgtttaggaatcccagttaatttaaataaagaaaatcttagctctccactaacaaccaaacttataagaattattatgaattttatactgtaataaaaataaaggaatttttttaaaaacttttttttttaacttaagtagttttattttatgggcaaataatgaacagatgttgtacccataaattctactttccaaaaacgggagctttttaaaagaaaaccacataataacttttaaaaggcgctgggattcctctgcttctagatcattgctaggctagaaaaataaagtttgttgtaccaggaatcacaagttagaactgagtattctccaaagcggaaattctagagtgtagtatcactagagacaaagactatttggttttcatccctaaattcctaccagaagggttaaaccaggtcaaaacagtccagcataattaggcttcatcaaacaatgtcattatgctcttctaagatgcaaataaaccaaaacaggaaatactaaaatcaaaataatatctgacactgtcatacaaatcgttagttccttgttgtatccccccttctttaacattaataaagggaatattttactcaaagaacattttattttatacatcactaaccatgaatttttgccattagttattatacaaatgctgcctagtaccattatccaaacggcataaccattttacgtccacaattcacttctatagttataagtagaattttcatgatttacataagtacatctatcggtgaagatttaacactgagatgcaatctaacatccgttaatatctgatgttttgtagatggcaatgtaggaaagatatattttaatcacttttcatttaaatgaccttatataacaaattaataatttagcaggtctaagttttaaacaatgctcactgaaatataacagaaatatttataacattataaaatgtcacatatctaccattacgtctttggactatttttggaagggggaaattaaaagttttgtacttcattttgacaaacaagtatcaaatcatgaattttctgaggcagttctgaagtaaacagcttacttaaagtatctatagtaactctttttacaataagagttaatacatatgtgtccaaatatggaagtatgtcagtcagtgtcatgtctagcaaataaccacatggctaatgggtacaactaaaaaagccaaaaagcagatagtaaaatataaatttcaatattgataacaaaaaaaaggaattctactttgtgccttgctcaaaggaaaaaaaatctacctactttaatacttactaataaacaaaatctaaattatgactgaaatgactacattctagtattaagcaaacacgtgctgaatgctcaatatctgtatgttgtcttttaccatgttctaaggattttacacatggttacttattatcacagtctataaagttggtaaccagacttttttcccataatgaacttaatcctattccccttaaatcagtgtctagtacactgctcagttcacaacatatgaatgccaaacaacagcaatatagactaaggaactgaactttttcatagaatgaaaatcaaacaaaataatgccaatgggtagaggtggaagcagttggtagtgtcaagtttgggtgaagacaggcagaaaatcaaaaacaaagaaagaaacataaaaaacaaaaaacctaggcttggatccaacaacataaaacatcggggtaaaggtttgccttcacataggagaaggggaaaaaaagaaaaaaaagattgtatatatatatattttttcccactttcatttcctgtcttaagcaataaccaaagactaatctaatgactctaatatggggttacttttgcccttgataactgcagtaatcatgagtatctatgattcttgtcaccaagccatttgcaaatttaagttcttggaacatgttatatataacgatagatacatgttaaaatgatatagccatgtaaagtgacaggattttcttttaaatgggttggcttttcctaaccagcaaagaggaagaaaaaaattgcttatttattagacaaggaaatgactgtaatggcacaggataggacaaaggcattacatcaaataaacaaatgtaaagtttatcctatagaactggttctcaaccagtaccatctaaccatctccatccccccacctttggagatggggtagttacagaggcaatttttttgatgtcacaatgactgaggagtgctaatattagcacttagtgggtgggaggcaaggatataagctttttgcaatgggaggatatctctgtaccatgaagattggtatcactcaaaaatgccaataaaacactcactgaggccactgtttaatagcatacattaatcactactgcttgtgaaggaattcaggtcacttttcaaaaaactaatcttcagtgaagttaaatagtattatataagtaaccacaaataacacaggtcgttattttattaacctactccaaaaacacagaaatagttttaagttttgttacacatttttaaaaagatttacctttaaatgaaccttttaacaggttatcttgaaaaggaaagaagaaaatatctctttgggaatccaagaagccaaaagacaaggcttcattacaactatcttcattaaaattttaagatactaattatcaggtgatcagtttctcttttaaaaaaacaaataatatgcaacagagtaatggacagtttcgaagaatccaatagatcaagggataagaattaaatcacaatctgtagctccacctgtgactatcaattcagaaccaggtgggcccaatcccttttgttcacccaaaagttcctaaaacatgaagaacttacgctttctccaattctcaacccaaatatctaagtatctggtcatgttaagtgttgatgtcaactatacataccatttaaatagcaatgtcttggctacatccgtttttccttgtttatattcagttattgccagagctgtcaagatatgggctttgtcttgctccgattcaacaatagacaaggctctctcataggctgttacatagaagtgaaaacaaacaaaacaatataaaagccatcctgattgatgaagcatgggatttttcctttccaaattttttagaaaggtctaaatacaattatatctttgtattctcctgttctcaagcagatagaataaaaatttataataatctaacttgttttcactgttccaaggtgattctgaagtatcattaggattattatgtgacaatccctaacttctacgttcggaatctatatggggatctaggtcactgtctttacgagccaatttgggtcagaagcagaggcctgcagccactgagatatcaccaaaactcccacgtgcagcccagcaactccatcaagcagtagatatttcaatgctctatacacatgtgggctaagcccatatatgtgaaaatgcatcatataacatatttggagaaatcaaaatctattactaacaatggttgaggtcttcatttatcagaaattaacatctaagcagtgtagagtagtaaacatttgttttcaaatgctaagtcacattatttgccataagtgatcttgggccccagtttcctcatctgtataatgaatactcagctcataacactactataaagactattcatcataataacattctaaatgaggtaacagataaaaaagtgcctagtattgctgctgactcctagtcagattttaataaacattgcaacccccaccccatctcattattacatctttctgtatgtgtgctcatcatgattaaactcgactctaaatgtgtccttagcttcagagcaatatacttacctttgctgctctctttataaagccccttcatgaataaagccaatgcaaaacctatgatgtcttctaacacttcaaggggtgttgacttaaaagcctggatagctttatcatattcaccagtggaactaagaagtaaagcacaacttacttttaatatcaaaagtaattctggtgtgtatcatcaaaatactgagatataattacactaagttgggccggacgcggtggctcacatctgtaatcccagcactttgggaggcccaggcggggggtgggggtggggggtggggggagggggtggatcacaaggtcaggagctcgagaccagcctggccaacatggtgaaaccccgtctctactaaaaatacaaaaattagccggacgtggtggcacatgccaataatcctagctgctcaggaggctgaggcaggagaattgcttaaacccaggaggcagaggttgtagtgagccgagattgcaccactgcactccagcctgggcaagacagaacaagactggtctcaaaaaaaaaatttacactaagtttcttttgataatttcatgtgtacttccttttttatagtggtctactaaattacgaagtgtctcttttttttcttaacaagctttaattaaaatcccaaattataaaaataatttcaagttgactttaatatggatctctaatttttttaagctgaatacttaattaaatattaccctatgagtatgattctagcatctttgccaagcttaacaagtcataaaatgcctagtcagaatcaaacctatcttttgtgtaaactgtttatctgcacattttttttttcttttttggagggcatacagatacactaaaattccacaaacaaaatattattcttttttgtgtttaagggagaggaagccgggcacagtggctcacacctgtaatcccagcactttgggaggccaagacaggggcatcacttgaggtcaggagttcaagaccaacctggccaacatgatgaaaccccgtctctaataaaaaaaaatacaaaaattacccgggcatggtggtgggtgcctgtaattccagctactggagaggctgaggcaggagaatcacttgaacccgggaggcggaggttgcaatgagccgagattgcatcactgcactccagcctgggtgacaagagagaaactccatcttaaaaaaaaaagagggaggaaaatataaactgtaatatatactaaagtgcaatacttattaataacagaaaaataacttgtttttgcctaaagataaaaggaacttgtataagctcaactgccatcatctgaagagaaacactatatctttgagattcttctttctggtatccatcactataacctgaatctgtttttatttttaatgtgttgtggaaatctttttataaaatctttttaatcttggaggatatgaatgggggctaaaaatataggcaaccttcacttctaaataagttttctaaaggtgaaaggaattataaaatcaatactcaaattttgataaaggaaagaggactaccttagattgtttttggatacatacatatatattaaaagtatttctttaaataaacactatcttctaagatgtgcgtgcttttgtggagaaaataatggaactacagaagggaatgtgggtgcttccacaaatctatctgaaatttttttggaaaaagtaacctgaaggccgggcacggtggctcacgcctgtaattccagcaccttgggaggccaaggcgggcgaatcacgaggtcaggagttcgagaccagcctggccaacacggtgaaactccgtctctactaaaaatacaaaaaattagctgggcgtggtggtgggcacctgtaattccagctactcgggaggctgaggcaggagaatctcttgaaccccagaggtggaggttgcagtgagccaagatcgcgccactgcactccagcttgggcaacagcgcgagactctgtccccccaaaaaaaaaaaaaagaaaaagtaacctgaagcaagctgacagaattttaagatataatttgattggtgacttttcattaaatgattctattacttactgcatgtttgcacatttcatacatttcataataaaagtaaacttaaaaaaaatctgttttcaatggaaggtatatattttcttctaaaatacttacattagtacttagattatataaaacatcaaaactaaaaagaacagatactttattctacacaatatctgtcctctgcttcaacaaaatcttggaactgacagctctatcaacttttaagtatttttttcaacttttaaatttaacagtttaaaataattgaaaggagaggcagtcagaacagttcaatcttccaattttggatataattcaggtacacaattataaaagaaaataactggctacctaaggtctgccaggtagctccttaaaagatgtagcactaatcctaagacatcaaagtatagttctaacagtgtttttcaaactgtaccattcaactttagggcagctctaggatgctgccttaacttgaatcaaaaaccttcctcctacaatacttctattctctggtcctagttctaccctctaaaacaactggttcttaatctttctttcttttattcttttttagagttagaagtctctgaaaaactgaggaaagatatagagctcattccccatccccaaaaggtacccacacaacaatttttgtgtactgtttcaaaggggttactggacccctaatgtccctccccggtttaataatatatagcaaatcagaataaatctaattcctcttccaattaacgaggcttctactgttagagacagtcactacctctcttccaaatgttctcatctccagtcaacaaaccatgagttctaactctgctccacataaagcacactggggttggttaccattataggtataggaaactgttaacagagcctgtttctatggaaattatgtatcctacatgtaccagtattctaggaactagtcagcatatcagcagtcccatagctttcaccagaaaaatacaatcaattgacagaattaatggagaaaaaatacgcttaccataacaatctgccgtaatttcttattgcaacattgtaagtatcttggtcttctgcagtctgtaacaacaaaattgcccttaaaaaaaaaaaggtattttaatttatctctgtgcaatagcattctgttaccttcctctttagctgaatccacagatttttgttcatttaattctactaattctttggtgctagttacaatagcttattcatattttattaagttggtaccacaaaagcacttatatatatttagattttagactttcaggaaaataacatctaaataacctcttagtaagtgaaatcatatatgacatttgagttctaaatattccaaaaatctaaatataggaaatgactatgtcacagtttaaagttttgacatatttggagtttatagaaaacacccttgaaactatttatatattagtagtttgagttaggaagccaggaaattgaatgctttcatgtgcccttgcttgtacatacagaaaaatatttaaagaaaagtaagttgagggaaggggactagtcactagaagtccctcaaggattggaataaataacctgctgacaacgtgtatttccttctcatgctcagttccctatgggcaggcagggaaatgtcttaacgactaaaaagagttggatatttaacaagatttttggtttttattttctttcccatttaaagacgactggctagggagaaatagccaagaaagattttttatctccctgatgttgcatgaaaaacaagaatttgctagagaagcctaaagacagtattatagagatgaaaaactatacccttatttagatttatgcctaatttgtggcttcaaccatcaaatagttgtttaaagcagaaaacagcagtgatgatcagtcaagaaagtggtacatacacccaagtgactgtggagatgccattttaagcctaaggtgtaaccaatgttagattcacaatatctgcaataataacgatacataccaaaaaaaaaaaaaatagcaaacaccctagctgcctagttttctctgtttaaaaatcttgctcactattgcagtctgtcatatttatacagtttactggtaagtttgttggctttgaaagaagcaaaatagtggtttttcatatacactcattttcatatacttctttccatacacacctggaaaaataacttcttgattacacaggctccagtaccatctagtgattactcctttgaactacggagagatccataaaagcatatggcaaagcattcaggacacctcaattattttttacctgacaaggcttcttgtaaatatttatttagatttagggcaataatgtgcctcagagattaggcaaccaggtctttttacttttcacctagtagttggtcatgagatcaatagttattttcttatcacctatccattaatttacatagaaatttatgtagatttcatttcctaccactctccagctggtcattccattgtagcacactggctttcttattttgtaaacatgccaaatccactcctccacttctccacttctcttgctgttccttctgcctagaatggtcctgcctagataaacaagtggcttgtggcctcagttcactgaagtcaggcctcaactgcctccttagtaaatctatccattcttaaactcacctgaaatgtcacttcctgccctgcattctctggcccttttccctactttaattttctttcttagcaattactatcatcacagatgtttattagcttatcatgtctcttcagccacagaacacatgctccatgagaacagggcctttgtcttttttaatttactgcaaaataatcagtgccaagaacactgcttggcacgcagtagtcaaaaaatatttattaaatgaataaataaatacatagtagatattaaagtcattcaaacaaacacatcacaatgttctcatttcttgtctcattgaacacatgttcaaatctaataaagctagacaagttcttaaaagacagacttttctaaaaatctgagaagatttttgttttgtttcatctttcttttctatcgatttctctctctcaatttctccaccccacctccttaagatgagcaacaaaaaccaaaatatagctgaaaatttgggaacacatcttttcatcttctaagatgtaataatagtatacaatgaaacatcaggaaaggagtcaaaacaattatttagtaccttcttcccgagaatgaaactaacatttgaaaagataaccgataaacaatgataacattgcaattgatgtagaactttgttccttagttcagctaaaaccgggtccttgtcacacaaccaggaaaagttaggcacgcagacacactgaagggtgaggggaatggatttattgggtgaaaaggaaaaaagaaaaaaaacctctcagcaaagcgagaggggttcctgctaacaggcccacatctcacagattgattccaggccacgcacccaagaactgaagaggccaggctcctccccacctgcaaatggcgtgaacatcccctggcttcacccggttctcccaacgcacaggccagtcagagattctccaggaacccttcccctcatcttcctcctgcatctatcacaattaaatgtagtttacctttggtatgcatttgctgcttcctttttcagttgtagatgttcgtttaagtaacccaacattgtgaaagctggggcataattctgaattctttctagaaaatgagaaatatcttcattttaaatatgcctactgatggtattaacaaaatattcgttttattttttcagtatcttaaatatcagattacctcttgagatcactcacactgttaagaatagtggcctgattttatcttgaatataatgtcagtaaaaactttattaactctaattactgaataatgtttaatagttatatttgatttttagttgtattttagaatttaaacattttatgcccaaaggtataataacttgaaattatagttcttgttaaaaccagtcatgagatttataaagatattcagttctttggctaattacttaagccttcctgtgattaaatttagcaataatttctcttggcggttctgttccaacatgtacgtatttaaaaaaaataacaaagtcagtattgtacactagaaacagaaggtaagtttggtactttcggtgcagtattttgaaattttaatgtcaaaaaacataatgtatctgaaaccaccatttcaaaattataactgagacagtgacagaaatccaacctaactccatcttgcttctaacctccatgctgtcctcgttcattcctgggcacaggctaaactaactttgggaggaacttggtttatagtttatagtttgaaacaaagatgacaacagccctttcccaaaacaaacccccttcttgcctagcgactagacctgcctttgcaggactactgaattagtcaaaagattaattatggtttaggagtcatacagctggaggctacaagattctgaccctccccaaattgttcctggggataacatcactattcagagcctgcacttgatggatcagctggcatcacccagattgataaactggctcatctgatcttgtggcccccacccaggaactgactgcgcaagaagacagcttcaactccctatgatttcatctccaacccaactaatcagcactccctactcactgcctgcccaccaccatccaccaaattattcttaaaaatgctgatccccaaatgcttgttcggggagactgatttcggtaataataaaactctagtcctccacacagccggctctgcatgaatttctctttttctattgcaattcccctgtcttgatatattggctctgtctaggcagcgggcaaagtgaacccattgggtgattacctatctatgaaggtaaaatgtagaaaaagaaatgtatctgatctaatgtacttaaaagtagtagtggaaagtaagccttcaaatcctttagattatttaacaaagtacactgtaaccatatcttttgtgattgctaggttctaagatcaacaactaaggttaaaatcaaatagtcaaagttattcttgaaaaatccttaaagtcacaaaagaaagagtcaacaaaattgagtcataataagcatgagggccaggcacagtggctcacgcctgtaatcccaacactttgggagtccgaggcgggtggatcaccaggtcaggagattgagaccatcctggctaataccgtgaaaccccacctctactaaaaatacaaaaaattagccgggcgtggtggcacacacctgtaacgcctacctgctaatcggaaggctaaggcaagagaatggcttaaacctgggaggtgaagttgcagtgagccgagattgcgccactgcactctagcctgggtgacagagcgagactccgtctcaaaaaataaataaataaatacaaaataagcatgaggagatccatgccttcacatgccacacccaccctaaggcaaacccccccaagtgctgatgtttgtaaattaattgcctagtctagtgcctcaggctaaatgcatgcagagtgccacaatccccacaatatctacagtgaggcattttctctcctgtttttcacaatttatctgattctttatattatttgactgccaatatttactgttttcagtactcttgcttaaactccttgcttctttattagcattttgtcaaaagttaatgaaactaacatttcttgagcatctaggatatgccaggcaccctgcataacattttgtacaaatcatcttgtttaaacactaagcaataaacactttcctgttgagaattttggtagcatgcccaaggtttcagtcaaggctactaagtggtggagcagagattaaaacccaatggtagttttattaaaaaagacggaattattacaacagatggttaataaaatttcaccactctgtcaacttcctaaacctaaatgtatctttccaatatcttcaagaaaaatcaggtgttaagtggggaagctaaaggcactgggtttggcacttcatttatattatctcatctagttctcacaactctacaatccaggtattgttatatccactatccagggagtaaacagaagttaagggtggtaaaacacttggcctaagactgcagagaaagttaaaggcaaagcgagaacagcagcaactgttctagtgtatagtgtatagtggagagtgtattaaagcctaatacactctacactataacaaggaaattacttttttcttgcatcattaggtaacaatttttatctttcttcaaaagcctttattaaagtttacaaagtaaagactgcttcgctgttgcaaaaagaaggcaaattcatgtcttaaagaataccaatatttaatttgacatgaattaattttaaaaattatttaaattatttcaatagttgctcaaatatcttgctattatataacaggtaccttacctacatatttattcaaaataacttgtgctgctggaatagcattcatctggaggatgttgtactggtacagctctgtttctctgttgcttttatcttgcaatgttgtgcagacccaatacgcataacctaatgctccttcagtctttaaaaaagccaacgttaagcagacataggataataaatgtgtcaataaaaattataataagaagtaaaacaatgcacttcaatacaataaatatcacatctcagtgttctttaagtcaattgttaaaagtacctttaaatgaagggtcactatgataaaacacagcgaagaacatattgaaattatttgctccaatcctaacgagaagaatcaaacgggataaaatgcagaaaacagagccttgcctgatgggctggctttcccttcctcagcaccattgccaaaggtcagaccaaaaaaaaaaatgaattctacaacattttcataaataatctagaaatgtctaccatgcctactccttatctcatgtctatctttttcctagagtctcagtttctattctattaatatatgactgctactatatctattaaatctaaacatcatttcttcaccagctcttgaaagttgtagaaaaaagaaaaatggtagttctttaattcgagaaaactaatctgtttctaagaaagaataaagaataaaaacaactgatgtcattaacatctaataccactatctattcattttctttttccttttcttagagacagaatcttgctctgttgcccaggctggagtgcaatggcatgatcatagctcactgtatcctgaaactccaggactcaatcctcctgcctcagcctcctgagtagctaggactacaggtatacaccatcatacctggctaatttttaatttttttttttaagagacagggtcttgctatattgtccaggctggcctcaagcaatcctcctgccttggcatcccaaatcactgggattacaggcataagccactatgcctagcccaatatctattcattcccttaacaaggataacacttttctcattaatgaatcctcaagaagaatgttcagattcttacatgcatatttagttctgtagtgtgcctgaagagatccatggtgtcataacttccaactgcctcagcaataagagcctataaaaggaaaaaaacagactcttaatgtgtttaaaagacagtaacaataataatacaaaatgaaactgtctagaagaaccaaaggtttactagctgagcttaaaagcaaagttaacctaagtttttcacttctattgttattattttaactaaatcttccagttacctgctaaaataaattatttttaaaaccaaaaatacttttaaaataaaaattaaaaagtgattctgataatcatctaagatctactgagctagagcagtactacgcgaagtgaggtcccttggaccagcctcataatcatcacttgggagcagttagaatgcaaattcttggactccctgggttcaatggctgacacagaggctagcacagtaacgccactgctcccaaatgctaccacagtgaatgggaacaggagtttgcctttctagctctgcttgcttcaccaattaactagaattaggcccaagagtctaaaatacaacaaaagatctctaaaccctgattaataattttctgataagcaactgactgcttactaattcattataatttctcaaccaggcaagaacttcgaggccactcagtctaatccccttctttttcaggtgagaaaattaaaatccagaaaagtgatatgctaaggtaaaaaaagaaaaaaaaatcagtaggtaacagactcagactagtaacaaagtatcctgattcctatttggcagtacaaaaatctgaatttgggggaggaaagaacactcataaacaagtgacaaaccaaatatgaagattttacagaaacataatattcaaaatgatctttgtaaatgtgcattttctttgtacatgtgagttaaacaatagagttctgggtttattttttaggcacagtaatgtcagactggtaagtgttcaaaggccccccaagtcagagttaaatccttacaagctacgtggccttaggaatgacacttaggagctctgagtttctatttccacaactataaagagagtataacatcaaccatatctcaaagaattgatgattgatagattaactgaaatagtgtatacaaagagctaagcacagtgactggcacaaagtaagccctcaaatgctatccgttaccattattatcactgttatgcatattagtcagttattgatatcaacaagcttattagtaactatatgttatatttcttacttgtccaatccagcacattaaataagatggatcaagggattgagccattttgaaagcctcatgagcttgctaggaaaaaaaggcaaaaaatattacagcaagtcattttataaacttattaaaccgcttatgtttaaaaagcataaaataagtcaaacctctcatcataaatatgtatgaacataaaatttcactgtttaagcataattagcaatgcttaaagcagtgttttaactacacagttctggaacactcctgggtgcaacagatttctccccaggttaggagttctgaaccctagcaaaaaagggttctaccttgtcatctgcagaacttttaaccaaccaatcatccatccattagatagccataggtttgaaggcaatgattaaataaggctatctattccccttttagcttaactgggaggataagaactcacaaccaatgaagtcctaaccaatgaagtcctagacatgtgtatacctgctaccagagaaggagtgatcaacaacataattctgcattaagcaatcaggaaacttcaaaaatatctaatttggacacattaacttggatgcttttttttctgctacaaaaaataactttttattacatactgctttatactattttctcaacaatctatgtatggcaggaaacagtcttatttttcctatttttaaaaagtaagctcatgggcaaaaactatcccatgctacaataaaaccacatccatagcttattaagacattgttttatttaaattaaaaaaagttcacgtattttaaaatccaaattaatattttcttcaatctatttacaattttctaaatccagtcttttttgcagggacttaatgtatccttgagaatattgagaaagctttttgggatgagattcaatataccagctgaaacacaaaacagttcagacatggtattacctatagatttatggaaactttccaaacatgacctataaacatactcccagtcactttagttctaattgcctaatgtataattgctcaagtatgacaaattacacttgctatttaaagagattaatatctactaaagccaaaatgtaaagcatccaagaaaggttaaatttaagctgctagagagtactaactgtctcccttgtgctcatccactccacctccaacactatctacataggacttctcttacatgtgtacagatttaaaaaaatgctgaattgattcagaatcaaactgttttaatctctaaatgaaaaaccaacataatcacaaaaccagaagtttcttgaaggtcataaaaaggaaaataaatcttacacattaattattcgacataaattgaatatcatcaattaactagcatactggagagcatactggctagataacgatgtgcaaaaacatttctccacaagaagctgagctattgaggagacaataatatagaaaacattctttgttttaaatatgacagacaggcaacatatttacctcaatgttttcatttgtgaggtataacactcccaagttggtccatgcaacagcattctaaaaaacataacattttttttcttaaaataggccccttgtctagttgaaagtctcagaaaattagtaatactaaattttgaagttctttttcatagacacatagaatactcacaatttgttctgactggattgatttgatgaaacagtgctgagcaagggcataatttccaatacctgaaaaatacaaaacctgatgaaactgaactttgtttgaaatacacaatcttctaaaaatattgaagtgttactcaattctcaccactgtaacatgcaaccacaccaagagcattccagtataagtgattattactgtcgagtctcactgcttttttcagacactgaaaagaagttaaattagattaatttttatttcttggaatagcagcatgtatatcaagatatatgtggttttatgtgaaaacactatttacttcatccaaaacaacttcgagaaaagcattatgtttttgaaaaggtttataaaaaatttatttataccatacatgtaaagatttctccagcaactccttaagatcattcatgttgctgcctgtttctgctagatgttgtgcttggcgataataattaattccaaggtcacaccatgtattagatgtagacatcagttttaatgcacgaccataacacctacgggaatataaaagtgaatgttttttgttacaatgccttaattcaattcaaatgttattaactggcaatctttgcaaattaccttcctccaaggtggaggagctcatttttctttaatacttgttttccttctttctgacctagaaggactcctaaaacatgaacattcactttagatggtgcgacagcatacagacaggtacaagcatccccagctagcttccagaggcaggacacatcagctcgatgctgtagagcactaaaaaaagaaacattgtgattcttacaaattatttataaaaagcatgaagtttatctccctgattattacttaaaacagaaaaactgtacattaagtactttactagtctcctcctaactgaatcatatcatatcacctccctaataggaagggaagaagaaaaggagaaagggaaggaggaagggattactttaagtgccagaaattttgtggacacttttttttgttactcttcaccatttttattagaagtagcagcaatcacgcaaataaataaataagttttccaggaccaatttccttttaatattaaaatgttaaaactatgctttttgtgtttaagcaatgaccaaggcagtaaagtttgtaactctcttacaactgacagttgtaaactcaggtttttgcttttagatcttctctcatgctgtgtagttttgactacatccccacaaagctcatgagttgggaactcaatctccaggacaacaatgttgagaagtaggacctttaagaggtgatgatgtcatgagggctctgcctccctaaatggattaatactgttattgtaggaatgggttagttgtcacaggagtcagctcctgataaaagggtaggttcagtcccattttttttctcttgcattctgcccttctgccataggatgaccctcaccaagatgccagcaccatgctcctggacttatcagcctccagaaccaagtcaaataaacttctgttctttgtaaattaaccagtccatggtattctgttatggcagcaaaaaattgatgaagacacctcaaataaaatataccaaatatatttggtaagatctgaaagatttttgtaaattttattttttaattggcataactatatatattgatgaggtacagagatgttttgatacatataatgtattgtgatcagatcagggtaattagcatattaatcatctcaaacatttataatttctttgtgttaggaatgttcactatcctccttctagctatttgaaactatatattattgttaactacagtcatcctacaatgctacagaacactagaacttattcctcctatctagcgtaattttgtgtcctttaacaagtattacccatatatcctttccccctacccttcccagcttctagtatcctctgttctactttttacttctatgagatcaattttttttttagcttccacatatgagtaagcacatatggtggttaactttctgttcctggcttatttcacttaacataatgtcctccagttctatccaaattgccttaaatgatagcatttcattcttttttatggctgaatagtattccattgcatataaataccacattttctttatccattcatctgttgttgaatatctaggttgattccatatctcgactattgtgaatagtgctgcaataaacatgagggtacagatgtctctttgatataatgattttctttcctttggataagttcccagtggtggggttgctggatcatacggtagttctatttgcagttttttgagaaaactccatactgttctccacagtggctacactagtttgcattcccataaaccatataagagttctctcttctccacatccttgccagcctttattttttgtcttttgaataacagacatcctaactggggtgacatgataccttactgtggttttgatttgcattttcctgatgattggtgatgttgaacattaataccctgagaccaaaaaaaaaaaacaaaaatctaaacataaaaatctgaagaactacatttaccgaaacaagagcagactgaatgaacaagctcaaaaagcaaagagaaatattaattatggtgacagagggcaattccttttagaatgagaaaaacttcagctatacatttttcttcatttttctcttctcgagatcttataaataacacatggcaatttcatttaagccaagtctcaataatcagctatcacaagctgctatgttactggcagatggaaaagcagatggaacatttttcatagccttttctactcatggagtccagccaaaaataattttccaatgtcttcctaagaaataatattaattattgtggtcataactaaaagcccactgagaatctgaaagaagggcaatatgatttggagttcctttgcctaaatatcttagcaaaatttctaaaattgacagcaaaaaatgagaagagaggaaaaaagtgaaacaggcgattttaagagcctaaattcttattttgagttcaataaaaataaaatatctataaattgaagtaacttatatcacccttacacaataattgtgatagtattaacgccttgtaagtctggaagtaaatatacatttggagattataattgttttatatgccaccttctaatgggttatgttacatgttatccagaataacatttcctaggctcagagaggcagtatttatagctaaggtactgtcacccaaaggttcacatttactcttaaatagcagttcaaataaagcatgccctttacacagtaactttccctttagaaagaactacattatgtgagacttgaaaagtagcaataaaattcagtgagataaaaaagggttaggttttcatttcatatttggttcatatgaaaagcaattctggaacaaccaataaatacaaaacagaggagaaaccaagcaggaaaagaggggaagtagaagaaagatgtttaagagttacaaaaaattcaaatgtacatctaacttgtggacttttggaagtcttctaccacagataacactttttctgacctaaccaatgaattcacagttctataaaatgccaaatctactcaaaattttctgattcctttcttgttattagacacatcacttttttccttcacagtttctcctcaggagcaatcagattgtcatttccccttaccttcaagacctactaataatcctacaattggctcttaccactgaatgtacagcatattgagcacctgaagccctatttcccaatcggttccaattaaagatactcatttccaggcctactgaaagagaacactaacacatggtgtcagagctgctgttccactagcagactgctccttccttcctattctttcctatgcatctaggatgccagccactactaagagcagaagaaattatatctgtttccccaagtgcaaaattaatacaacatgtatgttatagaattggcttgtctgttattctttatgtttgacattctgagcaattgctatatctagcagaatacataaaatgatcttctaaatttggcttcattttaatattacaaaaataaacaataaataataagaataatacgaaccaagtaaaatattccagtgctttttctatgtagtctacggcttttccatcaagataatcaactagagctgcttttgccatcataagatggcattcacccaaacctaaaatcaggtaagtttgtcactgttattaaaacatataaaataaacacttaaaatgaacttcaaataaagttattggtgttattttaaagcactttccagaaaataaaacttaacggtgtgttataaaattatcttaaagcatgatcctacattcactcaataagaaattcaaatggaagaattctgttggagtaaacatgcactagaagttataaaaaagttatctacagaacccaagaatttccttgactttgggcaagttacttacctgctaaaactttggctacaaaaaatgtggatattatctatatgttactctccatgatattactacttattaactattgtgaaacaagatatgatctttttatattaaaatctgtatagcaagctatactataagaattaaatgaaatagtgattacctaaagttcctagtaaagatttcttaaatgtgagttctccttctcttgaggaaagagttttacaaaattaaaaaaaaagtttcaagccctaagttatatgtcatatacaatatactatttatgtgctcacttcagcagcacatataccaaaaccggaatgataaaaagaagattagcatggctactgagcaaggatgacacaaaaattcataaagcattccttaagaaaaacaaacagaaaaaaaaaaccagtttctttaaaaaggagaaagaaggaaatggaagaaagtaagcatatataatgagctcccagcttttttaatacaatcattacaaatgtaggttatatatggatggtggtattttattttatattaccaaaaataacttagataactacaaaacaatgcaagttgtctctgaagtttaaaaaaaatttaatgagcttgtataacttacaaagtaattaaaggtattaagatattctggagacatgatgaattaattatcaaaatgtaagagtagggaaacatgttttagagatcaatttttagatctaatagttatcatactgtttgtctaaaagttaaatctctgtcacattactatttattaacttgtgaaacaagatttgatctttttatattcaaatttatataagctatactgtaagaggttcatatggatgcttgctgttgactaaagaagtccttttcaagttattcaatacatttaggcaggaaatctactcaaggattttatacttcaggatcataaaagtcaaaggagctactaaaaataaattaccttttaaagcaggcacataatcttctttctttttaatgatcatctggtattgagctacagcctccttatatttgcctaggatttgctgtattgctgcaaccttaaacacactgtatatggattctgggttcagctcactggcttttgtgaaggacttcaaggctgttgtgtagcctcctctgcttaagtatgcttctcctaacgattcccaacaattgaagtcctttgggtctgctcttaatgctgcctgtaaactaaaatttaaaaaaccgtaagagaactaaaagtatggaactatctccaaatctgaaaggaaaatataaaataaataattcaagtaaacatatatatctgtggctccttctacttataaaagtgctatttaaagcagataaatttgttccttttatgatttttttaatgctaagaaatgttattttaatttcagaataagaataaaatgctttttttgaaaaagtgctgaacaaaatttcttttccttgattatcttgaagaactcgagttttctatcctaccaggacaggtgtccatctcagtttgtcacatcagcccataatcccccaccagcaatccttttaccaaacagaaataccacagttaaaatatggaaacaataggcatgctttaaatatctgatcaaattccatttccgtgaaaatgcctgtactctagatactaacataaaccagaaacaattttattttgattcaaatacatttatttacatttaagtactgttcaaatcaaatgactcaaattgatcatatatgagctgctcccaatgccctttaagctgccaaatgtctcccttgccaaaaacaatgtgtgtcagcagaacaacaaagatatgtacctcagcttctcatcactaaaatttctattgagaactactatacatatgtattaagacttcaattcactaatctggctatctcctcaacaacaggacaccatttaatccatctctgcaattccactgccctgcaaacaataaacaccaatcaatcataaagtaattttgttatttcttctctcaaaatacaacctggtaagagacaattaaaatgcttaatttaaggaaccgttatgcttgtctaacatagtttaaatacaataaggtgccttactcagccactgcttgagaatgctgaccagctttcaaatagtatagtcctcgcctaagccaggcccattttgccgttccagcacttgccttttgagttactgttgttaggatagctaaagccatttcctaataataagaaaatactaatattagatatattgaacattataaaaagacagaacgctcatgtaaagtacacaaacatattttcatttctcacttctgattttttaaacttacactggtatacatcaaattacagtttcaacaataagtggttagtaatttaatatctgccaatggaaaaaaacttcacttacagaggcaaaaatatttatattgcacctatagaaaaaaaactaatgataactttcaagtatacatatataaaaatattttcatttatatactcaggataaaaaaaacaaaaagcaaaagtgattattagacataccatatcttcaagctccacacttaggtcaactgctgcagctccagattcagcatcagtgtcatctaattcaaaggctttcctataacatccacgagctctgtttttatctcccactacgtctctataataatgacctaaatagcagaaaactttgcccatatatgtatccagtcttgcagcctttgaaataaatattgataataacagaacattaaaagttcatttaatgagtatctttacaaatacagaagataaatacacagattaaagaaaaaagaaataatttcattaaacatacaaaaatatgccaaaaaatcctttgatgtaagatttaaaacagacaggaaagctgtccctcactgcttatagaaagtaaaaggaaatataaaaatattttgttttttggtaaaggaaatgtgaaattagagctgctactgaattaatctgctcttacaagtcaagataagaatgtaggacttatagatgttaaacatctaaaaaaacaggaatttaaacatctaacttgtatgctcataaaactacagtgaaaattaccttaaaagtattgtttacaagagataattatgtctcgttttctacaacacatgcttttcaaaaagtaactttcacattttatgttttaattttttccttgaaaacccatataacaccatcacaaaacctgacatatgaaagataaagcacaaaaaacagttcagtaaagagtaattgtaactaatgtatatgattattatttatgattttataatgccatttcaactaggaattgaattgtagcacttgctttaccttcagaaagtgggtaagagcctttgttttatcttttcttgtctcttcacccatgaaccagtatgttaatccaagttggtaatgatattctgcaacttcggtatctttctcaagagctctctgaaaactaagccaccaaagggtaataaaaagaaatagtaaaacaaatacacacacacccacacgcaatataggagactcctagttggaacaatcaaagtttgagtgattcagaggtgccaaattagaaaccaatcatcactttaggatttatattatcataaggaaaaaagtgatttgtttttgaagaagaggatcttaaaaaagcacagtggccttttagcactaccatgtgctaagtgttcagactatactgaacattacatctgcttagtgaacattatgatcagctgattagatttttttttttattttttgagtccgagtcttgctctgtcatccaggctggagtacagtggaatggtcctggctcactgcaacctccaccccccaggttcaagcaattctcgtgcctcagcctcctgagaagcagggactacaggcatgtgccaccacgcccagctactttttgtatttttagtagagatggggtttcatcgtgttgcccaggctggtcttgaattcctgcgctcaagagatcacctgccttggcctcccaaagtactgagattacaggtgtgagccaccacgcccggccaagatcagctaattagatttgaaacccatcatataattttttatagctactgtactacatgctaaatacatttctttaaaatactaaaacttaaagcctacaaagatcaaattcatgaaaaatcaaatcttcatcaagcctactcattttgaatttttcagaaatataaagaactaagatgtaaatggttctatgagcaatttatatatccttaccatttttctgcttgtagatagtcctttttggtgaaatgaatcaaagcctcaagggcatgaacttcagctaggtcagggtaagaagagagaaggtcttccataatctataaagtagacacctgtcaattctatagccaaataaaaatgcttttaactcaaaaaatgctcagtttgaataaaaaagccaacctttgcagcttcatcaaatgaacctttgttccgataggccaagcttttgagaaccaaaagtcctgggatattatctgcatcagaaatctagaaaataattgtaaagaactgctataaatctccttcaacacaaccacagcaatgtttgctttaattaacgaacgaacacagaaaagcatggtcctaatagaataaagaaatagaggtcctgatttctatcactaataacacatcttcactcttcataacctttttattaaggaaaatctcatatacataaaaaaattacagaaactagtataataaacccacatgtacccatcatccagctacaaaaccacaaactcacaagcaatcatttttttcatctatacctccactaattttaccacacttctgctcagatgattttgacacaaatcccagatattgtaactttttacctgtaatacttcagtatctatatctaaaagttcatttctaagttgcataaccacattaccattatcatacctaaacaaaaacaacatccttaacactatcaaatttctcagttgtctcatattttaacaattttaaaaatcaaaatctaaataagacacatacatttgaacttaatgataatgccttgtctcttttaatcaataaggtccccctccttctcttttttttttcttccttacaatttaactgttgaaaaatatggcctatttgtcacagtttctcagagtctggattttgctaaacgtattctcaaggtgtttaacatgttccttggttccctgtattttctgtatattagtagttgggttcagaggtttgaagattcccaaggatacttcaggtcttcaggtgtatttgcacttggttgtgtctgactgtctttttttttttgttttttggagagacaagagtctcgcttcgatgcccaggctagagtgcaatggtctgatcttgactcactgcaacctctgctttctggcttcaagcgattctcctgcctcagcctcccaagtagctgggattacaggtgcataccaccaagccagactaatttttctatttttagtagagacagagtttcaccatattggctggtctcaaactcctgacctcaagtgatccacctgcctcggcctcccaaagtgttagaggcatgagccactgtgcccagcctgattgcctttgtgtgatgttagtagccattaacccttgatgcctagatctattaattcactggggattgcaaaatggtgattttctgtcattttctcttattagacagaatacttcaacaaaggcaaatttctcctaccttcgttatttcattatcctgaggaatgattcagataaaggcaggataaatgcctttattcttcatagttgggttcttagcatccccccaaacatttgttttcttgaggacatttgctgagttttctgaatcatcatgaacacatggatttaaaatatttgatctgtttcaacataccacattagtaacgccctttttagccagtaagaatctctttatgctagctcttgagcccttttgtagtctgagcccttttatagtttcttgctttctagcatgacaaggtgttcttggttcatcttgtacattttctatctcagacctggactctgctagttctccaaaatagcagtcatttgtttttttgtgaaaacattatttgaaaaacctttataaagcattcacacaaaacacattattggtgggatggcaaaaagaaaacaagaaaatattaattgttgaaagatgctgacaacggttctgattttaaagaaatattatgaaatacaaagccctttgaaatacataaaactgatttaaaaactcaattttaatttagaccagtaatagtctttacctgacaaaaatctttagggcataatgctataattcataatttaccagttatagtttttttcactatggactttcaaattgctttaactcaaaacactaagaaatcggtttcattatgaaatatgaatctttctttgaatgaaacaaataaacattctctaccatgaagctaacagtgtccttaattattcttgtcaaatctgcagaacacttcctgaaggaaaaaatttggaatctcaaattaataataatcaagtagtaataacctaagagggcaaaaggaagaaacgagaatgaagtctagaactaacgaaatagtcttatatgatgagtactataagtccttaatcaaaaagcaaacaaataactttagaagttcccaaatgtatgaatgacttataaaagtgcagatgtggtgaattcatacctctaacacaaaatccatataagtaaattttgtggtaggcagagaatggttgttgcctggttgattggaaactaactagagttgaagaaaaaaacttgacaagtctacctgatcaagcgtacgaattgcttcctctgaagagtcataatctgagagtttaatcaaagcctctgctttcaaatgaagacaaagattcctctgataaagactgttaccagacgcaccaagattatctacgatcttcagagctgacaaaattaagggtatccaaatgaagacagccatatcacttctgtttattttttcttttttaaggatgacatataataaattgcagatacaataagcataaatttccaaaacaatatacatgaagaataactcaaagctaaatataaattcttccctgacttccttatggaaagacctgaatttaaaacagaacatatctgaatttaaaacctctatcttcacacaacatataataaaactgaatatcctaaaaaacgacaatggctatctatatttgctaaacaataaaggttagcccacaaccaaagcacctgtaacaaatataagaaattaaggatactggaaggggaaagcagctgaattagaatggaccaaggtgaactgtttcttagttacagggagcaagctaccaggtgggtcagaaacagtgaaccactttcatgatttcctatccccacccctcaccctgtcacattcaaataggctccaagatgcctaaggtttcccctctctatatgagagaaattaagaactcatgtgtcttggacacaccagaaacttccttgttacaaagacagaggacctccacacccaagcctaaactgactatgtcaatattccaaatgcaggaaaattttgctaaacattcattgtcagtttaaaaataaacacactagtacacatgcatgcagacttttatttaaacttattgaaattaaaattagcaatttaaaatacaaaatatagcattttggtttttaaaaatcactatctttgtcctttaagataaaaacaaatagggttggtcacccttatatgtcaacccaaaaagtatcaaaaataccttgactgcatgaaagaacagcttctttaggtctatgcattttgacttgggcttctgccagatgataccatccacttgtgcagacagggctttcctttaaccctaaaaggataaaaacaatcacaaaaaacaaggtttctgtgactacatagatgaacagcaccaatgcctactctccaaatcagactcctcccctcttcatctctcatatctcatcagtcacaaagtcacactgattctctgcctcaattcattccccaccatacatttttctccatctccacgtcagttcagacctccaccatctttatcccaaatcactacaagtgcttgccatccaccccaatgcattctttacactgtagctagaatatctctaaaaagacaaatcagattataaaattcccctgctaaaaatcttttactgattccccactgttgtcaggatactgtgcaaactccttaccaagtcttgctaggcccttctacaatctcacttcttgtcccctcctgtacatacacttcattctcaaaccctggtgaactacctgcagttctctgaacaacagttttcctcttagctcaggctatttcacagattcatctctgcctaaaatgttcttcccattcccttcaaccacctacctggcttgtatttaccattcagatctataatttgaatgtaggttcttccagaaacatcatacctagtaagactaagttaaagcctaagttcctaatgcatatatatctacatgtctgccttcctccctccctccctccctccctctccctcccaatttactttttgctttgctttctttcttttcttttttctctctttctatatagatatacctattttacaaatgaaaacactgacacacagtaagtttaactcttctgaggtcttgaaattagtgataagcagagtcagagttcaaacctaagcagagtccaaggtatgcaggtacattttttcccttccaccttagatagacattccttaaagaaaggctcaaagataaatgcctactgactgaataataattatacttcacgttacatgccatacactgtacatttaccttctgttaggttcctaacagcatcttcatactttttgtcttgtaatgctttaatgcctaagccaatgaggcctggaccactttttgaatccatttccactaatctacaacaatactgctgcccctcatcagtaagatttcctggaattaaaaggaaaggttattagtatacatatatcgagtttctaaatgcccaaacccatattcttaaatctcaaaatctgcctttatattcttatgcattcttcaccacatgctgactccagaaattcaaaatttaaatagaccagcaaatgcagaaaatattaacatttaatttaaataattatgatttttcatcttcttaaatactggaagtagaaaccactttaggatttcagacaagaaacctgctacttgccagtagactaagccacatagcctactgcttgccagctgtaacaatttggttgtcaaatgaaggagcccttgtcaaagcagagtgtcttcctcaagttctcttcctgggcaaccatgcgctgctagagacatgttagtcagatccagcagactcttccagcatccaaggatcacaagataggcgggttactcatcaggacactgcacaaagacttagtcacattcctcttaagtctacaaatttaccagtacatttccacatttttctaaaactatctttttctatataagtgaattgtgacacttatgagatagtcatccaatgcctacatttattttattttcaaatttattttggtaaaatagtttagaaaacattatatattttgtaatatttccattttccccaatctcaatcccacaaaagcatcaaaacaaacaaaaaattgtaatttctgttttagaataaattgtgaatagcattcacaagtttaataaatcatttaatcacataggagaattcttaaaaagacaaactacaacttgaagcaataaatatgggaaacaaaaaaaattcctgaaaaaaaaagacccgatgctttaataactatataaaacatagaagcccaaaccacatgtagaaccactgtttcagttacagatgtcaaaggtaaattatttgcataataccatgtagctcatatatttcaaattttaaaaaccatttgcaaaccaatgtataatccattagtaatatgtagtaatatgttatatactgatttagaaatccaagttggcaccaaaaatgaaaagaattaataatggctaaagagttaaaacttcagtatatttggcaaaatatgaaaacaaattggaagaaatactactttgattagtaagccagtgaaaaagacacaagcctgctactattatgcttccaggcatgaacttccttgtcaatattttctcaccatagcttccataaatatgaattccaaaaatagatatgtctagttccatacaccctataccctcccaagaaaactagcagctttttcccttttgatccagtggtattgtctaaactagacattgtctgcactatcagaatcacttggaagacttgttaaaacacagtctgctgagccctatccctgaagtttatggttcagtaggtctgtttaagacctaagaatttgcatttctaagaagttaccaggtgatgctgatgctactggtccagatatcatacttaaagaccacaggtctacaatatttgctaataccatatatgacctttactattagtcttataacatgtatattctgcccttattgcctctgtggctaaatggtaacctctggagagtacagaccagcatggcatctgatatgtggtaggtgttcattaaatcttgtgacgatcctttaaaaataccattatgaactgatattcaaaaaggcttagtctgttaataggtaacagctgaaaattactacaaaaaattaaaaatcttcaccatcctaaaaaaaaatagctaccaaactcttatcttttatctctacccatctcagtctaaacaccctgcctccatagaaacataatttatgacagactaccttgactacataaactgcctgtattacaggaaatatacctgggatgaaaatagttaagaaaaatcatgcatctctccagtgaacatccatatttagggtagcttaaacaacacacaggtaatcaaagtgtgggttggtacacgaaaatagtttccaaaaggctgagatgaacataaacgacttttaaaacaaggtaaaccttcctaacatatttcctttgctaaagcctgggagcataacaataaaaacaaaataagatctggggagactatgttcatgttcggccctgggtaacaattctctgcatatgaccaagcggcactgagaggaattttctatagtgttcccaaaactagcaacagtaataacaacactaatgatccttgtataaagagacaaggaatatttcagcttcaactatcaatccttctcttattcatacttattcttgttgagaatactagctaaataaataccttggtggaggacaaaaacagaggaaatagaattcattgcttttgaatcttattcattgcaaatgaatagaaaatcatttacttaactgctctttttaacatttaaaggattctaaggttccacatttaacaactttaaaacagttagacaatattatttttatttctcaaaaacgcaagccagatttggggctgatgaatgctcaaattccaagggtagagggtattctgaagaggtccgtgttggatgctgagtaataactatgaaattctgtttcttaaagtttactacaaaaagtcggtttttaaaaaattaatttctgacatcccaaaaaaagctgatcaatactatctaatttttcttttaaataaacttagcttgaggggggaaaaaaaccatgtacaatttggtggcattcatatttatcttcacctggattttctaatagttttaaagcagaaaatcttaatccagctcttttctgcttgaatttgaagaaccaagcttttttatcctcccccatttcagtaacaaagcaaaataagataaataaaaaagtcatttagcatgaaaaaaaatttcaacagatgacaactgtgaaagccattcactacttgttacatgaagctttataaactgagtcattttgaaaatgaattttcaattctcaacaggcaaagcaggacaaaggagaatgaaatacatttgttctcagtggaggagaacccagtgattaactgctgtgaagtagcaaattctgtacatactgaagtactttgtgggagggcggctcagacttcagagaccttacagattctcagaagttctcaatacactgaaagtcgggtttagaggagcagtaaaaagaaaaaagcacagattcctattgtcctacattaactattgaacttccacctcaagaatactactttaacttgaaatgtacccaaacctgaatttctcagttccacaaattcctgcaaccaacaattcagaagggaaagaactcttccctgattttaccatatctgtaaatatccacatatacactctttttgctgtgatatagaccttcttttctttccattctacataatacaaatccagaaccttactcaaaaatgatttttttcatttaaaccaagacactttctaatcaatcagtataatcccttcactatgtctttatcagagcactttgtcaaccactgaatttatgtgcaaaactctgtagactattgttgatcctatttttttctattattttgtaggctttttagaatataaggacaagtctacattataggtacatttatgcttattgagaaagcattctgtcagtcctcaaaaagaattttcaaagtattcactgtgtcatttggcatgtgagcaaggccaaggctgaggtaatggtgaaaaccataaatagctgaataggaaataaagagaaaagagtgaacaccagccattaatttttcaataacaacagtaacagcagaatagggaaaaagaattggtaccaggggccatacaataaagaaaatcagcctacttatctttggaacacactgagtcttatattaaaattggaaggatctgggtgattttagaactcagcttcctatcaggaaaaaaaaaaaaaaatcacaagacttcctaagtatgctccttgtgcttgatgtacctcatcctcctcagcctcagtgcaacactctcataatgttaactatctcacctactaactatttcttcttacaccactcctgccaggcagctattgcagttcttctcccacccctctaaaagcttactatcccctctgcgggcttcactttctcatcctactactccctaatgcacttagtccactttcctttgtatacctgctttttcctattctttccccatcactgtaatctaagctctaattcaatcactttcatttaaaaagatagccttaataaaaagcctcacaatcataaactcagttggctcaatctgtcaagacagaccataataatctcacttctgaaatgctctttccctgtcgtcttgtgttgcttctcgtcagagtccaccttcttctctgacctcatcccttctcttccttcacttactccctttctctttttcatctctttccctccaagccagccagcactgcccaaagtacagttctcagtatttttccctttagtcctcctctgatggtaaccattccacgtcattttcacctacatgcaaatgacttccaaaccatatgtctacgcttagtattgatctctcatctgcaaaccactgatgggcatttctcattaactgccccattaacatctcctctcaataacctacatttcatacaaatcatcatgccatattgggccaacttttcaggagaggtgaaagttaaaattgatttttgtctctccgtctaagaaatcactttcattttttcattcatctgttcctttctatcttcactatcatactcctcgttcattcaaacctactgtcacctagtgtactggagctagtccaccttctatacaatctgtcctgcacaccatgttagtttaagactttatactccactcactatactttttatgttctctttcttcttatggtagtaaaaagtactctcctaagtctatctttgactcagttaaagtaaggcaaagggcatctgcttctaccaaaaccagagctgaaggtaacagcaattttttttttttttttttttttttgaggagtctcgctctttcgcccaggccggagtgcagtggcgctatctcggctcactgcaacctccgcctcccgggttcacgcgattctcctgcctcagcctcctgagtagctgggattacaggcgcccgccaccgcgcccggctaattttttgtatttttagtagagacgcggtttcaccgtgttagccaggatggtctcgatctcctgacctcgtgatccgcctgcctcggcctcccaaagtgctgggattacaggtgtgagccaccgcgcccggccagtaacagcattttttaattcagacaccaggaaaaaaaaaaaagtaaaagaggactttaaaggagagttaaaatgaggagaactgagataggtgcaatggtcattttctaccaaggaattttccttcacagttatctttagcagtagttttcaacccttttttcactatgacacatgtgagggtcattcacatacaaagcattctcatgtatatactcatttagcaacaaagtgaaaaaaattaaatggattagtaaagctccacaataattgacaatcactaccacactggtgtacgtactaatatttctatttcagtgactgacttctgtgaatttgttcacctcaagagagtagggcatgaaattcaggttattaaaaaaaaaaatctattcagcacagatactgaccaaaaggaaagaggctggtggaaaaaccaatacagccaacctcttgttaactggtggaataccagccctggacacaagacttccacagctacaggttacccaactcccagcaagctagttgtcatcagttctctcttcctcccaaacaaagtacatgaagatacaagagcatgaagcatacacagagacaaattctcccatttgaatatgctctatttcattaaaaaaggagattcaggaatttaattactttataatattacagtattcataacagtgttcttatgacactgtgacataacatcaacactgaggcagctaaactttccaaaaatcctttctgtgatattcatagctctgtgtaatatagcctgacctatttagccaaaatatatcttagttatttcttccactataacaagcaaacctattttaccattcctaaaaaatgcacctagctccacatctctgctcatgccagctggaatatatttcacctactcctgtttacctagtttctataaaaaattcaagaccccctccaatttccaccattaaaaagatttcactgactaacaataaatctggcaactcataattcttctgtattactgtactttcctatatttattagtcttttcatatacacaaagactacacattatacttctttttatgtccagaaacacagaaacaacaccttaaacatggtagacactaaaacattttttgattaataacatcactcacataatcacacacctctaggacacacactataataaggaagaaattacctgattcaattaaatgcaaacaaagcacttctaatggatactgtacagtaggatagatgtttatcattccttcacaggccttcttcaatctagcagactcatgaggaaacttgaaaatataaaagcaaaatacactacattctagtagtagtaaaatgtatttatgaacactttcctaattagaaatacatacaagtcacattagagatttaaaaaatcaacttactttggataaactctgaatgaaatgcctataaagtacttggtgatcttcactaggaatcttatctgataatcccagtgcattctcaaaagcagtaaaaagctgaaacaaataaaaaagctatcatctgtatcatacttaaatgacaaatgattaaatgtataagactctcttacacaaactacacgttcaattaactgcaaatgtattctacagtctaaccctgacaacttcaacgaggaaaaaaatgtacatgtaagttttggaatgcattctaactccaactggccagcaaactgcactcaactggtaagtaacaactatacattaacaacattaatttaacaaaacgcacttccaagtgcctgctgtctcctacaaagtagtcaaccagagtatagtcttatatgctagtatagctgctactgctcacatatcatttttaaaacaattctgaaatcactagcacgttctttgaagtatcttcaatgatagcaaatcttcaacctttaaaaagcagttataaagttgggtgatacttttggtaaaagaaaagcagagatatgactgaactgttatgaaatcacttctcttatgcagtattagctgactctgaagaacattccatcacttctcttatgcagtattaactggctttgaaggccaacaggccttctaaatatgtctggaataagaacagcaatactagaatccaaggcaagtggtataaagcacttcataccactcagctggctacacgttctgcattttaaaatgaatactcatgacttaataccaaaaagccataatgtaattcaatatctcaaattttctttggaaagtatggtataaagtctatgtaaataagtaaaattttgctgccctgataaagttaacaatcttacaaagaaggaacatacctcaaaacagtctagcataaaagatttttaaaaacagtaataaaattattccaaatgaaaaatctgtaatacatttttttctaaatactcagtattcaaggtaggtaacaataaatcccctcatccttttatctattactaacagttagaaatcgattcttaaaatcttaagtacaattaattctctgtcatggaggagggtgggatagaccatccaaaaagttattttacttattttgaaatgtgtttgatattctggtaacctacattattttaaggaaaataataaagttatattatgatattatacaatttaagagaaactgctaagctacctaattttgtcactgctcaattttttccacaattgaatctatgcacagataaatcatgttatcacacacaaaaaagaaatcttattctcacatttttatccccagctcttaggaccctgcctgacacataataggtagtcaataaatattttctgaataaacaaattaatgagtgaacaaatgaacacatgaacaaatgaacaaatgaacacaaagaaatgaacttcctatcctatatagagtctatatttgtttatttaaaaattccactcaatttaacaagtgtacattaagtagctatttactataataagacattaagttgacttttaaagttacaaataaaaaaaggagaatgatagacatattttccaaatgtggttcaaaaccaattattttttagtcttacaaaaattctcttcaattactttaaaatctgcaccataaagactttttttctaggtgaaaaatactaaatataaatatactaaatactaaatttactctaaatactaaatataaatactctaaacagtggaattgttaaacctcaaagtaattcagtactcttagttcagaagtgtaaagaaacacacctttaaaagtataacttcttagacaccataagcagttttgtgaaagccaattcagtttcttttttacagtgattaagttactgatgtattgcagattcttatgaacacaagagaatgaaattctgataccatgagtaccaattccactccatccagactccgtatgagactacaggccaataattctgactttatctagaagagcctctgtgaatttaaaattgtacatttacaaaacacctagtctaacatacaatcctttttttttgagcatccattgaattatcattgaatgtcctatttccaatgtaattcatggactaatatccagaatcaataaggagcttaaacaaattagcaagaaaaaaaaacaacaatcccatcaaaaagttggctaaggacatgaacagaaaattctcaaaagaagatatacaaatggctgacaaacatgaaaaaatgctcaacatcactaatgatcagggaaatgcaaatcaaaaccacaatgcaataccaccttactcctgcaagaatgaccataatcaaaaaataaaaaaaatagatgttggtgtggatgtggtaaaaaggaaacacttctacactgctggtgggagtgtaaactagtacaaccattatggaaaacagtgcggagactccttaaagaactaaaagtaggctgggctcagtggctcacgcctgtaatcccaacactttggggggctgaagtgggcgggtcacttgaggtcaggagtttgagatcagcctggccaacatggtgaaaccccatctatactgaaaatacaaaaattagccaggcatcgtggcacatgcctgtaatcccagctacttgtgaggctgaggcaggagaattgcttgaacctaggaggcagaggttgcagtgagccgagattgcaccactgcactccagcctgggcaacagagtgacactctgcctcaaaaaaaaaaaaaaagaactaaaagtagaactacgatttgatccagtaatccctctactaggtatctacccagaggaaaagaagtcattatacaaaaaagatacttgcacatgcatgtttatagcggcacaagtcacaactgcaaaaatacagaactagcccaaatgcccatcaatcaatgagtggataaagaaattgtgatatatatacatatagatagacacagacacacacatacacacacaatggaatactactcagctataaaaaggaatgaattaatagcattcgcagcaacctggatggaactggagactattattctaagtgaagtaactcaggaatgataaaccaaacatcgtatgttctcactcatacgtgaacatatgataagaacattgtatgttctcactctaagctatgaggacacaaaggcataagaataatacaatggacttcggggacttgggggaaggtgagggacaaaagactataaattgggttcagtgtacactactcgggtgatgggtgcaccaaaatctcacaaatcactactaaagaacttactcgtgaccaaataccacctgttcctcaaaaacttatgaaaattaaaaattaaaaaaaaaactccataaaaagaaacaaacccaataaaaaatgagcaaagatctgaacacacacttcaccaaagaaaatatacaggtgcaaatgaacacatgaaaagatgttcaacattactatggaaatggaaattaaaatgacaatgatcaattatgtttccattttctaaattcaattaaatgatcaattttcatgaacaaacttgaggaataaatgagtcaataccaattgctgagtttcattattctggtcctctgtactttcagccaggaactgagtcaattttctccatagttgatgaagctcttcattttctgcaccttgttcctgccgtgtttttatcaacttgtgccatgttcgagccacctattaaagaaggagattttaaattattttgtccaaaatgtaaaaatgccaataaaaatgtaaaatctgcaaataaaaacatttttaatttgttaatatataaaaatagcaaaagcatagaaccccatctattttattttattttatttttttgagacggagttttgctcttgtttcccaggctggaatgcaatggcacaatctcggcttaccacaacatctgcctcctgggttgaagcaattctcctgcctcagcctcctgagtagctggtattacaggcatgcgccaccatgcccagctaattttgtatttttagtagagacagggtttctccatgttggtctggctggtctcgaactcccgacctcaggtgatctgcctgcctcagcctcccaaagtgctgggattacaggtgtgagtcaccgcgcccagcccatctattattaaaagaagtcagaaaatcattcaccaacctctaggtgtttcttttcttggtaatatagatccacaagtttcttgcagacatcacaccacttctgcttgtcaacacttagaacaaaacaaaacacacacacacaaaaggattttgaatctgattaataaaaataaccaaggacttaaaacactaaaatttaagtattccaataataatttcaggtactattttaaattagaacatatcttctttcatactacagtaaaattttctaaaatgagctcctcataaaaaagaaaaggtttaagaaatattatcttctattatattgactgaaaataatgtcaaagttccaaaattagtcaatcctcttactagtagtgttttgattctattttaatcacaaaagattctacgacaaatgtttgaaaaaaaaaaaaagcttcgcaattcccagtaaatgctggaatacttctacatgatttttaatcagtttattaaaattcaagctttgaaagaaactggactttcctcatacatttcttacctctcataaagatccaggagcttttggtaaacaccaggcaagtcatccttagcatttatgtgattatatttctcatacaagtttgctaacccctaaaagaagaagtactcatgattattctttttcctaaaacatttgctgttctcacattcatttattttgctaaataatatgataatctataaagattatttctgaaaaaggattattataatttacaaatgaaatgatctgtctgagatttgcctctaaatataatagctgggggtcggagggcacaggtaaagtggatattgttgagtatgggtgacaggaataaagaggtatatcattcccttttctttcgaaaattcattagaagtgcttcacaataataaacacttttaatggctattctacaatcttaccatctaagattactatatgacattatttttttcaatttcagcatgtgatctaaagtattttattgtgatatcattgacatataaaaattgtatgtttttaaggtgtacaacttgatgttttgatatatgtattcactgtgaaatgaccaccataatcaagctaactaacataaccatgctacgtagttaccactggtggcgggggaggcaggggagaggtgagaagatttaattttaagatctatgtgacactacctttatgatatgatcaaacaaaaaaaaatcaagtagtctgtgaaaattgtcatttttgcattaaagaacgatcagatatcctaaaccactcagtccattataaaagcagcaatttctctaactgtgttaccagatatcctcaagttcttattcacatgaacctgagacaaacaggttcacaccctccagggcctactacatcgtattaatcagtttcaaaggtgtgactgagataccaaacaaagttattaaatgtgaaaaagttggagaatctaagtaaaaacattaaggccactaagtaagaaaaaagaatttaacttgcactcaaagatagaaacattaacatttttatattattttatttttaggaaacattaaaaaacatttctttttcctcaggtaagcataaagaataatattgtggagaagtcttttatatgcacatataactaaggtagagatttatatttgagtgctcacattagaaataatccattaggtaggatattaaatagtgttaaacaacatcctttgcaccactttttttctaaactaacttttaggtttagaaaaccaataaatttaaattttttcttacatggggcaaatgtaggtttaaatgcttagtttaatgttgaaacctgtattttgaaaaatgcaaaaaaaaatccatttccataatacagaaaaaaaaaatttctacatacctgccaagctagtaattggtctggctctaattcagcagcttttttataggcactctgggcctgatcaggttgttctagttcagctgcagcaacgccaataaaaacccaggcattatagttatttttctcttgctttaacactgtctgatttaaaaaaaattaaaagagtaggttagtaaattttcgaagcaaatgaactaacaataacagaaagtctagcatgagtcaggaaatctatatctaccacttaacagggcaaacttcagaatgccatttaacctatctggtttcagtttcctcaggggaaggagttggactgtaggagtgaccataatggctttgaaataacaggtggtttcttttaaagctgcccgagggatactgacacctccaccaaatgcctccccatgctctttgagaatactgggtataaaaagaacaataactactcaatcatcctgcctgtctccatactgctactggtcaaattcacaaagctgttctccatctcatttcacttaatccaactctcatattttccttcaccatgatagtttccccatattagacacatggatttttctcaagattaagactaggaaagtagattcaccccagtgcgattataccaaatatgttcaaaataaatagtggcaatgatgtttaaacaacacctgccaactggaataaaaattatatgtagagataattgctttcagaaataacagctacttgctaaaggtaaaataaaacagcttgaagcagttagcaagtatgttctagggaaagaaaaacaaaaccagtagccaaaatgaaattagcctcttaaggttttacattattccagagaaaataagaacatttccatgagttaagcgagtcatattattagacttgagtgtttccacacaacactcctaataatctgtccctaatatgcagtacaagctccattctatctgtgaacacactgattacacaaattgggtcattcttgtcacctaagtcagagtaaagggagcaccagggggaaaaggcactcaggcctcatagcacctgctccaagatttaaattttccaaaagcccggctgctgagagggcctgctgtaaccctaagaccagttttccccagtagctgccatgactctaagtctagttttacctaccatcgtcactcaccaatcagagcctgccagctcccaaaagcttctctagtaccagtgagctttctttcaaaataatacataacatttttctttccaataaaatggccaatcttctctttgttcttcagacatacaaaagaccacttagcctgtgtgtgtatgccccaaattgcaattcttgtttcccaaaataaaattatttattttgacttcaacataataatgctgcctcctaacaaaccacaacaatgatgtaactaccaaagttaagctctaaacactggggccttattaatgcttatgttcccaacaccaggtacaatggctggcacttaacagctgaacaaaatgccatactcaaccagcaattagttaagtactgactatctgcctgatgaccaggttttcagaatccaaaatggatgtttaagaaaatgattatcaacaatgtggtgaaggcaggtatgagattctgaaagaacatagagaaaaaagtaccgaactctgcataaactggagaaggcttccctgaagggatactcataccatgtgataaagcgccacaggcagacaaggtgatgatcagacaaaaccacagcaaatgcaacattcctttactcaaaaattcatttagtctcaaccaatattctgggttactacacattagtaatcaggcatttataactgattagctatccatttgcattttctaattgggtctctctagtataaattattaactatttggtggaattaatatctgaattttgcagaaagtctacaggaagaagacagctatggtggtgctgtatataactgaaacgtgcatcaattagataaacctagtgctgaaggaaacagtccttcttcccttcttgtattccatccacaacctgtccccacttggaacacactgcccaccttcttctatatcaagattaatactatcacgtccttgcatccctgctgggctccatcagtcaccaccagaaacctaaacctcacaagggtatcctttacctgtttactccttagactcatcctcatattgccatgtatactgcccagtcttgcccaattccctccctaccactctcctaaattcttcattgtgccctctggaactcccaatctgggtcagccaagttccttccatatttttaacctttcttttaaccacaccaagttctgcctcaatgaaaacatggctaattcccctatacatcctacagattgcagatgacttcttttacagctcacatgccacaggcctagaaggtgagaaactgcttcttgctcacactgtctgtcacctacagtcctctactgctccttcctccttcagcaaccccactacctttgaagctcaggccatccaactatactactaaaaatagccttcttgttgctacagtctaccaccttcctaattcccctttccttcagtgaaaattctgtatccttcttttccacctcagtgcctgtattcatgttgatatcccgttgaacactctggcctctcagttatgtgaccaccacactactcacccatccaaaatctgaatttccagcacagtactattctgctcctctctaaccgtcccagttcaattactgtagtggtcccatggtaacaaatctttaacctttggtttctctaattttttctatcctaaacgctttttccattgcctatcagcccacctctcatttctcattcctctttacccagcttagactccagggctcaccactgtcatcactcccttgtcatgtctttcctttgcatgtctttcctttcttctttctctccatccatacttgaaccccatcatgcccatctccaaacctgagaaactgaatacaaagagaaaaactacagcggagttcactaatttcactttaatagcttgaaacttcaaatgggcaatcactagggcctgctaatctttccaatccttactagcaagtttcttttcccaccatgagaaaaaaaaaaaacaaaaaaaaaaacaaagaaagaaactatttcataccttctgctatctcaaacctcctaaccaataaccaagtcttctcccagtctcatcttatactttgccaagaaaatagaagccattagagaagaaagcttttcccaacaccaaatctataagcccaacactgtatggatgggcacctatcttctctcctgctaagatggaagaaggattaaagggctccctcaagctctggatcccagtgtgtctctcacctactgatgacttcactcctaccactaccctctgtctctcccccgagtccaatttctccctctgaatggaatcatacccatcagcataaaaataagctttataatcttggtcctctcatccacaaaccaaatagaaatagaacactaacatgccattaaacaatgaaaactttaagatacagtagcattccacgatacaaccatcaaaagatatttatgggatattcaggttttaagaacttggttttgttaagttaccaatacagagaaagttaagtttggcagaggtagtttatcctgctaactagaggttaaaagtccaaccattctaatggttctactaaatggccttaccacttttgctgtttggacaggaaataattcacatattacaaatcaacaatgtttataaatgggtaacatactttcattgtggaagaaaaaaatactggttaccttacagtgtttcaaagcttctttgtattctttgtttctgattgcatctctagcactttttagagcagtcttcacttccttgctggacattctgtcaaggcagaaagcctgagtaaatctacagtaatacctacccaatcgtaaatgttccaacaaacttagccatctgaaaagggaccctggaaaaggaaaagactccttctctctggaacagtcttccctctagaatatacacagtttattccttaacctcttcagatctgtactcaaatgtcacttcctcaatgaaaccttcctttgacatgctatttaacattttaatcttgccatccccctactctcaacaacccattatttccggaaccccttccattgctttatttttcttgaaagcatttgtcacatttaatatactatatattctacttatttatcctgtttattttctgggtcccaaccccacaagaagctaagttccatgcaggcaagaattttttttttcactgccgcatccccaggacctagtatcttaaattatagatgatcaattaataagtgttgaaattgagttatattttatttacattcattctctatatattttggctaaaatacaaatgatcttgttgatcaggactcaaaacacataccaatctcaatccaactctcccactctatacaaagctagatccagtagaataagcccaagtcacagataaaacactaacacaaataatttcagtgactgtgatatgaaagtttaagaaagcattgttttaatgctagtttctgtgaaacataaatcaagatattaactttcttcacaataaggattactgtaggtttattacctgtactttttctaaagaaaaacaatgtttaaacttgaatggaagcaatggataatgcaaaagggttgtatactaatttcagccataaaaagatattttaattagtagagaaagtatttcttcatttagtcttaagatatattaattttaaataaattagcatattttaagattacacaacttattctggcttacctataaacaagtctaattcaatcataattcaatgttgaaaaaaagaaatatttgtattttctgtcagctcctctaatctcatagaaaggtaaaacaaagctggggtaaatattaagtatttataggcttcagatgctcaagggagtaaaatgtaccaaaaagatgaatcactgacatggtacactgacagtcctttatatccaaagaagaagctaacacagaagtatgagaccaaagaagtttgagaagttagatacatattttttaatctttttgacttaaaaaatgttaggattcaaaataatagaaaaattaagataccataaaatcaatttatctacagctagaaccagattccctaaataggcagataagtaacttttttgcctagttacaataattatataatttaaagcaccatatttcatatgttcttgctttagaaactactaccttatctgaaattatcttggtatatatttataggtgaaagcttcagaatgatttttttgtagtttgcaaatcttgattggagtaggtaacaaatttcaatgctgatttcacaattttctcaaaccagtttcctttggttaaaaaaaaccctgcagactaaaaagaagaaaataacatcaaggatgatgacaactgatctagatcaataaaaagagacaaaaagagacactcaagtaaaaaaatcaaaagatgtccaaattgaaaaggaacaaaaacagtctcaaattaaaaacaaacaaaagaccacaaccattacataaggaggaagttcaccatctcttctatcacccaacattcatgagggtatgtatacaaacaaggcaggaccaaccactactaaactacatgcagcccccaagctatttgctgtgcacgatataaaaaatatataaagaatataatctaaatcaagagaaagacttaagacatataagtcattcaataatcaaatgctaaactaagggtaatgagtggaagtgcaataggaatttagagaaggaaaggtgtgtggtgtgatgttattaatggcttctattaatagaagatgacaagacttaaaaatggagtgaagaaggaaaattgctctactcagaggcaaatgcattagcaaagtgacagaagtgggaatgagttgtggcaagtataggaaacagtgagaaagccaggctgaatggatcagaagggacttattaaacagaagaaaattaggttgggtaggtaaatagagcctcagattacagatcctgaaagtcaaacagacaagtgtgaagttaaatacagcagcaaataggaagccattagtaatttttaagtaggttgtttttaaagaccactatatagaaacaaacaccatttttctcttggtaatcaattctaatattaaatgtccttcagtatctgtatgtctccatatgtaattacaattcttcatgctacaatggaaccctctattctcttccaattccttcttcatttgatgcaacatttaacacaatacgctagcactgaggtcctctctcactcatgcatacacacatatatgtacgtaagtttcagaagtttaatttgtaaaaagacaaaataatctgccccttttcaaccctaaaaactactacttcctttttttttaatttttatttttatttttgaggggaaagggaaacgtccattcaccaattttctaaacaaacccttattgagatccaaccatctactaggtaccacttaaacccattttccttccgagggtaaaaacctactacccaaaatgattccacgtaaccccatactcctctattttggatatttcccttcattgtaaggatttctaacacgtcaaagaaacatctagctctcttgcaagagagggagatgtctttaatattcttccacaatataactccctattaattctttccgccttatacctctcctcccactattctcctcaatctcaactgtctttttttaaataagagtattcattttgtacgttttcactcaagtttttctactaccaacccaaaatatttttatccaacataaatcaagaataaaaagtggcaacaactgcacttaaaaagagttagaaagtgacagtcatgccataaaggcaatgatattcctcaaggacaacatatataggtatgatatatatgtccccagttgaggctatgaaaccttaaataatattccaatatgctcatacaaagattccacaaagctaaaacaacaataataataaatagtaatgataatgacaacggaagctaattacagaaaggaaaaaaaacgatatctttaaatctaataacaaaaggtattttgtaatgacccatagtctgacattaaaaaaaaaaaaaaaactatgccattaaatctttcttctgaaaggaatgagtaaaaacaatcattaagtaaaaatagattccaatttattatttagcattgtagacacttaccttttaccaattattaccacctctatattcttcccgaattgaatttgattgttccttacccattttccatctaaattaaacaaaaacaagtatgagacaatcatataaaaaggatgacacccacaacccaaaaccttctaaactttttaacgcatcaattttcataattcataatttaaaacatgagaaataattatgtataatttttagtatttttattctttcccagagagacactattcttaatctccaaacttctgaattggtctaaactatattcctgggcctcagatgataaaaggaaacttctacaagagatcagaaggattttgagaaaccatttcagaaacccaaaatacactgatgtcaatataaaaaaatagagccaaagaagaatatctactatttctgtgccatttttgctttgaatcaaggacatctacagacaactaagggtacttatttacacccaatttgcagcctaattatattagaatagaacttttctctaaggaacataaggagtataatataatacaattatattagtttgtaatctaatgaaaacagagaaatttttttaatgttaacaatgcatttaaatagtcattaaaaatagtaacacaactacacatctacaaattctaaggatattttgatagcatccctgaagtggcttctgtcaaacaaaaaacaatctagaatggtccctgcagagaatggaagtggttttgaaaaactgaataaagtgaaaaaaaacatgctacttcagaactaggaagtaaacaatgtttaggtgaggcaggtagggatgaacaaggaatgaaaagtttccctaaccaaaacactcattagtgatctaccgaaatagaagtgtcactccaacagtagaaagtcttactggtaagaaaagaaagtatggtaatccaaacaatgtttaggaaagtaagataatagttaaaaaagaaaaaaaagtacaaacttgactatttcactggcttctttagccctgctaacacttggctgccctcctcacccaatctagttttatcactcagtcacttcaactctgttcttacaaagtaccctagatcctgtcagcccctttactctgtcatatccacccaccaaggcttaccctagttgagagtgagcttaggaaatcaaatggatctaggatcaaagccattaggccttgggtacatgacttcattactcaaagcccatttcctcactggtaaagtaagaattacatcacttacctgatacacacatagatggagtacttggacataatctatactaataatgtcctatctactattattctctcaatcaactttgctacttgccattcctaaaacaactagtgtgataactcagtgttaaaaattttccctacacattcaaatccccaaccgtcctgcaacctccttcttccttgctctctcaagaagtaaacttcttacctatacaaacggcccctgacttacaaatggttgaacttacaattttttgactttacgatgggcttatcagcatattaaatgcattttgacgtacaatattttcaagttaaaatgggtttatcatggtgtaacccaccataagaagcatctgtattcctcaagacagctatcatcaaacatgagtaccctcttcatattagttactacactacatgaatactagagtacagcctacaacagggatcactccctcctccaaacctccaaactgagctactcaactgcaacttaacaaatattatttttattatcctatatagacataattcaattatgtctcccaattcaataaattcttagacgtaagtcttatattttcagagcttcttatatacccaacacttactggataatacatattcaataaatagctaatgatcttccagcttccaaggcttaccagtgttaacaaaaaaatgagtgactgagggaagtgtctcaatcagtagatgtttattgagccacactttgagcacacgcctggggaaaaacaagccacagaagcatctgtgacccacactttccaaagagggctttcggaactcagtattctagaggagagcatgcaggagtgaaaaatggcgggagggaagtaggcagtgaggcaaatggttacattctcttgagtaccttttctgatagcatagaattactgattagcaaaaatgttgtacgttcacaaaagagtaatcaaaacaatgaggaaacctgaaattatgagaactagctgaagaaactggggactaggaaaaataaataaatggtggcgagggagttgggggaaggactgttgaaagggagagattatccatgtaaaagtgaagaaaaatgcactaatgaatggttaaaaatagaggaagattaacttcaacttaaaataggaacttttaatgagacctatataaatgtggaatgaggtactcaatggaagtgtttcccatcactggagatgaaaaagcacaggctggacaatccactcagcaggaatgttttaggataaactgaatgtcagatgggaagtaggactagaagcctcttagattcttccagcacaacgtctctaaggctctaaaatatctgtcttgctccaaatcactgcagcacctgctcctattgacactgccaaggggagaaagaagaaaaagatgtattcttgtaagcctgtcatcagagtacatgtcctgtggaaacaaggctgtagagagtaagcacagtttatggaatcagacacaaaattaaatataacttttatgaatttaaatgtcagtcaatattgtcactatggtagaaaatacgttctacattccaaattaactcaaaacaaatttgtttttatgagagagcccacttgtattaccttccgtgctgtattattatttcatgtatgcttggttttgcttccctgaaatctaaactcatgtaaactgagactattgtttaggggtttttttgtttttgttttttttttgagatggagttttgctcttgttgcccaggcggagtgcaaaggtgcgatctcagctcactgcaacctccacctcctgggttcaagtgattctcctgcctcagcctccctagtagctgggattacaggcgcccgccaccacgcccagtattttgcgtatttttcgtagagacggggtttcaccatgctggccaggctggtctcgaacccctaaccttcggtgatccgcccgtctcggcttcccaaagtgctgggattacaggcgtgagccaccgcgcccaacactgtttacgtttttgcatgctcccgcagatctttatcatgctgcttgagtaacaattctgctacactaacagataaactaactgcagacagagcatttagtgagttacggcacagactcttcaattttcagtcgtgctctgactggctccctgtgtaaactcaggccagtcatttaacctctctaagcctgttttcctatctgcaatatggtgaaagtgaggattatagaaaatattccatataaaagtacgtggcacgcagcagatgctcagtaaatgcttagtataacgctcagcacctaagtgccatgtgagtattaaataaacaaatctgttccttactacaattatcttaggcaaaaaaaaacctgccagatattagtattcagttgacttaagtaagtagtataactcctcttttaactgtcagaatattaaaactactagtgtgatgtgcaaattatatacccgaaactagatacagaaattggaatttggctttgggacagaaatctgcttcttccagaactctccaaaggaattcaacagtcaaaagagaccggtttttattctgcagcaaaacaatgatattctgaacctacgtcaactaactgaacatgtcacacagcccatttccccctccagtttcgcttatctcctttgctctctgaaggcaaggaacagctatgctttcccctgcctacagcctgaaacttcttactaggccccgctcctcgccccatgggagcacagtaaatcctgactgcacggggtaagagaagcaataagatgagacaggctagagatttccctgggaaggtattcgggggggtctaaggcattcacggcgcacctgaggcggtccacccagaggccccacaaggcaccgccctattcaacttaagtgacagccgcgccgccacctcatcgccgcccagttcacgctctcgccgaacactcagccacgcttgcgcggcccaaaatgaacagccccggccccgatcctttctttctctaagtaccatttcaatcgcctttaggatcccttgtgcaaaaccgacagaaatccaaacccacctggagcagatgctcctcttctacaaacgccgaggctgcaatgagagcgcatgcgcctttcccaggactc

SEQ ID NO: 2843 - DNA, 4314 bp, Homo sapiens
  source 1..4314: mol_type = genomic DNA
tggctttgaatgctctattttgccttaaaaatttatttactagtctcagtaatacattagtaaaaatcatgtcacttaattaattgtgttagaatcaaagaaacatagagttgggcaatatacttcatcctacccatcccacccaaatcttactctactcatctcattctcattaattttgggaaatcatcagaagatgtgttcgttgagtaagagattaaaagaaataagctttttgacccctgccaacaccccatgcccagggtggtcaccctccaatacaataacatgccaggaagagtaagttgccctttctgatgccgtaatctgccatcatcttcccatcttccagtctctttccattgcaagtcacaatctgggtctcagggattatacccgtcttagtctcgatcattgctttcacttgtgccactgagctggaccttcgcacctggaggaggtgcctctttgcctcatcacctgactccacaagaaacaagggcagctcctcatcactgggcttcaccactttcagggtaaggtggatggtcttctctttgtcaatgccataagatgagaggcttctccgtggctttaagatcttggagcccagcaaaagaacctggtcctgcacaggaaccttggtcttagaccggacatgttctttgatttttttcacgctgtcatatgggttggcatcaaaggtcattaaatcccattcctcggaacggacatgcacctgggaagtgaaagccacaagacagttacctaggatgcctgcctcctttacacttctactccccaccacaatggctccccctcttccactatctatctggtcctctagctcctattcagtagccagtgtccctctctttcttggaacttcttttttggaattaccaagttacaacacaaataagataatttgtcccattcctttataatcacacctttttttcgatcttgagaatggaaaataaaatcctgagcccccaaccaactgaacggacgctcttttgctcagggggaccctagagaaactttaaaaacttagtcattgggccaagggtggtggcttacacctgtaatcccagaactttgggaagctgaggcaggctgatcaattgatgctgggagttcgagaccagcctggtgaacttggtgaaactctgtctctactaaaaatacaaaaattagccagtagtggtggcaagtccctgtaatcccagctactcaggaggctgaggcaggagaatcatttgaatccaggaggcagaggttgcagtgagtggagatggcactactgcactccagccagggcaacagagtgagactctgtctcaaaaatataaataaataaaacattcagtcatgatggaacaggaggttggatatgcctcattgtatcttctcccttttgcagtttagacacaactgaccagcaaagttagagattataagactgagagaatggattctttgtggcaataagatagcaaattataaacaagaccgagggctataacaggcaaaagttaagtcatgcatcccttacacttaaagaataaactatgttctgccacaaagttttttcttttttctctagcagctaaacaagcactggccttgacaggaacaatattaaaacaattacagctcaccctgtgttggggaacacaggctaactgaccccgtgttccacaagccataactacagttttaattggacaaaagactgatttcagtaattttctcctgataagagaccactgaccatggactggttctggctagtttacagaagctgtgcatttgaatgcctttgtgtccctgcttcaccttttcatgtataaggcctaactgtaatgcaattaaatgttaagtctccacttcagagtgaccatgggtggtatgtaacatgcaagcttattcaatatgcatgcattaggaccccctccatgaatattcattgcctctgctataacctattggatatgtatacttagcaaaccccttcagcataaattcctgtgtcacctttcctcctgcaaagtgcttgcttttggttttcaatcagaagcaaaacttcccagcctgtcagaatggctaccttgcagactataacctttcataagaaataaactccccttctaaatttatgaattgtgtgattttttttagttgacaatctttacatttcgtttttctgtgcatttcaatggatgtaaaaaacatacctttatccatctcaaaatgtaattagtgattttccaccttatttacctgcctctcctatccagataaagtttgtcaaatgtcaacaagtaaatacgaggcttcaaaagatgtacatcagactctaaaaacaactctcaaagagaatttccaaaatatgacagcctcatgaagatactcatagccataggataccctctgtcaatacttcagaaggaaatcctgggtaggacacataatcactgaactgttagtttcttttcaaatatcccactgctttataataataactcacatactaccgtgacactatgttcagtgtttcttgttaatttatatttcttgtgtttttatttctatctaatgagagacaggactagctggatttcctaggccgactaagaatccctaagcctagctggggaggtgactgcatccacctttaaacacggggcttgcaacttagctcacacctgaccaatcaggtagtaaagagagctcactaaaatgctaattaggcaaaaacaggaggtaaagatatagccaatcatctattgcctgagatcacagcgggagggacaatgatcgggatataaacacaggcattcgagccagcaacgctaccctctttgggtcccctccctttgtatgggagctctgtcttcactctactaaatcttgcaactgcactcttctggtctatgtttcttacggctcgaggtgagctttcgcttgccatccaccactgccgtttgccaccgtcgcagacccgcggctgacttccatccctcggatctggcagggtgtccgctgtgcttctgaaccagtgaggcgcccattgccgctcctgattgggctaaaggcgtaccattgttctgcacggctaagtgcccaggttcttcctaatcgagctgaacactagtcactgggtccacggttctcttccgtgacccatggcttctaatagagctgtaacaaccaccacatgacccaagattccattccttggaatccatgaggccaagaaccccaggtcagagaacacgaggcttgccaccatcttggaagcggcctgcggccattttggaagcagcccaccaccatcttgagagctctgggagcaaagaccccctggtaacactaatatagaatgtgatctcctttgataagactagggcctcactcacagaaggtagggactatatctaagtcttacttcaatagctggaaaatcctaaaagatgggaaaactcacccctaatggccacttgaaagcctgagaagacctccctcatactccattcagaaatattttcccaatctagatattgcagacatttcttcactggaagatctgtgttaagcattgccttaattccaggttctctccatagtgcatattttcttatataatgtaatgtgttagatcattaacaacttcagatgaatgagttttgtgaagctctcctttgagaggagagggaagattaagtttaagaaccttaaaaaatgttaccataatttcaaatctcaccagccctgtggaacacaaagctcacccccactttttcttctaccatttatccctaagagtagctagtccaatgttttatttaaaaaagaacacagaagccagataaccagcttctcttcagacaatccctcttcccattctgcaaatgtcaatgccagcctcttctcctgaaggatgcctgcccagccccccagagccctgagtactgcccagcccccgtttctaagatctctccccaactcttgaaagtgcttttcctttccccatcccctttatcaaatcccaacttacacagaggcaggaagcattgggagccatctctgcagacaaggggccagaaaccagagacagaaaaaggactttgcatgcagcttatataccagagttgagttggaaatcccctgcctggattgctgtgtttgtccagctttgctgtgctctttgttcttgcatgctcccatgaattttctttcacttttgctgggcaggagttaatagacaaagaatgctttctgatcacatacttctctcctcaagcaatc

SEQ ID NO: 2844 - DNA, 20251 bp, Homo sapiens
  source 1..20251: mol_type = genomic DNA
gcggtgccagcccaggccccgcccctgggagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcggtgaggagtgaggaagtctctccggagggcgcgcgcattcaccctagagccagacgggacccgaatgtctgggggtggagtggggagggaggatgcggggcggctctgggaaggaaaaggggacgcaggaagaaaggaggatccagaagatatacccctcccccccaccccagacaaagctccagagtggccccacctggctagggccaagttgggaggccagacctgggttcgggtccagcctcgcgctggcccactctatcgcctggcacacatccctgtaccatcctaggtccgtttcctgatttgaatacaattgcgatagtaatacttgctaaagcgtagggagagccttttcattcatccagtaaatattcactgagcacccactccctgccaggctggggtctggtaattcagtggtgaacaaaaccgtcggccttacttcctggggcttagattcttaaatgctaggccttatctttgctgagtgctttacaagcagtagctcagttgatcccacaattgctctatcaggtagacatatactttcagatgaggcatttgaggcccagaaaggggacatgacttgcccaaggtcatagagctagaaagtgctactccagctgcagcctgtccagcttggaaatgtgacccctgaaccacattgttgcatgccctgttgtttcccatggggaccttgtgccccagagttggagaccccaatgagacaatactggagaaacaatttcgctatctagaagctgcttccagcaccaggctggaaacacacactcagagccaccatatataaggggttacaacttttgtggtatatacaaaggtagagaatgctaacaggataaatgtactcatttttctttttttcttttgcagtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatgtgagtgatgtgtgaaaggcaagttgccaagacccatagacccgtaggtgcctcatgaagggcagaatctggccccaactagaaggaagaaaccagaaacctctaacactggtggtgggaaagtcattgacttagcagagaaagagcaggtttcaagaactggggatttttctgtcatcttggttttgaattcgtagcctaaaatgtgtattacctctgggtataatattctccctgttcacgaggaggtgaccaaaggagaatctggagcagggtgtcaaggtcatgccaggcactttatttctgagagggccctgggtacgctgggtgtgcaaggttcaaatcccaccctagctctgatcagcaggtggaagacaaaaaatgcccaggcttcagagtcagacctcactccgctgcccactactctgggtgccctttataagatactagacttctcagagcttcagtttcttcaaatctaaaatgggggtagcactggctaggccaggtggctcacacctatagtcccagcactttgggaagcggaggcaggcagatcacttgagcccaggtgtttgagaccagcctcggcaacaggtagaaaccctgtttctaccaaaaatacaaaaaaattagccaggtgtggtggcacacgcctatggttcccactacttgagaggctgaggtaggcggattgactgaccctgggaggtagagactgtggtgtgccaagatcgctccactgcactccagcctgggtgacagagtgagactccatctcaaataagacagtttggtggcttcttacaaaactaaacatactcttatcataaaatccagcaattacattccttggtttttgcccaaaggagttgcatttggtattgacagtgttctggagtttagccattctaataggtgtgtagcaatatgtcactgttgtctgttaatttgcatttccctgatgacatatgatccagatcatcttttcaatgctttttgccatctgtgtatcttcctcagtgaggtgtctgttaaggtcttttgcccactttttaatcatttttgtttattaatattaatcatttttgtttattaataaattttaatcatttttgtttatttaatattatgatgtgggtctaatattggatcttaaaatattgagttttaagagttctttatatttgaaataatagtcctttatcagatacgtcttttgcaaatacatttttttcccagccagtcgcttgtcttttcattctcttgacgttgtccttcacagagcagaagtttttaagtttaatgaagtccagcttatcaattatttctttcatggatcttgcctttggtgtcatatctaaaaagttgtcaccaaacccaagatcatctacatttttctcctatgttatctttcaggaatcttacagttttgcattttacatttagttctgtgtccattttgagttaatttttgtgaaaggtggaaggtctgtgtctagattccttttcttatatatggatatccagttattccagcaccattggttgaaaagactctctttttcacattgtattgcttttgctcctttgccaaagatcggttgactgtattgatgtgggtctatttctgggttctcaattctgttccattcatctatttgttcaccaataccattggtgaactgttttgattgctgtaactttacatagttaagtctcgaagttgggtagtttcagtcctccaactttgttcttctccttcagtagtgtgttgactattctgggttttttgggggctttttttggttttttttagagatagggtctcactatattgcccaagctggtcttgaattcctgggctcaagcaatcctctggcctcagcctcccaaagtgcttggattacagggatgagccacagcacttggcctgttttggttttttacctctccatgtacaccttagaatccgtttgtcagtatcacaaaataacttgctgagattttgactgggattgtattgaatctgtagatcaaattgggaagaactgacatctttacaatattgaatctttctgtctataaacatagaatatcttgtagggtccagccccactgggtcggtgggttttctccctgtgtgcggagacgagagattgtagaaataaagacacaagacaaagagataagagaaaagacagctgggcccgggggaccactactaccaagacgcggagaccggtagtggcctcgaatgccaggctgcgctgatatttattggatacaagacaaagggtcagggtaaggagtgtgagccatctccaatgattgacaaggttacgtgagtcacgccacttggacgggggcccttgcctgcctggcagctgaggcagagagagagagggagagagagaggacagcttacaccattatttctgcatatcagagacttttagtactttcactaattttgctactgctagctaaaaggcagagccaggtgtacaggtgtgaaggcagactaggagcatgaccactgaagcacagcatcacagggagatggttaggcctccagataactgcgggcgggcctaactgatgttaggccctccacaagaggtggaggagcagagtcttctctaaactcccctggggaaagggagactccctttcccggtctgctaagtagcgggtgttttcccttggcactgacgctaccgttagaccacggtccacttggcaatgggcatcttcccagacgctggcattactgctagaccaaggagccctctggtggccctgtccgggcatgacagagggctcgcactcttgtcttctggtcacttctcactatgtcccctcagctcctatctctgtatggcctggtttttcctaggttatgattatagagcgaggattattatatattggaataaagagtaattgctacaaactaatgattaataatattcatatataatcatgtctatgatctagatctagtataactcttgttgttttatatattttattatactggaacaactcgtgccctcggtctcttgcctcggcacctggatggcttgccacccacaacatctctccacttacttagttcttctttgatttctttcatcagagttttatagttttcctcatatagatcttatacttattttgttagatttatacttaagtatttcattttgctgggggtgctaaggtaaaccctgtatctttaatttcaaatcctacttgttcgttgctggtgtataggaaagcaaatatacagaagttgacttttgtatgttaactttgtacactgcaaccttgctatatcatttattacttccaggaaattttttttggtagttcttttggattttctccgtagacaattatgtcatctatgaagaaaaacacgctgggtgtggtggctcacacctgtaatcccagcactttgggaggtcaaggtggacagattacctgaggttgggagttcaagaccagcctgaccaacatggagaaaccccatttctactaaaaatacaaaattagccagccgtggtgggacatgcctgtagtcccagctacttgggaggctgaggtaggagaatcacttgaacccaggaggcaatggttgcagtgagccaagattgcaccattgcactccgtcctggtcaacaagagcaaaacctcgtttcaaaaaaaaaaaaaaacaaaaaaaaaaaacggacacagtggctcacacctgtaatcccagcactttgggaggccaaggcgggcagatcacaaggtcaggagttcaagaccagcctggccaacatggcgaaacccccatctctactaaaaatacaaaaattagctgggcatggtggcacatgcctgtaatcccagctacttagaaggctgaggcaggagaattgcttgaacccgggaggtggaggttgcagtgagcggagagtgcaccactgcactccagcctgggcaacagagcaagactctgtcttggggaaaaaaaaaagaaaaacaggcttatttcttctttgctaatctgtataccttttatttccttttcttgccttattgcattagctaggacttccagtatgagttgaaaagcaatagtgagaggaggcatcattaccttgttcctgatcttaatgggaaagctttggagtttcctatcagttagctataggtatttttagacattctctatcaagttaacaaagttcccctctattcctagttttctgagagtttttatcttgaatgggtattggattttgtcaaatactttttctgtatttattgataggatcatttgatttttctcctttagcctattgattggatggattacattaattgatttttgaatgttgagcctgctttgaatacctgggataaatcccatttagttgtggagcattattctctttatatgttgttgtattcaatttgctaatattttcttgaaaatcttgcatctctgtccatgagagatatgggtctgtagttttcttgtaatgtctttttctggtattggtatgaggataatgctggcctcatggaataagtcaggaagtattctctctgcttttgtcttctgaaagattatagataattggtttaattttttccttaaatgtttggtgggattctctagtgaaccgaacccatctgggcctggtgccttctgttttggaaggtaatttttgtttgtttgtttgtttgtttgtttttcggagacagagtctcactctgttgcccaggatggagcacactggcatgatctcggctcactgcaacctctgcctcccaggttcaagctattctcctgcctcagcctcatgagtagctgggattacaggcacctaccaccacgcctggctaatttttgtatttttagtaaagacacagtttcgccatgttggccaggctgttctcaaactcctgacctccggtgaaccacccaccttggcctcccaaagtgctgggatgacaggtgtgagccacagagcccagccggaaggtaattatttatttattcaggctgggtgcagtggcttacgcctatcatccagcactttgggaggccaacacgggcagattgcctgagtttgagaccagcctgggcaacatggtgaaaccctgtctttactaaaaaaatacaaaaaaattagccatgcttggtggcgggtgcctgtaatcccagctactcgggagactgaggcaggagaatcgcttgaacctgggaggcggagattgcagtgaaccaagattgcaccaccgtactccatcctgggcaaaagagtgagactctgtctcaaaaaaaaaataataataattcaatttgtttaatagatttaggcctatttagattatttcttcttttgtgagttttagcagatcgggtctttcaaggaattgttccagttcatctaggttatcaaatttgtggacataaagttattcatggtattctttgattatccttttattatccatgggatctgtaatgatgtcccatctttcattcctgattttagtaatttgtgtgccctctctatttttcttagttagcctggctagaaacttgttgatttactgatcttttcaaacaaccagcttttggttttattgattttctttattgatttcttgtcttcaattttattgatttctgctctaattttaattatttctttacttctgcttactttggattaaatttgctgttgtttttctactttcctaagatgaaactcagatgattgactttagatctttttctttttcttttttttttttttttttgtgagggagcctcgatccgtcacccaggctggagtacagtggcgcaatctcagctcactgcaacttccgcctcccaggttcaagtggttctcctgtctcagcctcccaagtagctaggactataggcacgcaccaccgtgcccagttatttttgtatttttagtagagacggggtgtcaccatattggtcaggctggtctcgaactcctgacctccagtgatccacctgcctctgcctcccaaagtgctggaattacaggcgtgagccaccatacccggcctagatcttcttttctaatatatgcatttgatgctataaatattcttctaagcaccttttgctgcattccacaagttttgataagttatgttttcatttttattttgttcaaaatatttataaagttttctggagatttcttctttgatccgtgtgttatttagaagtgtgttttttaatctccaagtatttggggattttccagctacatttctgttacagacttttagtctaatttcattgtggcctgagatcagacattgtatggtttctagtcttttatatttaaggggttctgatgcttactatttttcttcagattgtatttttgccctttagtatgtcttgtaatttttcctcgatagctggacatgaagtactatgtaaaaggaactgtggtaaacaggcctgtatgaatgtggtggtgaggtggtgggggacaagaatccttctgtagtcctgtgattgggtgtcaatcttttggtgagccggttcctctggactgggaacttcccacacgcttctcagaattttccccttcctaggtgggacaggatgaccagaaggtgctgcagtttggtatttcacttcccctaggtcagttaagagtctgataaaacactttcaggttaggctgtaattcagtaagtttctcctgagggtagaccttgttaagaaaaactggaggctgggcgcagtggctcacgcctgtaatcccagcactttgggaggccgaggcgggcggatcacgaggtcaggagatcgagaccatcctggctaacacggtgaaaccccgtctctactaaaaatacaaaaaaaaaatattatccaggcgtggtggcgggcgcccgtagtcccagctactcgggaggctgaggcaggagaatggcatgaacccgggaaacggagcttgcagtgagccgagattgcaccactgcactccagcctgggcggcagagcaagactccttctcaaaaaaaaaaaaataataataaataaataaataaataaatgaaaataaaattatattagaagacatagacataggctgctgtccaagtaattttctccccaaacccagagtaataaggacttccctctgccttctgggcttcttcattcagccatggcaccttggctgagagaacggcccgccctctttactcctcccctccagatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggtgagtgcttcttccctctgcctctccactccctcccctccatggcttctcctcctctcctgagctactgcgggcattaccccagcaggcaggcagacctaaagatagaacacggcccctctcctggggctgcctgctctacttctcatcctccgtgaccttgggcatgccgtggaagctcttgacacccctgatgccgtatctgctctgtaggaaaagccagctgtttttctgtaagctcttgctcagtacttccagcacttctgtgaccagatgtgttgagtttttttccacaccaacaaattatccaactctccagacacccactgggtgtcctataatcgaactcaattctgacactaataacccagggttagtgcagacttcataggttaaggactcagtcccacaagactgcgctccttgtcagacaccatctgcagtgttgagctctcaggttacccacaacatctgtctgatttcactacaaatcagaggttctgtggaccctctcctcaggtttgatcatttgctagaatggctcacagaattcaggcaaacagtccacttactagggcgccagtttattacaaaggatatgttacaggatacacatgaacagccagatgaagagataggtagggtgaggtctggaagggtcccgagcatgggagcttctgaccctgtggagttgggagtgagccaccctcccagcacatgggtgcgttcttaatcaccaagggaagctcctcaaaccctgtagttccaaatttttacggaggcttcatcacataggcatgatggattattaactcagtctctagcttccctcccataccgggagggtagggggtggggctgaaagttcccagcttctaatcatgccttgctctttctgtgatcagcccccatccaggacctcattgcctcattggaaccaaagatgcccctgtcacccaggaaattccaaaggatttaggagctctgcgtcaggagccaggatcacagaccagataatagaacaaaagatgctcctagcacccctgctgcttaggaaatgacacaggttttaggatctctgtgtcaggaactggaggctgagaccaacacatatgttatcatttcacagtgataggtcaaacaggtcatggtaatggtgggagctacctcactgggggcctatgggggtgaaaggagatcatgggtgccctcagcacaccacttgggtgaagggttagtaccagaccccacttctggttttgtctgccagcctggggctttttttttccccttacctattagattatttcataactcttttcctaccagaaatgcatctcctgctagactggtccagatcaaaaccctgctctttcactgaggctctcccggttggcatatcctgcagaatccctccgtccagagatcagtcggtcctgtggttgtttcacaggtgactcctctgtccagagatcagtcggtcctgtggttgtttcacaggtgacacctccgtccagagatcagttggccctgtggttgtttcacaggtgacccctccatccagagatcagttggtcctgtggttctttacccctggtggtcatttcactcaccctcatatgcagtcgttcctgtgtccatcttccttcctggagcccacattcctccaggccaggactgtggcttctctctgaattgccccacagcttttttccaagtgctctgctcacagtagacatcaaatagatgcttgttgagtcatggtgcgggaatgagggagcctagagaatatctttctggatcctctactgttgatactagaaggagcctaagaagccacccggctgatggttttctgaccctgcctttatcagcagagccttttttcaaatgaggtgttgcacaaaagcctgatgtgtggctgtgtaaaacagaaataaacagtcttctagccaaagccccattcccacagttcagggggccataggcccaggaattccataggatgtcactgcccaactaggaaactgctcagttagctgaaccccttctgagggccagaggaggacaggatttgtcccaatccagacactcggccagggaataagggctgaaactcatctctcaacctagtccagccctccccctctttggattgtcattatcaagttgattgattgtatattatcaggactctcttaaccacaggtgccagaagcccatgccagaagcccaacccaaagtggcttaaaccaaagagaaatttataggctggtataactaaaagattcagaggtagcactggctcatgcatgagtggaccggggtgacaagatatcagatggcacctgactgtcaccaccacaggcagactgttcaccatctcagctctgtccccttcctttgtcacaatgacgaagccaccgcatctcccggctaatggtgtaccagcctggaaagacagcctccctctctgattggcttcagcacaagtcacaggaatgactgcctggtctgacccgtctcctgtgtgctttctttgggagtaaagagttaacaggcccttcccccttccacagagagtgcttcccttatcctgcggaagctctgcccctggatgaaggaggagagcggctatgttagtgctgatgactggcacactgcacttgcgctaggaagacagcatgaactgcacccctccagggaagccacggcctgggctcccctgcatacagtggttccttaactgggcacgagtcccttgctgggacttaggaaaactctgcctaaagtccattgcaagaaatactgatccctgtgggatgtatatgtggctggttcccttgctcactgagagactagaaaacagcacctggacccctgggctggttccctctgaggaaaggatctgtgtcatgagtgaagcccgggcaggtgtggtctgttcaactttgatcatctggttgagcctaaggtgaccaagagtgggcggtgcacccctgattctgttgctgtgactgaggaaatgctaagctctgtttggccaggcctgggcagcctgcctctggagtaggggtggagagccatcctgcaacacgaggttaccaggagaaggagttttggttgggcacagacatccagtgtccactccaggatgtttgggagacaccttgagaactcttcctaaaagctgcacttaaccaagctcctggtggttctgtgatcccttacattttctccagaggcagagagttggctgactgacttttgcccttgggcagattgtgaggctctacccagcatgctggtatattatgttccctcagatgggggtgagacccttggcctgggggctgtaaaatgatctgtttctgtgaggagactttccatggtgagattgctagtgtctcagagaataaaggacagaaccagtccaagtcaaagcacttacctagctgagcctgactcttcccgtgttattgatctgaggggtgggtgggtgggggcatctgtctcgatttcacaccaacagacctattcccctcacgaaagcgtcataggtgacaacaaggactctggaaacaggcagactgactgttccaatcctggctcaccaaattcagcttcaccatgcctctgtttctttgtctgtaaaatgggcataattgtaggcctgctcacagagttgtgtgaggattcgagaaacagagtgtgcaaaggcttgagctcagccctgacacacgaagaaatgttgtcgtgattgcttagatgaaatcggagtcatctattttaaaaaactgcaagaaatgaatcagctgttaagtggtccattatcacctacttgatcaataaggctttctcagttcccatcagtgaagttgagatagtctcaaattgtttatcgaaatgaactgctattaacaaagtaaaatttttactagcacctggatgatgttgtgtgttactcgggctgggtgattttaaggtcttgtccagctctaatgtttaaggttcagtataccacctgcataatggggtgataatatgaagtgcaaaatgagttaactatattttcaaagtgctgtttttttttaacataagctattttttctgctttttttcttacgatttttcctgaaatatggtcttctaaatttcagattcttctttactgccaaccaggtaaagatttacaccaatcaagagaaaaccaggtgggtcctcccaacccccaatcaccatcagaggaagattctttggtgcaaaaattgagtgctttgtttctggacttgtttgtcccattttttgtttgcttttaaccaactctatgactataaaggcagctatccccaaatctgaacctttctttaagaaaaataactgggagatcccaggcacagtagcgcatgcctgtaattccagcactttgggaggctgaagcaggtggatagcttgagctcaggagttccagaccagcctgggcaacatggccaaaccgtgtctctatgaaaaatacaaaaattagctgagcatggtagtgtgtgcctgtagttccagctacttgggaggctgagatgggaggatcgcttgagccctggaggtcgaggctgcagtgagccaagattgcaccactgcactccagcctgggcaacagagtgagaccctgtctcaaaaaaataaaaggccaggtgcggtggctcacgcttgtaatcccagcactttgagaggccaaggtgggcagatcacctgaggtcaggagttcgagaccagcctgcctgacatggcgaaaccccatctccactaaaaatacaaaaaattagctgggtgtggtggcaggcgcctgtaatcccagctactcgagaggctgaggcaggagaatcgcttgaaccctagaggaggaggttgcagtgagccaagatcacaccactgcactctatcctgggtgacaagagtgaaactctgtctcaaaaataaataaataaataaataaataaataaataaataaataatgactggaggagcatgtagtggggtggtgcccagagattgagagaagcatcttggtttagtgaaaacctgtgaaagtcaggaaacctgtttctgcccagctccatcccagttgtggtgtttagtccgtgtcttcatctctgtgacctttcattttcacactggcacacgcctcccaacatccactgttgggcagttgtaaggctcaaatgagccccaaggcctttgaaaagttaaaagtattaaagtgttagatgaacataagaagaaatgattatcctgccttcaaagcgagcctccctgtctgatgcactcactgggccaccttctctgagcacttctgaaaggggcctcatttattcattcatttattccatgctgcacaagtttgttaagcacccacttgtgccaggcatttgctgtacactaaggattcatcagtgaagaggtagacacagcccctgctcttttcaatctcatattcagaggggagacagataataaacaagtaatgagagtgtttgttaataactgtggtgtgatatggtcaggagtgggtagtccaggagggtaccagggaagtggccagggagatggcatttgatggtgacctgagaatgagaagccagccttgggaagagctgttgcaagagcttcaagcagaggacatagcaaactaagtgactccgaggcagggaagatttcagcatgtttgaggaggccagtgaggcagaccccagaaagcacgagggagaatgataggagatgagatgggtagggttagcccatccaggggctgcaagctcaagtaaggagtttgaattttcagtataatggaagccattggagggatttgaacagaggagaggcatgacctgatctatatctggggatgtcagtctggctagtggtgtgtctgtggccatggagtctgggggcaagatagaagggagcaagagtggatgcagggaaaccagagaggagccaggtgtcattgtccaggtgagggaccattggtggcctagattagggtgatggccatggaagaccaagaggtggacacattggagatacactagaggcagaagcaaccaaattaccaatgggttggatttatgtgaagcaaggggaagacgaacattgattcctgggtttgaggctagaacaactggccccgttttctgtgataagagacactggtgggatgaaaagcaaaagtgctgctttgtacctgtttgtttgtacctgctaggttttgctatctattggacccctaggtggaaatgtcacatatacaactgggtgttcaggagagggaccagctggagatagaaatgtgggcagtgttggcctgtgtgggaagcggggctgggtgagatcagcctcctggagagtgcagatggagaagatccagtgatcttcaccacggggaggctggagaggagagagggtggcagaggacactgaaccgggagacaggaggcaggattaaaccaagactgcgtggcaggtgatgtcttgggagccaagagagaaaagggtttcaaggagggaagagtccactgtgtgagatactgctgggtgcgtacgaggcggacagcgaagtgtcccttggatttggtaacgtggaggttgttggcaactttgacaagaggactcccagcaaagtgggttgaagatgggaggtgagaaagagatagtgatggtggacaaatggtctttttgagaagtttcactgagaatgggatggggacgtgctgaaaccgtgggttcaggggagagtttttaaagatgagagagcatgcctgagtgcttgtgggaggcgtggcagatgcctgggagcaaagtcctcgagaagaggcctccttgaggacaggagtcatttgcgattggaatgatgatggagaatgggggtgcagaagcttctgggtttgtgacttggcagtggtgggtgaaggcgttcctggaagggttattagatccagagaagggaggagagctgtgtgggtgagaactgggaaaggaagatttacagacagagaatctgaggactgagagagttggctcatggagcaggaaagcgagtgtaccagggagacggtgagacccacggcccaggcctcttggccttctgcctggctcctgctcggctgcgcagatggctgtgttctcagaggctacatctcatgcctgcgttgtcttcctctccccaggacctttattgggcttgaggtcacttcagggcatgcccagttcctggacctggtttcagaggtggacagagtcatggaggaattcaacctcaccactttctaccaggtaatgaatggggctgctgcttctccattgacccatttctaatgagaataaaactgtctttaaagaagccctcgtaagaggcaaaccgaagacccttcagaacctcccgtgtcggtgctctgaatgccagccttctgaggatgcacacctcggggggtgagggctttgaggtgtagtcagatgcagcccacccaaagtccaacatttcttagaaattttgctttatatcctaaatacgcccgagatttgtaccttctgctccataatgttcccgtgttgttttcacattttttaagtagatgtccctaataatttttggtcagattgaccctcagagaggagttgtagcttcacacaccttcctgcaccttgcccaggccctccaagggcacttggactctaagtcgactctcagggctttgaagggccattcattttatttgatatatgtttttaaaccgtgctgagggagataagtatgaatttgaatggagacaattattgttgcttcaaaacttgagactttggggattttgttcatgtcatctgaaaagtatggtgtatactggaatgtcctagatcagaatagagggtggattttctttcatgtcacagatgtaatgaccctctgatacttcagggaaagcctctgtgaatacgactgtcttagctcaggctgtcataacaaaataccatagactgggtggcctaaataacagaaatttatttttgcacagttctggaggctagaagtccaagatcaaggtgacagcatggttgatgtctttttttttttttttttttggagacagagtcttactctgtcgcccatgctggagtgcagtggcgcaatctcagctccctgcaacctccgcctcccaggttcaagcaattctgcctcagtctcccaagtggctgggactacatgtgtacaacaccacgcccagctaatttttgtatttttagtagagacggggtttcaccatgttggccaggctggtctcaaactcctgacctcaggtgatctgcctgccttggcctctcaaagtgctaggattacaggtgtgagccactgcacccggccaagcgtggtcggtttctggtgagggttcttcctggcatatagatggccgccttcacatggcggggcaggggttgggggctacagagagagagagcagtgcccaagctctctgtgattaaagggcactaatcatgagggtcctgccctcatgacctcatctaaccctaattacccctcaaaggccccatctttacatactatcacattgggggttagggctacatgaatttgggggaggtgacacgattcagtccatagcaaggaccagtcctgtgctgttttgtctgtctgtggagggtgcttgggatcaacactgagtatcttgtctcccactgggcaggccagggatccagcagggatgtcacgacagctctgtcacagacctgctgtgagggcagggcctgccaaggcgtccgggtgactgcctgcctctcgtttccctccccaggatccttctttccacctcagcctggcctggtgtgtgggtgatgcacgtctccagctggaggggcagtgcctgcaggaactacaggtgaatttccagggcgggagcacagagggcgctgaactccagaaatgacaggacagatgctggagagggggaggatgaggcacccaaacctgaatccctgggaaacaaatgacatggcaggagaccccaacaccttcccttgtgactcaaggtgtggcccctggaccagcagcttcagtgtcacctgaagcttattaacaacacagatctttgcccccacccccaccaagacctaagaaatcagaattacattttaacaagatctctggggatttgtgtgcacattacagttctagggagcactgccctagaacactgatctgcgaggaggctgcaggctttccctgaagtcctagccacttgcccagaggtcagaggcttgggcctggcactgaaaatgggtgaaatgtaccaggggtaaggaacatccagcccccagagtctatcagattttgataagtagctgaaagattccactttcccatctgcgcccttggaggagaaccagcaagttacatgaagtggtaagcggcggctgatactccagccctggttggggagacagtagggagtgtggccatgcgggaagattggcctagagttgccagcacttctgtttcataagagaagccagaaacctagatttttacatgtaatctgtcagttttcaaatgtcagcaactaatttggatgtttaaaaaacattttgcaaccaaaccaaacgtgcaggctggatgcagctgtggtccctcgttaaggagccaccttgcgcttggcctgatgttgctggaggtggcaaagagctctagtttgggctccggcagacctgggtcccaggcctggttttattggtttctgtgatccagggctctgagcatctgtgtcctcatctgtaaagttgagatgataggaccaacctcagagattacagaagtgatcagacaagatcaccaatgcagagcctggagcctgcagcctcagcctcgcccagcctctgaagttgggtgagctggttttgtttgcagtgccctgtgggtcccagatgccccttaatgtgactgtcctcccctggctgctgttttaaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttggatcttt

SEQ ID NO: 2845 - DNA, 12198 bp, Homo sapiens
  source 1..12198: mol_type = genomic DNA
gcggtgccagcccaggccccgcccctgggagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcggtgaggagtgaggaagtctctccggagggcgcgcgcattcaccctagagccagacgggacccgaatgtctgggggtggagtggggagggaggatgcggggcggctctgggaaggaaaaggggacgcaggaagaaaggaggatccagaagatatacccctcccccccaccccagacaaagctccagagtggccccacctggctagggccaagttgggaggccagacctgggttcgggtccagcctcgcgctggcccactctatcgcctggcacacatccctgtaccatcctaggtccgtttcctgatttgaatacaattgcgatagtaatacttgctaaagcgtagggagagccttttcattcatccagtaaatattcactgagcacccactccctgccaggctggggtctggtaattcagtggtgaacaaaaccgtcggccttacttcctggggcttagattcttaaatgctaggccttatctttgctgagtgctttacaagcagtagctcagttgatcccacaattgctctatcaggtagacatatactttcagatgaggcatttgaggcccagaaaggggacatgacttgcccaaggtcatagagctagaaagtgctactccagctgcagcctgtccagcttggaaatgtgacccctgaaccacattgttgcatgccctgttgtttcccatggggaccttgtgccccagagttggagaccccaatgagacaatactggagaaacaatttcgctatctagaagctgcttccagcaccaggctggaaacacacactcagagccaccatatataaggggttacaacttttgtggtatatacaaaggtagagaatgctaacaggataaatgtactcatttttctttttttcttttgcagtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatgtgagtgatgtgtgaaaggcaagttgccaagacccatagacccgtaggtgcctcatgaagggcagaatctggccccaactagaaggaagaaaccagaaacctctaacactggtggtgggaaagtcattgacttagcagagaaagagcaggtttcaagaactggggatttttctgtcatcttggttttgaattcgtagcctaaaatgtgtattacctctgggtataatattctccctgttcacgaggaggtgaccaaaggagaatctggagcagggtgtcaaggtcatgccaggcactttatttctgagagggccctgggtacgctgggtgtgcaaggttcaaatcccaccctagctctgatcagcaggtggaagacaaaaaatgcccaggcttcagagtcagacctcactccgctgcccactactctgggtgccctttataagatactagacttctcagagcttcagtttcttcaaatctaaaatgggggtagcactggctaggccaggtggctcacacctatagtcccagcactttgggaagcggaggcaggcagatcacttgagcccaggtgtttgagaccagcctcggcaacaggtagaaaccctgtttctaccaaaaatacaaaaaaattagccaggtgtggtggcacacgcctatggttcccactacttgagaggctgaggtaggcggattgactgaccctgggaggtagagactgtggtgtgccaagatcgctccactgcactccagcctgggtgacagagtgagactccatctcaaataagacagtttggtggcttcttacaaaactaaacatactcttatcataaaatccagcaattacattccttggtttttgcccaaaggagttgcatttggtattgacagtgttctggagtttagccattctaataggtgtgtagcaatatgtcactgttgtctgttaatttgcatttccctgatgacatatgatccagatcatcttttcaatgctttttgccatctgtgtatcttcctcagtgaggtgtctgttaaggtcttttgcccactttttaatcatttttgtttattaatattaatcatttttgtttattaataaattttaatcatttttgtttatttaatattatgatgtgggtctaatattggatcttaaaatattgagttttaagagttctttatatttgaaataatagtcctttatcagatacgtcttttgcaaatacatttttttcccagccagtcgcttgtcttttcattctcttgacgttgtccttcacagagcagaagtttttaagtttaatgaagtccagcttatcaattatttctttcatggatcttgcctttggtgtcatatctaaaaagttgtcaccaaacccaagatcatctacatttttctcctatgttatctttcaggaatcttacagttttgcattttacatttagttctgtgtccattttgagttaatttttgtgaaaggtggaaggtctgtgtctagattccttttcttatatatggatatccagttattccagcaccattggttgaaaagactctctttttcacattgtattgcttttgctcctttgccaaagatcggttgactgtattgatgtgggtctatttctgggttctcaattctgttccattcatctatttgttcaccaataccattggtgaactgttttgattgctgtaactttacatagttaagtctcgaagttgggtagtttcagtcctccaactttgttcttctccttcagtagtgtgttgactattctgggttttttgggggctttttttggttttttttagagatagggtctcactatattgcccaagctggtcttgaattcctgggctcaagcaatcctctggcctcagcctcccaaagtgcttggattacagggatgagccacagcacttggcctgttttggttttttacctctccatgtacaccttagaatccgtttgtcagtatcacaaaataacttgctgagattttgactgggattgtattgaatctgtagatcaaattgggaagaactgacatctttacaatattgaatctttctgtctataaacatagaatatcttgtagggtccagccccactgggtcggtgggttttctccctgtgtgcggagacgagagattgtagaaataaagacacaagacaaagagataagagaaaagacagctgggcccgggggaccactactaccaagacgcggagaccggtagtggcctcgaatgccaggctgcgctgatatttattggatacaagacaaagggtcagggtaaggagtgtgagccatctccaatgattgacaaggttacgtgagtcacgccacttggacgggggcccttgcctgcctggcagctgaggcagagagagagagggagagagagaggacagcttacaccattatttctgcatatcagagacttttagtactttcactaattttgctactgctagctaaaaggcagagccaggtgtacaggtgtgaaggcagactaggagcatgaccactgaagcacagcatcacagggagatggttaggcctccagataactgcgggcgggcctaactgatgttaggccctccacaagaggtggaggagcagagtcttctctaaactcccctggggaaagggagactccctttcccggtctgctaagtagcgggtgttttcccttggcactgacgctaccgttagaccacggtccacttggcaatgggcatcttcccagacgctggcattactgctagaccaaggagccctctggtggccctgtccgggcatgacagagggctcgcactcttgtcttctggtcacttctcactatgtcccctcagctcctatctctgtatggcctggtttttcctaggttatgattatagagcgaggattattatatattggaataaagagtaattgctacaaactaatgattaataatattcatatataatcatgtctatgatctagatctagtataactcttgttgttttatatattttattatactggaacaactcgtgccctcggtctcttgcctcggcacctggatggcttgccacccacaacatctctccacttacttagttcttctttgatttctttcatcagagttttatagttttcctcatatagatcttatacttattttgttagatttatacttaagtatttcattttgctgggggtgctaaggtaaaccctgtatctttaatttcaaatcctacttgttcgttgctggtgtataggaaagcaaatatacagaagttgacttttgtatgttaactttgtacactgcaaccttgctatatcatttattacttccaggaaattttttttggtagttcttttggattttctccgtagacaattatgtcatctatgaagaaaaacacgctgggtgtggtggctcacacctgtaatcccagcactttgggaggtcaaggtggacagattacctgaggttgggagttcaagaccagcctgaccaacatggagaaaccccatttctactaaaaatacaaaattagccagccgtggtgggacatgcctgtagtcccagctacttgggaggctgaggtaggagaatcacttgaacccaggaggcaatggttgcagtgagccaagattgcaccattgcactccgtcctggtcaacaagagcaaaacctcgtttcaaaaaaaaaaaaaaacaaaaaaaaaaaacggacacagtggctcacacctgtaatcccagcactttgggaggccaaggcgggcagatcacaaggtcaggagttcaagaccagcctggccaacatggcgaaacccccatctctactaaaaatacaaaaattagctgggcatggtggcacatgcctgtaatcccagctacttagaaggctgaggcaggagaattgcttgaacccgggaggtggaggttgcagtgagcggagagtgcaccactgcactccagcctgggcaacagagcaagactctgtcttggggaaaaaaaaaagaaaaacaggcttatttcttctttgctaatctgtataccttttatttccttttcttgccttattgcattagctaggacttccagtatgagttgaaaagcaatagtgagaggaggcatcattaccttgttcctgatcttaatgggaaagctttggagtttcctatcagttagctataggtatttttagacattctctatcaagttaacaaagttcccctctattcctagttttctgagagtttttatcttgaatgggtattggattttgtcaaatactttttctgtatttattgataggatcatttgatttttctcctttagcctattgattggatggattacattaattgatttttgaatgttgagcctgctttgaatacctgggataaatcccatttagttgtggagcattattctctttatatgttgttgtattcaatttgctaatattttcttgaaaatcttgcatctctgtccatgagagatatgggtctgtagttttcttgtaatgtctttttctggtattggtatgaggataatgctggcctcatggaataagtcaggaagtattctctctgcttttgtcttctgaaagattatagataattggtttaattttttccttaaatgtttggtgggattctctagtgaaccgaacccatctgggcctggtgccttctgttttggaaggtaatttttgtttgtttgtttgtttgtttgtttttcggagacagagtctcactctgttgcccaggatggagcacactggcatgatctcggctcactgcaacctctgcctcccaggttcaagctattctcctgcctcagcctcatgagtagctgggattacaggcacctaccaccacgcctggctaatttttgtatttttagtaaagacacagtttcgccatgttggccaggctgttctcaaactcctgacctccggtgaaccacccaccttggcctcccaaagtgctgggatgacaggtgtgagccacagagcccagccggaaggtaattatttatttattcaggctgggtgcagtggcttacgcctatcatccagcactttgggaggccaacacgggcagattgcctgagtttgagaccagcctgggcaacatggtgaaaccctgtctttactaaaaaaatacaaaaaaattagccatgcttggtggcgggtgcctgtaatcccagctactcgggagactgaggcaggagaatcgcttgaacctgggaggcggagattgcagtgaaccaagattgcaccaccgtactccatcctgggcaaaagagtgagactctgtctcaaaaaaaaaataataataattcaatttgtttaatagatttaggcctatttagattatttcttcttttgtgagttttagcagatcgggtctttcaaggaattgttccagttcatctaggttatcaaatttgtggacataaagttattcatggtattctttgattatccttttattatccatgggatctgtaatgatgtcccatctttcattcctgattttagtaatttgtgtgccctctctatttttcttagttagcctggctagaaacttgttgatttactgatcttttcaaacaaccagcttttggttttattgattttctttattgatttcttgtcttcaattttattgatttctgctctaattttaattatttctttacttctgcttactttggattaaatttgctgttgtttttctactttcctaagatgaaactcagatgattgactttagatctttttctttttcttttttttttttttttttgtgagggagcctcgatccgtcacccaggctggagtacagtggcgcaatctcagctcactgcaacttccgcctcccaggttcaagtggttctcctgtctcagcctcccaagtagctaggactataggcacgcaccaccgtgcccagttatttttgtatttttagtagagacggggtgtcaccatattggtcaggctggtctcgaactcctgacctccagtgatccacctgcctctgcctcccaaagtgctggaattacaggcgtgagccaccatacccggcctagatcttcttttctaatatatgcatttgatgctataaatattcttctaagcaccttttgctgcattccacaagttttgataagttatgttttcatttttattttgttcaaaatatttataaagttttctggagatttcttctttgatccgtgtgttatttagaagtgtgttttttaatctccaagtatttggggattttccagctacatttctgttacagacttttagtctaatttcattgtggcctgagatcagacattgtatggtttctagtcttttatatttaaggggttctgatgcttactatttttcttcagattgtatttttgccctttagtatgtcttgtaatttttcctcgatagctggacatgaagtactatgtaaaaggaactgtggtaaacaggcctgtatgaatgtggtggtgaggtggtgggggacaagaatccttctgtagtcctgtgattgggtgtcaatcttttggtgagccggttcctctggactgggaacttcccacacgcttctcagaattttccccttcctaggtgggacaggatgaccagaaggtgctgcagtttggtatttcacttcccctaggtcagttaagagtctgataaaacactttcaggttaggctgtaattcagtaagtttctcctgagggtagaccttgttaagaaaaactggaggctgggcgcagtggctcacgcctgtaatcccagcactttgggaggccgaggcgggcggatcacgaggtcaggagatcgagaccatcctggctaacacggtgaaaccccgtctctactaaaaatacaaaaaaaaaatattatccaggcgtggtggcgggcgcccgtagtcccagctactcgggaggctgaggcaggagaatggcatgaacccgggaaacggagcttgcagtgagccgagattgcaccactgcactccagcctgggcggcagagcaagactccttctcaaaaaaaaaaaaataataataaataaataaataaataaatgaaaataaaattatattagaagacatagacataggctgctgtccaagtaattttctccccaaacccagagtaataaggacttccctctgccttctgggcttcttcattcagccatggcaccttggctgagagaacggcccgccctctttactcctcccctccagatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggtgagtgcttcttccctctgcctctccactccctcccctccatggcttctcctcctctcctgagctactgcgggcattaccccagcaggcaggcagacctaaagatagaacacggcccctctcctggggctgcctgctctacttctcatcctccgtgaccttgggcatgccgtggaagctcttgacacccctgatgccgtatctgctctgtaggaaaagccagctgtttttctgtaagctcttgctcagtacttccagcacttctgtgaccagatgtgttgagtttttttccacaccaacaaattatccaactctccagacacccactgggtgtcctataatcgaactcaattctgacactaataacccagggttagtgcagacttcataggttaaggactcagtcccacaagactgcgctccttgtcagacaccatctgcagtgttgagctctcaggttacccacaacatctgtctgatttcactacaaatcagaggttctgtggaccctctcctcaggtttgatcatttgctagaatggctcacagaattcaggcaaacagtccacttactagggcgccagtttattacaaaggatatgttacaggatacacatgaacagccagatgaagagataggtagggtgaggtctggaagggtcccgagcatgggagcttctgaccctgtggagttgggagtgagccaccctcccagcacatgggtgcgttcttaatcaccaagggaagctcctcaaaccctgtagttccaaatttttacggaggcttcatcacataggcatgatggattattaactcagtctctagcttccctcccataccgggagggtagggggtggggctgaaagttcccagcttctaatcatgccttgctctttctgtgatcagcccccatccaggacctcattgcctcattggaaccaaagatgcccctgtcacccaggaaattccaaaggatttaggagctctgcgtcaggagccaggatcacagaccagataatagaacaaaagatgctcctagcacccctgctgcttaggaaatgacacaggttttaggatctctgtgtcaggaactggaggctgagaccaacacatatgttatcatttcacagtgataggtcaaacaggtcatggtaatggtgggagctacctcactgggggcctatgggggtgaaaggagatcatgggtgccctcagcacaccacttgggtgaagggttagtaccagaccccacttctggttttgtctgccagcctggggctttttttttccccttacctattagattatttcataactcttttcctaccagaaatgcatctcctgctagactggtccagatcaaaaccctgctctttcactgaggctctcccggttggcatatcctgcagaatccctccgtccagagatcagtcggtcctgtggttgtttcacaggtgactcctctgtccagagatcagtcggtcctgtggttgtttcacaggtgacacctccgtccagagatcagttggccctgtggttgtttcacaggtgacccctccatccagagatcagttggtcctgtggttctttacccctggtggtcatttcactcaccctcatatgcagtcgttcctgtgtccatcttccttcctggagcccacattcctccaggccaggactgtggcttctctctgaattgccccacagcttttttccaagtgctctgctcacagtagacatcaaatagatgcttgttgagtcatggtgcgggaatgagggagcctagagaatatctttctggatcctctactgttgatactagaaggagcctaagaagccacccggctgatggttttctgaccctgcctttatcagcagagccttttttcaaatgaggtgttgcacaaaagcctgatgtgtggctgtgtaaaacagaaataaacagtcttctagccaaagccccattcccacagttcagggggccataggcccaggaattccataggatgtcactgcccaactaggaaactgctcagttagctgaaccccttctgagggccagaggaggacaggatttgtcccaatccagacactcggccagggaataagggctgaaactcatctctcaacctagtccagccctccccctctttggattgtcattatcaagttgattgattgtatattatcaggactctcttaaccacaggtgccagaagcccatgccagaagcccaacccaaagtggcttaaaccaaagagaaatttataggctggtataactaaaagattcagaggtagcactggctcatgcatgagtggaccggggtgacaagatatcagatggcacctgactgtcaccaccacaggcagactgttcaccatctcagctctgtccccttcctttgtcacaatgacgaagccaccgcatctcccggctaatggtgtaccagcctggaaagacagcctccctctctgattggcttcagcacaagtcacaggaatgactgcctggtctgacccgtctcctgtgtgctttctttgggagtaaagagttaacaggcccttcccccttccacagagagtgcttcccttatcctgcggaagctctgcccctggatgaaggaggagagcggctatgttagtgctgatgactggcacactgcacttgcgctaggaagacagcatgaactgcacccctccagggaagccacggcctgggctcccctgcatacagtggttccttaactgggcacgagtcccttgctgggacttaggaaaactctgcctaaagtccattgcaagaaatactgatccctgtgggatgtatatgtggctggttcccttgctcactgagagactagaaaacagcacctggacccctgggctggttccctctgaggaaaggatctgtgtcatgagtgaagcccgggcaggtgtggtctgttcaactttgatcatctggttgagcctaaggtgaccaagagtgggcggtgcacccctgattctgttgctgtgactgaggaaatgctaagctctgtttggccaggcctgggcagcctgcctctggagtaggggtggagagccatcctgcaacacgaggttaccaggagaaggagttttggttgggcacagacatccagtgtccactccaggatgtttgggagacaccttgagaactcttcctaaaagctgcacttaaccaagctcctggtggttctgtgatcccttacattttctccagaggcagagagttggctgactgacttttgcccttgggcagattgtgaggctctacccagcatgctggtatattatgttccctcagatgggggtgagacccttggcctgggggctgtaaaatgatctgtttctgtgaggagactttccatggtgagattgctagtgtctcagagaataaaggacagaaccagtccaagtcaaagcacttacctagctg

SEQ ID NO: 2846 - DNA, 20251 bp, Homo sapiens; identical to SEQ ID NO: 2844
  source 1..20251: mol_type = genomic DNA

SEQ ID NO: 2847 - DNA, 149381 bp, Homo sapiens
  source 1..149381: mol_type = genomic DNA
gggacgccattcccataatgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtaagagaaaggggttgagatgcccgcggttgcccgaggatagtggagaagtgggcgggagccgcgagctggttctttcgctagtgacaggtgcgggcaggtccggcggcggccgccggggcagcgggattttggccgcttctgaaatgttggggcaaaggttggactctagatgagggtcagggttcttggcttgccagggcatgctgaaaggtatccggggagcggcggcggcggcggttctgactcgtgcggttctcttcgtcctccttccttccgtagtgccgctcccacctcaggccttcccgaatgataggttatagtggtttggtttgagtcttatatacgccgttttgacaggtcccggtgccgcggcttatcacgatctcaccggctttacttctctgttcatttcctttcctagaattgtcggcgtccaagttcccttttattctgattcttggtcttccgggaggcaggctgcaggatgtttgcggtctgtactacacaggtggcatgtcagggctccacataagagaaagaaaccctagtttccagttccttgtcaaaggagggagaggagtagggaaccttgggcttatgagagaccacgtggtcttgtgctttagtggtggcttgatagaagccggcagcgtttctgttagacgtgcagcccttcccttctgtttgaaagataatgtaggcctgcaaaaagtagataagtccacttgaggcttaactaactgctaatattcaaacttgtaaaataccaaaggttatacatttaaaatactgaaggatgtatgtggacattttcacacttgtcgaccatatcaagtggcatctacaataacttaaatatgtgaatatgtaacataatttaaaattccttattttttgggaagcataatgtgcctcttcattataataaaacatattttcactttccactgttaccataacagtagtatataattcatagagtgtttcagtatggcatagtgaaaggaacagtaagatttagacctgagttatgtcacagtttcaccactcaacttgcagtatggctttgaggagagttaatttaaatcattgcacctcattatcttcatgctgtaaaatggacagtaattttattataaggattttatcttgattcgttttaatatcttaagaatttcatatttatgagatatcaaattttagttatcctcttatctctgctctttactcctgacaaaaggctgtgatattgggatcattttcagttaagctaataggtggcagacttaggaccttaatttaaccttgatctaagtcttagtctcttttttcttttttggtaggctatatactatgtttgtatgatagaaatccctaaggatgtaaatacatacttgtttcattatatcaaaaaaatagaatcttcaagtgacttaataatagttattgttggcctggcagggtggttcacgcctgtaacccagcactttgggaggccgaggagggaggatcacttgaactcaggagttccagaccagcctgggcaccatggtgaaaccccgtctctacaaaaatacaaaaaaattagctgggcatggtggcacgcctgtggtcccagctactcaggaggctgaggtgggaggattgcctgagcctaggaagcggaggttgcagtgagccgagatccggccactgcactctagcctgggcaacgtgagactccatctcaaaaaaagaaaaaaaaaagttattgtttttattataatgttagatgtttattactgtggggaaattggacatttcctaggacacccatgtttaccttggcttgtggtaatgacaaataagtccccgctggctattgtaagttaaagaacatttaaaaattcttaattcacccaacctagtaccaccttattttaaaaagtgaatttccttaaaatagaaatctgtaagtctataagttaaaatataagtgttattgtctctcattaatgtcacgtttttgtatatagagtaattggtagcattgacactacaggatgataggagcaatatgtgcattgtgggcgtttaactttatgaagtttggtattttcaaataagtatatttttgcttttttacaaaattaatgtaaattgttttatatatgtgcgtgtgtgtgtgcgtgtatagctgtataggtacagtgtctcactatattgcccatgctgatcttgaactcctggcttcaagtgatccacctcagcctcccaaaatgctagtattacaagtatgaaccatgactaaatacaagaggctcataaatttaagtcatttcagtgcttttattttaaataaaagtaaactgagggccacatatttagataaaagcagattgtgcaagtttatcctcacgttaattttctcttaaaggaaaaaaactgcaagagaaagatggtactgggagttgcagaaaccagtttggtttatttgtgagccagtttatttgcaaattagcaagtgaaacctgtccaaaaacaaagtagtagagagcaaaaatttgattcagaattttaaagagaataatttgataagtataaatttgatgatgaacttacaggtacagaactggtggtgatatgtaataatttagtttatgtttttggaactcactagaaagttgtttttccttttaatatctttttttaatctttgaatcaggttatttgaaatttgccctgtggaatattgtcgtggcatatgtatgtaactgtctaggaaagactgattgggctgttgagaaaaaatggtgggtttaccataagtttattcttgaaagtttaatacacatgtctgaagttatagtcatatgcatcacagtgaataaatttcatttactagcttttgagcactttgcagataatgactgtctcatggtaactcgggtaactaacttccatacctaggcaagtataaagatttatttcattctgtgtaagtactacagtttctctttatttgtaagcagtgaatgatttttatctaaaaactgattttctagagatgaaaataagttacacaagtgtgagatgaagagaaacatactttatgatgtatttagttctagactttatattgagaagtaaatcaaaattaatacgagagtaatacctttttaaaaagcaagaagaaggtagcactgatttgtataaggaataaagcagtctcaaaatgatatttgttgatctgtgtttcaatttcaacaagagatcagaaaaacacgaacaaaatttagagtttaggaactataggaaagagataaatgaactagaattgtatcgcttaggatgaattaaaaacaattttcagatacatggtggtttcttctgatgagacaaaaagataatttgcttaaggtacatatgagtattttaggaacatatttaaggaatggtagttaatgagttacaaagaaaattatgggttataaaatactctctttggaaaaaaagtttttgaaacagagtctcgctgtgtcgcccaggctagagtacagtgcgtggtctcggctcaccgcaaccacctccagggttcaagtgatcctcccacctcagcctccgcagtagctgggcctgcaggcacatgccaccacgcccagctaattttttatttttagtagagacagggtttccccatgttacccgggttggtctcgaactcctggcctcaagtgatctgcctaccttggcctcccagagggccgggattacaggtgtgaaccacctgcaaaatttctggcctggaaatttttaaagaaatgggcctattatgagtaagtaaaacataaccacaaatcatccaaagcactgcttcgtttccaccatttttattaaatgttattcatctgccaatcattttcagtaatttttatgtgtgattatgttaagtggtaatgtgtagttaacttttgcagtttagcaaaacattgcatgccatttttgtataaaccctaataactgtagtaggtaactttacagagtaagtaatttgtgtgtgaagtcatttaaaatctctgtgacattttcatttcaataattgccaaagaatctgatcagtgaagttttagacaagagacattgatttcagtttttagagctttctgtccattccgacttttacttagaaatctttgaggcttaattttatttgatcccttatgttcgtgcaactttgaaactaaaagaaaataaccttatactcacaaatcccttaataatgaaaaggaacactattactcaacatgaatttcaaaatatttagtgtatacttaaagaaatttttatattactattacttttaaaattagtttcagtagtgccagggtgtttacgaccagagtagggtatatactacatcatttataggaaatgaaactaaaaggaaaaacttcttcagtcttggtaaattggtgaaaacaaggacagagatagtgaccttaaggcatgtttcacatcttagatgcttaaaaatctaggaaagcaacttttcttaatttaagcctttttcgtaagtttttaaatgacttctgttagtgagtccagggttaatgtaccctaatagtccaggaaggtccagagctagtcaatgatttcgtttatctgttttgtgaaattaaggctttttttcctaaattataccattttcctgttagcacatataaggcattaaatgacctttttgcaaaatggttttgtgacagttaacaattttgcttctacgtaagtgtaacaagataaaatcagtttgtcaggccatgacctgtaatattacatttaaaaacactatgtgccaggtactgttataaatgcatattgacttatttactcatcaccatattaccacaattctgggaatcggtgttattcacatttgacaaaataggaatcataggctcaaaaaggttttcacatagtggtatagctgggatttgaacccaagtagtttaggtctttggtttgtgcccttaaagcactgtaccacattgcctctgattttatttaaaaaaattttttctagagacagagtctcgcttcatcacccaggctggagtgtagtggcatagtcatagctcactgtagcttcaaactccttggctcaagcaattttcctgcctcagcctctgaaatagctggaactacaggtgtgcgccaccacacccagctaatttttaaagtttttgtggagacgggatcttactgtgttgcctagactggtttgaaactcctgacctcaaatgatcctctgacttcagcctcgcaagtattaatagctgggattacaggtgtgaacccctatgcccagcctctgtctcttattttaaagattcattttttaaaaagtagattcactttaaaaagaaaagaacctatttttctttttaaaggaagtctattttatatttagtagcagaattctaccatttgcctcttgtgactgttcagtttagatatgatagaacatgtaggaaatcttaacaccttgcttctggatattaaaacatgcttaaagattgataggtgaataattgaatgtacagagcaaatgtcattttgatccacaagtacattcagacaaaaaaatttgaggtcatttactattgagcttttgaattttaattgtctatcaataatcataagctcttattagagatgatatggccccttcacatatagttttacagaaataacccatgaagcatatagtaagatcttgtaggctattttgtttcggtacttggtccatattttaaaagtatggtattggtttactataagccacaaatacatacggctttcttcttggacttaaatccatatgaaccactcagcacagaaaatgcaaatatgaatgcattattatgttcaccaactgattttttccctagagataactcttaaagaatttttgaagtgaaagaacatttaaattaagatagtggaagatacaatgataataaaacagtcaattttgctatcttagtcttgaatttatcttatgatgtgagtttagagtgattcttctttttttcactgaaaatcacttcattaataagtcatgattattgacaaaagtaaattgaaaccattgggcatattggtagggaaataaggggaagatagagaacaactgataaaggttgattatgtgcattacgagatttgatcctcaaaagaaggaccaaaatatatatatttatatgacttatagatgaggaatctgagagaaattaatttgcttgctcatagtttactaccagcggacatttattaaatgcttagtctgtcgcagccactattttaaatgctttacacttacatagcctttaaagtacatgctcttattacacttcattttatctttgatgatttcagagctggtttaaatacctggtttataaagatttaaagtactagatactatctaatactaagaatagatccttagtattaaaaatggttttatgctgtcactactcgaatgtaattcaaacaatatttcattaaaccatgggaatttctcttttttcttagtccttgtatagaatttttcaacaattactaaatactttttttcttccctgagtaatgtcagtctagcttgtttcttttaatttcctcacttaccactgtaattcacattctgtgtctcatattcattcctctgaagccacttcgccagactcgttctcccatttatcctttaaacaggggaatgtagatcctttagattttatcacccagtttacacaaaagtcactattcaagaaatctagcataagcctagtaagtagcctcagttttggatacagattaaaattatttgagggaagggtcaaaaatggctccttacaaagaaggaaataagttccaattataatataaaacagaaaacccctgtaggattaacctgcatttgattatgtctagactgcctttactacttccatcactaagattctacatggtttccttatagctctccaaaaagaaaagagtaatgatgcctttttttcctccaaggaatggagaactaagaatgctaactgtcccttccattctccctttagttttgagaagacccagatattagcgtggtaattccccaccataagagaaaatcatttagcagaagtaccagtagcaaggacttctttgtgaaggaagtcaaagatctcacaaagaagttcaagggtggctctgaggccagggtattctaagtttagagccagttaaatcaagacctgagaacatttagagacaaagttacttaactgaaaagagcatcaagttccttgttccaggtagaaaacacctggtaatctggattgatttctgttatttacccatatgtttttacagcttaacaaagtttaacaggttagtcaagagatttgcctttgataaaaagatgggaaatttatattcatacatttgaatggatttcaagctgaagaactttttaattctcaggagagatgtagctaagtatttatatgtaccacatagttgtggctatggtttacaataacttattactcatttactatgttaagagcattttaaaagttctctagatacaggttccatatataatgtaatatatttattccaaatatattacatatatgaaatacatggtagtattctcattttaccagtacagaaactgggatagttaaatgtatatggtcataacacttagtcagtggtagagcaggaggtctaacttaaagcttgcattttaaattctaagtgtactgcctgcctatgtgtgatagagccatacccagattatggaagcaactttttgaaagacaaatacttgaaagtattaaaatcaagaaatgacagctttgtaatacttgttaaacacattttcatttgttattaatatcaagagcctctagaattttgtgagtcttcttgttttagccttgtagtctcagcagtctcatttctaattaacatatctctgttttgatacagatagtgtctcccatttcctgcaaattatttgctttttcctgcttttggggcctttatgccccatttctgttgtttcagatacttcttaaaaattactgactttcatttcaaaacctagttcaaagtcagtctctaaaaccacctctaatctcatccaaatttgtggcccctccattctttgcttttaaaatatatatgtatatataaaacagctttattgtgatgctattcacataccttacaatttgcccacttaaagtggacagttcactgggttttagtatactcgaaagagttgtgcagccatgaccataatcaattttggaatccaaaaaggaacctcatacccattaatagtcacctcccatttctctcccaaactcctctgttctaggcagctactaatctattttctgtctttatatatttgcctattctggatattttatataaatggaatcgtatagtatgtgcgatttttgcatcttgcttcttttacttagcatacatgttttctaggttcatgcatgttatagcatatatcaatgtttatttttactgctgaatgatacagtcatgagtcacttaatgacaaggataacttctgagaaatgtatggttaggcaattttgtcgttgtgtgaacatcttaagggggtacttacacaaatctagatgggattgcctactacatacctaggatgtattgcctattgctcctaggcaaaaaaaacctgtacaacatgttactgtagtgcatactgtagtcaattctaatacaatggtaagtatatatatatgtgtgtgtgtataaatatatatatgtgtgtgtgtgtatatatatatatctaaacatagaaaaggtagagtaaaaatacaatattatgatcttttttgtttttagagacagggtctggctctgtcacccagactgaaatgcagtagcccaatattggctcacattgcccttgatctcctgggctcaagcaattccactgcctcatcctcccaattagctaggactacaggcaagcaccactgtgtctattttttatttttatttttttgtagaaatgaggatcttgctgtgttgcccaggctggtcttgaactcctggcctcaagcactcctcccaccttagtcttccaaagtgttgggattataggcatgagccactgtgtctagccagacataatgtgtctgttattgacctaaatgttgttatgtggtatgtgaccatattccattgtatagatataacacatttgatatatccatttatcaattgatagacatttgaatttccaatttttgcctattttgaataatcctgctatgaacatccattacaagttttcatttctcgtgtatatacctgtaagtggaattgctaggtccctgtttaactttttaaggaactgctagactgtttttctaagtggccgtaattttacattgccaccagcagtgtatgagggttccagttttttcacctcgtcagcacttatgttcttttttttaatatatagccatcttagtggatatgaagtagtatctcattgtagttttgatttgcattttcttgataggtaatgatgttgagtatcttttcacctgcttattggccatttgtatgtcttttggatgtctgtccagattctttgcccatttaaaaaatttggttattttgtctttttattattgcattgtaaaagttctctagatacaggttccttattaaatagttaatttacaaatttttctcccattctgtggattttctttttactttcttggtagtgtccactgaaacatggaagtttttattttattgaaattcaatttgcctgttttttcctttgtcacttttgcttttggtatcatgtctaagaaggcttggcttaactcaaggtcatgaggatttactcatatattttcttttccaagttttgtagttctggctcttacatttaagtctgtaattcaatcgagttaattttttgtgtatatggtcaggggaggagttcaatttcattcttttgcatgtggttatccagttgtcccaaaactatttgtcaaaaagatcattcttttccctgtgcaattatcttggtaccctgcttgaaaatcaattgactgtaaaagtgagggtttatttctagattctatatttgattgacatataccagtaccagattataactgtgtagacagttttaaaatctggaactgtgtcctccaacaacttttcaagtttgttttggccctcttctcttattagtttacactatgttgaaatgttgttttgtaaatattcttaaatatgtgtatttcattactccgtataaatgacacactcatctttttgcagcctgtcttcttaccttctctcattcgaaatctaccccatctctttatttcttagaggtatgtggtatagtagtatttgcagtgaatgttttgtgtcatttaacccatggatctctcttccactcctaatctcatgccccaaaagcacaaacaatgcgctgtcttaagaacatagataagtgtgctaattatcaaaaacacatttacagtacctggaaaatgtaagacaacaccctcagcagatgaaaatgacctggcatcctaaaaggaggctaaactcacattaatccttcaaatgaaaaaatcgtcacatcataccctttaaataatgctttaaaacattcaaaattatttatgaataattatttatgagtctttgtggaaatgcagttatgcaagaaaagtataaaaatattcatggaatgataaatgctaaatcagagtaagggtattccaagagaggggcccacaaggggctatattaatatttatgataattttctttaggtgcttgttttgatggtatgtatatagatgctcgttattattcgaagtttaatgtatgcctttatatgatacaaaatacttttaaaaagcgaagttgattgtaagagctttttattttgaggaagtcccaatttttcttagttttttctgtttattatttttatattgttaataccaaacctaattctcccggtgtagaaaagttacacagagctgagagaatttatgtagagtcaagcattattaattatcatttccttcttgcttcatatatgcttatcacgcttatatgtcacatatggttacaagatatctttagtatggagagacatacacatttaagatattaatggtcatgtatgtgtattctggatgaatagtttaaaaacaatcttacttggcctccttgagtttcttatttgtcttagtttagatctaaaaagagatcataaaaattatttattgctaggtgatggatttaatgtgtggagaagaaaataggttagaagtgcatggaatctaaaaattaagctataaagagatggtaaactattccattggtttatttgagtgaatttcatagttttatttgtttcagttttactgaaaccatgaaattctgagtcttagtttgtggtacttaaaaaaaaagtcagtgaaatatctgatttataataatttaaaatactagatgctgccagtatctccttagtgttgaaaattgttttatgctatcactactcaaatataatttaagcattttgttaaataagagaattagtcataagagtgaattagtatccagaattgtttatgccattctgcacaagatgattataaatatttttctgagattaagtgtgctacattggattaggctgagatttttgtgtatttttttacttataaaaggactgcctatgcctactctgtaaagaggcagataggatttcaaaaaataaacaaggttatatttattttaatattaggcaattaagcaggaacatttatctgaaaattgtcagcataaacatgtacaaatcaataacaacaaaaaaactgctttactacctctctggtttcctaaatcctgctgttggaatttccacatattccttttatactctgttgtatctggaactatttcttaatcatttgttggtccttgtatatctttcttaaatttgcatctagtgtaaaagcaccaaacaacttttgatattctctttctccctgccaactccaaaaccttttacattcatatagtagctttactgcatttgaacagtgtcttaaaattgactctgaagccccagtttctccagagccattgaaaattattctatccacaccataatacaaattatttatcataatgccttcagaatatttagcaccatacaatttagatcattttgaggtattcatgttaatataactttatgtaagtttttgacgtagtatttcacatgtatttgatcgttccagtaatcttgtgaggtagtcccagtggtcttcatgaaatgtaaatcaaatcatatctctttacagttaaaaatctttcagtggttttcagattacttgagatgaaatccttgtcattgcattaaaggcactatttagttcggtctcagtctaactctttagtctcatctaccatttctcccccaccttgtcataaactccaactttatttagtcattccttcaacactcaaaattcccaaagtccttctggccttagcatgtcatcctcattcagtttagatactttttcttaccacttttcttggagtaactcttattcagaggctaaaacattttttcagagagattttcatttattctatatagggccctcattatatgctttcatagctccctgtacgtttacttcacagcacttaacaatattttattatgtaccttgattgcttacttttcctctctcctccactggactcttgaacaaagggaccttggctgttttgccaaccactttattcatatgaagtattttttgaatgaatgaattcccatttctaagatggacagtcgaagggttttattgctgagtaacttttctaagacttcatagcaagtagtgtcaaaaatagaagtttggtgtggtgctttttctatagtaaatttagaatttatatctactcaagtctgatttcaggagataagaatatatataaacaaaaataatcatgaaaacaaattgagattggtatgacaaattcatccacagtttagtgtttgctacatttctaggaaacttcttcagagaatggtagtgtttttgtgtgtgtgtgatctttattgatgtgaaaacatgaatctcttataggcatgcgtgtgaacatttgggctcttattctacgaagtttctgatagtcaaagctctaaccctaaagatactcactttgaaaatactcattttctcaataagtaaagtggattgttagaaattgttggaatttatcttctaaataagccttccagttctatttatagcttggtgataatgttatcatatcctctgctatctcacttttaaaagtgaacttattgtttcataaagagggagtgtggtatatgattttactaggcatctgttacatttctaggtctttgttaaataaatggaatttaaagtttggtgtaatgaaaagaacactgaactttagagtctgaaaactagagtgcgggactttgtgtacccaccgagtagtgttacatgaccttgataagttatataacctctctgagttttggcttttccttctgttaaaaaggaggctgggcacagtggttcacacctgtaatcccaacactttgagaggccctggcaggaggatcacttgaggcgagcagttcaaaaccagcctggggaacataggatttcaaaaaataaacaaggttatatttattttaatattaggcaattaagcaggaacatttatctgaaaattgtcagcataaacatgtacaaatcagcaacaacaaaaaaaaaaaacggtgcatttactacctctctggtttcctcaaattagacctgtccctacaaaaaatttttaaaaattaaccgggtgtggtggtgctgtctgtcgtcccagctacttggaaggctgaggcaagagaatcacttgagctcaggtgtttgaggttacagtgagctatgatcacaacactgcattccagcctgtgcaagagtaagaccacctcaaacaaacaaacagataaataaatgaagataaataaaaggttgctctaccctgtctcaaaggaaggagggaagggagggaagaaaaaggttgctctaccatcaactaatataaaaacactttgtacgaaaaccttatataaacattaaacatttatattatgcagatactaagattttaaacagaagtgagatgatcacgtttgtggttttaaaatgtttggcagcagagtggaggacagcttggaagcaagcaaaacttaaagtagttggacaaatcaagcagctatcatagtaatctatgccactaaaaatagtgtggaaggggagctgcagaactaaagtacttttctgaggatgaagaggcgaggggcagactcttagaaatattctggaggtgcttggttaatggatgttatggagcggggaatataggttaatattctggtttgtggcttgggaaattaaattactgatgaagtcacttgttaaagtaatagtagagaatgggtaaatggagagagagaggattgactcaaggttgagatgtctggaaaatccaagttgacatggactaataggaattggaaatacgattcaagaacttgaggactagctctgagatgcagattttggaattattgatatgaattataggagaatataaacagtgaaagaagaaatcaaagagcagggctatgtaatacatttaagcaaaagagaaggttgtaaaaaaaattgggaggagtatcacccccccacccaaaaaaaaaaaagaattacagaggctaatttttagagggattaatagatatataaaattatgaatccgttggatttgttaaggtggtcattggtgatttgtgagggcccattagactaggaagacctgtaagtgaaagttgaggaaatggaaacttgagaagcttgactgtaaggacaagtcataaaatgagaatagatgagaaaatacgagagttgagaggtgatatgaggggagaggaggaaaagacttaatccctgttgaaatgctggtaggaaaaggtctccaaggaagcagaaggaaattagatccacagcataggagcaaaaattattggcctgggatttgaggaagattacttcctctactgatacgtaagggaatcaggtaagattcaggtgtgatgcagtagagttggacaggcttctgactgctttgtaaggtaggtagcaaggttgttcaacctaatgggttagagactaggtaagactgccaaaggtttgaaataattattgaggatatagaagggtatgctatggacatggtggaagattacaggtcatctttgaaggacttgagagattgaaaaccataggtcttcagtctctatatcattttctttagtaactatgaacccagataatattaacattatgataaaaataatttcagattgatgtatgtaagaatcgtgtgtaatgaccaggtatgaggcaccctcataaaattccttgtaatcctctgaaacaggaagattatagtgattaagccatagatcttttagattatacattggtacatttacttcataacttctttacaggaacacagtcaaatgtcttagtattcagaaatacttcacctttggtttcatttataaagcattgactcctttgtataagaaatttagcctgttcatcacaaaacaatttaattactactctgggctgctcaagatggtttgtacattagtatttagatgaattttagatggttgcaggtctgtagttagtataatatttggtaccaaaatttgatcagcttcaaatcagtaaatatgtcagttttggaattgtttgttttgcttatattatcttccaagatataaagggtaataatctgtcctttatgtgcttttccttttatatgagatatcactcatataaaatcatatatgagataacactcattatttttctggcttattcactggttgctctagttaccaaaaggaagtattttctcaggaatgaatacactaccgtatatcagaatcacattttgataaatttagaaatgattgcaaatgaattgtgcttttccaagtcttgaagaaaattcttcaagacttacgtaaatttttaattaaaatctaatgcaaattcacctgtttagaaaaagtacaactataaaaaataaatacaaaagatcatataaagttatgaattttttcagaaataaaaagtaatgaataaaaactgtgccttttatgcattttgctgtgtatattttgtcccaatttttaaatgtgtttgtaattagttttcttatttttatgcataaaatttccattgttgactgtcactgaacactatcacttttgctagcctcaatattattcttagtctatttgactgtacttcattctgtgtgcatatatgtgaagatgtatctatacataacttctgtgttaaacaaaagacgtttactcttgctgttaaaactttctggcagattttggataaccctccttgcaccacttgataataactcacaagctgcaactcttctgaattccacttccacaagcagacaatcttttttaagataaaatgtcatgtttattatggtatttatatatttcctaaccattcaacacatgtaaagctgtgctactgtttttattatcttctttaaaacatgtcactgacagtgcttcagcaagagaaggaaggggatggtattagggaagcatgcaaacctgtacagcatgttaccatactgaatagtgtaggcagttttaatataatgttaagtatttgtgtttctaaatatagaaaaagaacagtaaaaatggcatataaaagatttttttaaatggtacacttatttagaacacttaccatgaatggagtttgcagggctggacgttgctctgggtgagtcagtgagttagtagagagtgaatgtgaaggcctagggcagggttgtcccatcttttggcttccctgggccaaatcagaagaagaattattgtcttggaccacatgtaaaatacactaacgctaaaaatagatgataagcgaaaaaaaaaatcacaaaaaaatctcataatgttttaagaaagtttacgaatttgtattgggctgcattcaaaggtgtcctgggccacctgtgggcctcaggttggacaagcttggcctagtgcattaatgtacactgctgtaatctttataaacaccatacacttaggctacactaagttaatttaaaaatattttcttcaataataaaattaactttagcttactgtaacatttttacgttataaaccttaaaaatgttttaaatgtttttgactcgtttgttataacacttggtttaaaacaccaatacattatacagctgtacaaaaatattttcttcatatccttattctataagcttttttctatttctaaattttttctaattaaaaagtttttttgccgtaaactaagagacaaacacacattaacctaggcctgcacagtcagggtgatcagtatcactgtcttctgcctccatatcttgtcccattggaaggtcttcatgggcagtaatattcatggagctgtcatctcctgtgatatcagtgccttcatctggaatacttcctgaaggacctgcctgaggctgttctacagctaacttttttttatatataagtagaaggagcacactctaaaataacgattatagtaacaaagtatagtaaatacataaactcataacagttgtttattattgtcaagtattatatgctgtacataattatatgtgctatactgttgtaagattggcagcacagtaggtctgtttacaccagcatcaccgtaaacatgtgagtaatgagttatgctacaacatcacaatggctacatcattaagcaaaagggcttttttaggtacattatggtgtatgggaccaccatcatatatgtagtttgtcattggcaagaaagtcattatgcagtgcatgactgtatacagatggtcctcaacttaatgatggagttacagcctgctaaactcattagaaattgaaaatattgtaagtaaaaaatccatttaatatgcctaacgtaccatacaatataggttagactagcctaccttaaacatgcttagaacacttaaattaatctacagttgggcaaaaccagctaacagaaaatctgttttataataaagcattgactactgtactgaaaatgaaaaacagaatcatcgtatggatattagaaatatggtttctgctgaatgcttatcagtttcacaccattataaagtccaaaaatcttaagtcacaccgtaagttgaactgtctatatcaacttttttcattgtagtaagaatacttaacatgagcgctgccctcttaatttttttctgtacaatataatattgttaactataggcacaatattgtacaatagacttactcattttgcataactgaaactttatacccactgaatatcatcacctccttatttcttcctttccccagcccctggcagtcaccattttactctgtttctatgactatgatgttttagatacctcataagtggaatcatgcaggatttgtctttctgtgactcatttacttcatttagcatagtgaccttcaggttcatccatgttgctgcatatggcaggattttcttttttcaggctaaatagtactccatttttctttattctttcatccatcaaaagacattaaggttgtttccgcatcttggctattgtgaataatgctgcagtaaacatgatagtacatatatcttcaggactctgattttaatccttttggatatgtacccaaaagtaggattgctggatcatatggtcattctatttttaattttttgaggaaccttcataccattttccatagccagtgcaccatattatatagtctacaagagttccaatttctccacatcctcaccaacagttaccttttgtttttttcaataatagccatcctaacacgtgtgaggtgatatctcattgtggttttgatttgcctaattaagtgttgtaacaccttgaaattttcaaaaacaagcattagaaaagaaccgactgcatgtataataagatagagctgtaattgattttttcctttatgcatgatctgttgtgccagtaccttttatagaatagtccatctttgcctattagtttgtaatgatgcttttgacatatgtcttcatatatatgtgagtctggctcttatttctttccactgttttcattggtctttttacttctctctatgccaatatcacattttcttaatcacagctttgacactttgtaaccttgggcaagttaatttctgtgtgtatatatactccatctgaaattaagataatagtacctacttcattgggtaaatgaaaatatatgaatgtgcttagaagtatgcacatggctcaagagtaaaactcaaatattagtgattttgttattaaacttaataaaggtaataattaaccttaatatgttaataattaataataaattaagcttaataaagaggcttagtaatgaggaaactgagatttccactttgtttttcttccagactttctggggaagtggggagagggttatggagggattccctgaagcagtgacatttaggcagatatgtgaaagattatagttgttaactatgtgtcttagccccttcaggctgctataacaaagtacctgtaagtggcttaaaaacagcaaatttatttgtcactgttctggaggctggtaagtccaagatgactaggtactggcaggttctgtgtctggtgaggaggacacagcatactttctggttcatagatggaaccttctagctatagtggaagggatgaggtgtctctctgggagcctcttttataaaggcataaattccattcgtgaggactctgcccttatgatctaatcacctcctaattccctatccttgggggttaggattttaacattaattctgggggaggagacacacgcattcagaccatagctctacatgttgaaaagaataagggaattttctaggtagaaggggttatgaggcagaaaatggtgtgtcaaggaaatgaaagaaggctcttgcagctggatctgggcacaaagaaaaatggtaccagctgagtctaaagaggtagctagggattagatcatgcaagaccttttagacaatgttaagcattttagacttcatcctacatagttataactatttgtattggttgatatcctaatgactttaagtccataaaagaaactcaaagtgaaaattgggcttatctggaccctaatagtatataaggattaagaataccattgagaatatatgaattcaggtctttgttcattgtttgtagtctttgtaatctgttgattccgttctagtattttatcagttcagattgaacattgggaattttggcagatttcatagatgtagaagtatagtttttacagtgcaacagatctatataaatgtattgaaataaaatcttttcatttatttgtctgtgtcatctaatcttacctttcttagtcttctttcttgtctacgtcttctaatctcatctttctaatatatacctaacaacactatacattgtttctggagtagattctcctatttttctttttctgtttgctttttgagacagaatcttgctctattgcccaggctggagtgcagtggcatgctctcagctcagtgcaacctccacctcctgggttcaagcaattcttgtgcctcagcctcctgagtagctggggttacaaaagtatgcgccaccacacttgactaatttttgtatttttagtggagacggggtttcaacatgtgggccaggctggtcttgaactcctggcctcaagtgatccagccatcttggcctcccacagtgctgggattacaggcgtgagccacagcacctggccagattctcctatttttctactttcctgatgtttcattaccataaaattgtgtagatagccctaagagaaatatggtgccctttttcaattgaagatagtattgaaagcaattaaatatcatcaaatgggaaagtctcctatcataatagtatcattgtacagaaagaagtcactacaagatctaggaaagatagttgatacagaaatatatgacaatagacagttgacatagaaatgtatgacattatagaaggtttaccaagtatatacttttagtaccgcagtccctttttatctgcagagtataagttccaagaccctcagtggatgcctgaacctgcaaatagtagcaaaccttatatacactgctttttcctatgcttacatataataaagtttaatttataggccaggcacactggctcatgtctgtaatcccagcactttcggaggccaaagtgggagggcaccttgagcccaggagcttgaaaccatcctgggcaacgtagtgatatctcatctctacaaaaaataaacaaaattagctgagtttgtggcacatgcctgtagtcccagctactcaggagactgaggtgggaagatcacttgagccagggaggttgagactacagtgagctgtgatcatgccccactgcactccagcctgggtgacagagcaagaccctgtctccaaaaaaaaataaataaataagtttaacttataaattagccacaggaagattaacagcaacaattaataataaaataggacagttatgacaatattctgtaaaagttatgtggatgtggtttctcaaaataccttactgtactgtacttaccctttttgtaatagtgtgagatgataaaatgcataggtgatgagatgacatgaggtaaatgacataggcattgtgatgtaaatggaagatttcagaaataatttataggttttaaattacatgtgtgctgcatagcatgatgaaatactgtgccattccacccaaactgccttcaagccctcttggttatcaggttgactgttgcagtatcacaatccttatgttcaagtatcccttattttatttaataatgacccaaaatgcaagagtagtgagagtaccacagttgacagttaacccgcagaaagtgaaactgcagataaaaggaggctactgtataactgtaaaggatttattaagtactttgggagataaaactctatatcttaaaaatgtctaagtaactataaatagaatttctatacttttccacaaattgtttttaatgtgttttataaatgatatttgtaactgtagtattaatgttatctcaagtccatattctatttttaatggatatggcattagctttttaagaaaactaacgggaaattttgcatttccattttaaagggaaaaatcagtaactaagaaaaattaactgaagatcagagtctaccctcccaaatgatactatactccccagtagtttttcatacaagtaaatcattaaggggcagataacccgttacaaactacttttgtagatagtagaagagtaaaagctattccaggtttgttcagaagagtacaggagaaaaagcttggcaagtgcagaaaattttcatcacctttaacacttagtcatgatagtctaaacaaatgttgaatagaaaggaacttctctaagttcataagcagtatttatcaaaaacctacagcaagctaataagcagcatttatcaaaaatctacctagtggtgaaactttaaatgttgtcataaaaaaaaagacaaaaatgtttgctgtctcttcacctatattttaggagccctagccaagaaaaataggcaatagacaagaacaataggaatacaattagaaaggaatgattaaacacattatttgcagcaacagtatgagtttttacatagaaaaatctaagggaacctacaaccaggtaaaactactaagagttcaggatgctggtggatatcagattaatcacttaaaaaaattaggctgagcacagtggttcatgcttgttatcctagcactttgagaggccgaggcaggcggatcacttgaggccaggagtttgagaccagcctggctaagatggcaaaacccggtctttactaaaaatagaaaaattagctgggcatggtggcacaagccataatcccagctactctggaggctgaggcacgagaattgcttgaacctgggaagtggaggttgcagtaagccaagatcgtgccaccacactccagcctgggcagcagagcgagaccctatctccaaaaaacaaacaacaaatattatttctatgcatcaactacaagcagttatagaatttaattaattggggaaaaaatgtaaaattcacatagaaaaactgaggtttctaggaacgaatttagcaaaacatgatttttattggaaaaacatataaaatttattgaaagacattaacctgaataatggagagatacgccgtggctgtggataagaagactcactttggtaaagatggcagtgtccctcaactttgtaagtgtaatgtacttccaatcaaaatcttattagacttttttgtggaactttgcgaagaaagcaagtcgaatgtctgagtataagtaaagtcattgctagtctagtcaatatttattttagaaaataggattttcttaagacttagtccctcaattcttttctcacaaatcttaaattccacaatgtgtgggggctttcaattgcataatcttgacagtgagttcagaatactggtacatagataattctgcatatccacttttagggagttaaactcatgaatattctttaagaaatctgaggttttgttaggttagtgcctttgctttagctattttcggacgtaactgtgggtttttgttcttatagtgctatatatggtaagcatagaaaagaaacactagaatggataatcttctaaaaagctttgttacctgtagtattacacacatgagctttaaatctctcattaacctttatctttacctttgattctgcttgtgattgaacctggttaaatgtgggagaaatgtttctagaaaaatttaaaatcattgtgaaccaatgacaaagcagtattttatagcaggcatactgtagtcagaataaatttttacaatgttttaggtttttttttaatgctttctatcctagtgaactcttgttttactttttctgtcattggtcatctgatgagaagctagtttctaggcagctgaaaataagatggatatagtttcagtaatgtttacagtgttagctgtatcacacttttgaaatcattcaaaaaccaatcctgcttgccccatattttactactataggaggaacagtcagagatagtattgttgttattaacttctgttggtaaagaagcttaattaaggttttaagagttgattatactttctattaatatttttatagatttagggactacaaatgcagttttgttacatggatgaactgcataatggtgaagtaagggcttctaatgtagccatcagctgaatagtgtatattgtactcatttaataatttatcatccctctcctgcctcccacccttctgagtctccaatgtctgttattcacgctctatgtgtatacatgatttagctcccacttataagtgataacatgcagtatttgattttgtatttctgaattatttcccctaagataatggcctccagttccatccatgttgctgcaaaaaacatggcttccttcttttttatggctaagtagtattccatggtgtttgtgtctttgtgtttgtgtatgtgtgtgtgtacatgagtgtgccacattgtctttatccagtcatccatttatggacacttaaagtgtttcctaagataatggcctccacttccatccatggtgctgcaaaaaacatggttttattcttttttatggctgagtagtattccatggtgtgtgtgtgtgtatccatatatgctacattgcctttatccaatcatccactgatggacacttaggttgtttccatatcttcactattgtgaatagtgctgtgataaacatacaagtgcaggtgtctttttgatagaatgatttcatttcctttgggtatatacctagtagtggaattactagatccagtgatagttctatttttagttttttgagaaatctccatactgttttccataaaggttgtactaatttccattccctccattcccaccattccttttcttctgcatccttgccaacatctgttatcttttgagcttctaataatagccattctgactggtatggatgctttttcactgtggttttacttgtatttatctgataattagtgatgtggaattttttttcatatgttgaccattcatatgtgttagtttgaaatttttctgtttagagtaaacagacaatctacaaaatgggagaaaatattttcaaactatgcatacaacaaaagactaatatctggactctataaggaacttaataagaaaaaaaacgcccattaaaaagtggacaaagaacatgaagagaattctccaaagaacacatacagacagccagcaaatgtatgaaaaaatgcacaaaatcactaataatcagagaaatacaaatcaaaaccacagtaagataccatctcacaccagttgaaatggctattattaaaaagttaacagattttagcaagattgcagagaaaagggaatgtttaatatgttattggtgagaatgcaaattagttcagcccctgtggaaagaaagcagtttggagatttctcaaagaactaaaaatagaaataccattcgctcagcagtcccattactagaaaataaatcattctaccaaaaagacacttacactcatatgtttatcacagtactgttcacaatagtaaagacatggaatcaacccaggtgcccatcattgatggattggataaagaaaatgtgatacatggccgggcgtggtggctcatgcctgtaatcccagcactttgggaggctgaggtgggcgggtcacctgaggtcaggagttcgagaccagcctgaccaacatggtaaaaccccgtctctattaaaaatacaaaattagccaggcgaggtggcgcatgcctgtaatcccggctactcggaaggctgaggcaggggaatcgcttgaacccgggaggtggaagttgcggtgagctgagatcgcaccattgcactccagcctgggcaacaagagcgaaactctgtctcaaaaaaaaaaaaaaagtgatacatatataccatgcaatactgtgcagctatcaaaaagaatgaaattgtatcctttacagcaacatggatgcagctggaggccattattctaagcaaattaacacagatacagaagaccaaatactgtgtgttctcacttataagtaggagctaaacattgggtatacacgaacacaaaattgagaacaatagacactggggattccaaaagagaagagggagagaggggagtagcggttggaaaaaaacctctcaggtaccgtatttgctactgggcaacaggatcattagaagccgaaacctcagcatcacgcaatatacccatgtaacaaacctgcatatgtaccccctgaatctaatatttaaaataaaatttaaaattttttaaaacgaatttatgatataaaaataaattttaaaaatctgtgttctttgcccacatttaaatgagtttttttggttgccattgttgtcattgagtagtttgagttccttgtaaattctgaatattagtcctttgttggaggcatagattacagatgttttctcccattgttaggttgtctgttctctcaattatttcctttgctgtacagaagtttttcagttaaactaagtcacttttgtctatttttgttttttgttggatttgtttttgagatgttagtcataaattctttgtgtaggccagtgaacagagagtttttcctaggttttttttaggacttttataaaagtttcaagatcttgaatacaccttgcgttaatttttgttgttgttgtttttccaccttgagttaaatattttatatagtgagaagtaggggcccagtttcattcttctgcatgtggcaatccagttttccctgtaccatttattgaatagggtctcctttcccagcgaatgtttttgtcagcttcgttgaagatcagttggcaaaggtatgtggctttatttctgggctctctattctgttccattgatctgtgtgtctatttttgtaccagtaccatgctgctttggttactataaccttgcagtttaatttgaagttgggtaatgtgatgcctccagctttgttctttttgcttagtattgcttaatctattgagattcttttttttatttcatatgagttttagaattgttttttctaattcagtgaaacatgatgttggtattttgatagaaattacattgaatctgtagattgctttgggcggggaagtatgagttattttaacattatcgattcttctgatccatcagcatgggatgttgttccacttatttgtgtcatctacagtttctttcatcagtgttttgtagttttccttatagaggtctttcacctccttgattagatgtgttccctggcattttactttttttttttttttttttggtagctttggtaaatgaaactgactttgatttggttctcagctcgattgttactagtgtataaaattgcttctggtttttgtaagttgattttgtatgctgaaactttactgagttcgtttctcaaagaagtcttcgtggaatctttagagttatctaggtataagatgatattgtcagcaaacagagataacttggcttcctcttttccaacttggatgacttatttctgttgcctcttttctggctgtgacttttagtactatactgaatcggagtgtgtaagtgggcatttttgtcttgttcccatttttagcaggaattctttcaacttttctccattcgtatgatattggttgtagtttcgttgtttgtgacttttattattttgagatatgttccttctgtgcctagtttgttgcaggtttttatcatgagatgttgaattttaccagatgctgtttttgcgtctattgagattattatatggtttttgtttttaattttgtttaggtggtgaattgcatttattgatttgcatatgttgaacttcctttgcgtgcctggagtaaaacccacttgatcatggtgtattatcttttcgaatgctgttgtattcaatttgctaatattttcttgaggaattttgcatctatattcatcaggagatattgatctgtagttttctttatttgatgagtccttgtttggctttggtatccgggtgacactggccttgtagaattagaaagggaagattccctctactattttggaacagtttcagtgggattggtacaagttctttgtatgtctggtagtattcagctctgaatctgtcctctcctgagcttgttgttgttgttgttgttgttgttgttgggagattttcatcttactgatttaatcttagtactcattattggtctgttcagggcttccagttctttctggttcagtacaatcttgggaggttgtatgtttccaggagtttacccacttcctctaggttttctagtttgtgcatgtagtgatgctcatagtagtctctgatgaccttttgtatttctgcagtatccgttataatatcttcttttttatttccgattgtgtttattcgaatcttctctcttcttggttagtctagctagcagtctgtccgttttgtttctcttttcaaagaactaacttttcatttcattgatctttttgtattgtgtttttggtctcagtgtcacttacttttcctctgatctttatgtcttttcttctgtcaaatttggatttagttcttgtttttctgtttcattgggtgtgacattaggttgttaatttgtgtgtgtgtgtgtgtgtgtgtgtgtgtgtgtgtgtgtgtttagacagcagtataaactttcctcttagcactgcttttgctgtatcccagaggtttggtatgttgtatctcctttttcattcatttaaacattttttaaaattttcatcttaattttgttgttgacccaaagatcgttcaggaacatgttgctgaatttccatgtatttgtatagcttcaagaattcccccttgggattgatttctagctttatttcactgtggtttaagaagatacttgatatgatttcaatttaaaaaaaaattctttaagacttgttttgtggcataccatatggcctattttggagaatgtttcatgcatgatgaaaaagaatgtatattctgctatttggggctagaatgttctgcaaatgtctgccaaatacatttagtttagagtccaatttaattctggtgtttctttgttggttttgtgtcctgatgatctgtctagtgctgtcagtggaatatggaagtcccccactattattgtattgctgtttatatcttttcttaggtctagtaatattagttttatgaatctgggtttgggtcttctggtgttgggtacatatatatttaggattgttatgtctttctattgaattgatccctttataataactttgtgtatttttttactgtttttgatttaaagtcagctttatctgatctaagtatagctactcctacttgtttttggtttccgtttgcatggagtatctttttgcacccctttcttcagtctgtaagtttctttaccactaaggtgagtttattgtaagcagcatatagttggatcttgttttctaaattcgtcctgccaatctttatcttttaagtagagcatttaactcatttatgtttaaggtaaatattgatatgtgaggttttattcctgtagtaatgttaattgttatcacattgctttgtagtttcgttggtgtaattattttacaagacctgtggattttttactttcttacatttttatgatggcaagtattgacccttcatttccatgtttagacttcccttgatcatttttgtagagccagtctagtgatgacagattccctcaatgattgtttttctaggaaagactttatatctcctttattcctgaagctttttctagcaggatacaaattttcaggttgacagttttttttttctttaagcctattttgaaaatagaatcccagtctcttctgacttgtaagtcatctgccaggaagtctgctgttagtctgatggagtttcctttgtaggtgtccaaatgcttttctcttgctgagaccacacagtctgatgactctatgtcatggtgaggcccttcttgcaatgtatttttctgggtttcattgagcctcttactctggatgtctagatcacttgctggacaagagaagttggttttccaaactttttgctttcttttcttttctttctcgagaatacctacaattcctagatccagacattttattgtagtctcctacttctcaaaggctttgttcatctttaacattcttttttctttcttcaaaagacctgtctttatgttctgagattgtttattctccttgatctagtttattgttgaagctttcatctgtattttgtaaatccttcagtgaattttttattttcaaaagatttcatttatatccttaattgatattctgtttctttgtgttggtttttcacattttccatgaatctcattgagcttccttaaaaatcaatattgtgaattatttagcatttcagtaatgttggttaggatttattgctagagagttagtgtgatcctttgagggtatcgtaacaccctgttttttcaaacttccagaattattacactggttctttctcatctggaaaaacacatttctcagtttgaattaatttttgtttgaacgagactgttttcccttgaggatgtgactgtaatgtatgttgaatatggtcatttggctttgcttctgggtgcttttagtggcaaagactctatatgaatttcctggttttagatagcctttggtggctttctcaaacatcaggtgtgatagtggtatacttggcttgtgagcaggctcacagcctcctgtaagtcagggtagcagaggtctcaagaagtgtatcttgttcccaaattgtgtgcatttatgttaccagattgggttgtgcagttcatctccaggccaataagtagcatttgcaggtatgagtcagcttcagtggtaacagtggggtttacgcttgacctttgtttgccagggaaagctcagatattctgatgactggcagaggcaccagccctgacaagggtggcaggggagaggggagtcattgggccactggtaaaatgcactgaggtctcttgtggagaggggtgggatgggggggtgtgggccaggtgatgagctgtcttagcaccctggcctcagcaggcaggaatgtgatgtttccctctcacactcctattctggtgctcaggttgttcagttctcttagacactgctgtttatctccaagctgcaatgtagcctagaactacaggagatgcttgccccatggcttgacagtacacttctgtgctatctggaaatgggtgccatgcagactctgctccctccccatggcaggacccctgaaactctaggcagagagtgggacaggacccacctttctcatgaacctgggcccagaggccactgccagtggaactgcagttgcccctcacagcttcagatagcctgccctctggtttcttgtgccagcttcccatgggagcagcaattactgtgtctgcagcagtgggtggagggggaggagaagttcccttctctatgtctgggctcaagcacagaggccacttggccagtggtacaggaccttactcctcacttgcagtgctgagcagagtttgtgtctctgtgtctctgccaggagcaggcattcacttgcagccccaagcagagagctcttggggggcgctggaaaatgcatgctttggtttcctttgtcccagaggctgtccttttggtgcactgcacttttccttctcttaaaagtagcactccttgtgggatagattattgggaaccctgcagcaccccgggtctaactagcactgtgccactgctgcctgctgagtgggtgctggggaatgtcagcaagagctcccaggatgtggaagcacaagggctgaggttccctgggcaagataaagtcccctgatggatatgctctgataatgatgccttgccacagatgctcgagtctaggatggtgggaaggtgagcaacccagcgtgagcttgcagtctggtgtaacaccctcaagaaatccctacccataccacagtctaggtttgtgagagcagaggagctctcccatagatcgcatactagcactctgccacaggaatgaaggatcccaaacactctcgcttaccctttccgtgcaacaccaagtcccttggggctcccagccactcttttttggcctctcacttccttctttttctatgcctaaattttttcctgtgatttttgtgtactagtattctctctctgatattctgttagagctgtgattatgtgtttgtaattttggttcttttttgagaccgagtctctctctgtcgcccaggctggactgcagtggtgcgatcccggctcactgcaacctctgcctcccaggttcaagcaattctcctgcctcagcctcttgagtagctggggttacaggcacctaccactatgcctcccaatttttgtatttttagtagagacggggtttcacgatgttggccaggctggtcttgaactcctgacctcaactgatccacccacctcagccttccaaagcgctgggattacaggcgtaagccactgcgcccggctgtaattttggttcttttttctgaagagaactggaacttgatgtctttagtcagccatcttgaacctctctctctgattatgattattataattaaccttgcaacccttgataactggtttcctttacctccgaaacacacaataaagtacataaaattatttgcaagcttcttgtaaaagaaccattttttctatttaccatattgcatttttaaatttattttgacaaattcttacggttatttccatttttattcaatgagaagcattttcttgaatacgtatatttgtatttttatgtcagtatttgtcattaagtagtatatatttatagaacaataggaataatactttatacaaatgaagtcttgtctttctaatactaaggggcattacagttttcaaatatcctttgaagtagatatgtcttttaatataaaaggaaatatcaaaaaatagatggctgttctactgttcctgtattttcaggtattttccttaaccaatttcttttattttttaggtacctagtcgatagtcgctggttcaaacagtggaaaaaatatgttggctttgacagttgggacaaataccagatgggagatcaaaatgtgtatcctggacccattgataactctggacttctcaaaggtcattattttcttccttcagtcaagttgtaaatgtgttaaatttcattatataaatgtcagtgggttgaatttggaaaatgttagcgcaaataagttgataaagttttgcattacagattttacctaatgaactcattattctaataagttattaaaaattttattagttattattctgtatgacaagttttgtttttcatttatgatgtaataaggttttattgttgtttaaacccttaaatgaagaactgatttcttcatttaaagatttcattattaagtaatcattatttaatgattatttattactaaataataagactcattatttgttattaaataattaaacactgattattttgagaaatgctatgtcacatattgtttttcctagtggacacatgacattttttaaaatttgaggaataatcatatatgcttaagttcttaaatttttgcattagctttctacaaccctcactacttgccagtccttctatatacctcttattatgggtaaagggaacaaaacataagtaccagaacttccatttctaacagtggttctcaaaacactgtgtatcaggcaacggaaaacagtgatccttgagagatgcgaaacaaaataggtaagccctccaactgccttcagtttactgcattaaaagagatttccaagacacaacatgggaagatgaaacccatgcagacccttgctatctcccttagttgaggaaacagagtttgcagtctaggaaaaccaaggctacaagagtccaggaaaataccagaaagtagtgagtagctcagagagagagagacctagacccccccccatagggttgctcttaagtcttcaactattaaaccgcactttgcatataagaaaactgcccaaggtcagacaaggtaccactgaaaagaaggaacaatcatcgaggctaatataggattgggaatcgtttgtgttctcagcagccagagtggaaaaccacataatttagagtagacttctgagaacagttttacttatgtaatagggtgaaattaattttcctgctctgctaacctgaaagcatcaaactatttcgaagaaacttaactgcatttcagaataaaacttgagtatttataagaatacaaaaatatccagcatacaaaaatgtaaaatttataatggcttggatctgaccaaatattacctggcatgtgaagaagcaggaaaatatgatcaataatgacaagcaatgtcaatcttaaaaacaaatctcccccacaagacatggaaaaaattaataaagaacagatgagacaaatacaaaattaaaagttgctagattgaaacccagctctatgaataatcacattaaatgtaaacacctcaactaaaggtagtgagggtgagactagattaaaaagttaagaaccagctataactgcctacaagaaactcactttaaatgcaagaacacagatagattaagatatggaacaagataacaccaggctgtggtaagcaagactaacccccagtgatcctcactcttgtataatactctcccctttgagtgtaggtgaaacctgtaaataggatgaagatatcactcttgtgattatgttatgtggcaaaaagagactatcctggtgaacgtaatctaatcacacataccctttaaaaacagagagttttctctgtctggtggcaaaagaattcagagatgcatgaaagagggtcaatatgtcattgctggtttgaagttggaaggaatcatgtgagatgcaaggcaggcagcctctaggaacagagagtggcctcaggttgacagccagcaaggaaacgggaacctcaaactcacaaccatgagtaactgaattctgccaacaactgaatgggcttggaagcagattctccctcagaccttcagataagagcccagcaggggtgatatcttgacttcagccttgtaaagccctaagcacaaatccatttgggccctccttaactactgacccacagaactgtgaactaataaatcggtgatgtttaagccactatggtaattcattatgtaacagtggaaaactaataacacatgctaacactgttttttaaaaagccggagacattaagtttcagaataaagaacataatcagggatagaaaaggtcacttgataatgactaatgggatgggatagttcatcaagagaatatagtaatcctaaatacatacctacctaatggcataacttgaaaatatgtgaagaagagtgatgtcagcaggatgatagaatagaaagtcccagcccccaacacccaacagaaacactgaagtaacaatggaccagactctttatgagaaacccaagatccagttaagaatttgtagtactccagatgagcccaaaactgagaacaacaacattgaaatgagtaagaacaattttattttgcccacatcagcccctcctccaaggagtcttagcttagtctcaagagagattgtctcagatcaggacctctcccttgggggaaaagagggagatcacgtgcttaattttccagcccttcagtgtactacccaacaggccagttttctaaaaaaaaattttgatcaccttacatagagtgctgaaggaaccagcatagttctgatgcctgggggcagttaacaaaggaaagagggtaggtggttgctgcagctggaaggctctgagagattgagagaaggctaagaacctgaggcttctctcccaggaaggaaggagaggagtgggggcatcctgcactgcccatgcctttcagtgtgctgcttgaggggccagtttctgtcatgccttattgtaccagagagctgacatagttcaaataactgggggaagttaacaacaaaagaaaagggataggtggcttgctgcagctgccacaaccctgtaatattgggagaaggcatagaacctgagacttgtcttccaaggaagaggaaaaggagtggagtgtacccccagtgttccagtctttcagggtactgcttgaaggactgacttctgtcttaccttacccagtgtttggtgggggcagataggaacaaaggaagaggggcaagtggcttgctgcactcagcacagctctacaagatttgagaaggcagagaactcaaggaagagggagacaagtgggatgttcctctaatgttctggtctgcagtatgatgtaagataccagaaggaggaagagattatgggtttctgaaaaaaaaggaaatcaacaaatccttctaattaggaatctgcatgcacaagtacagaaaagacatatccacaaaaaaagtttgagatgttctcagaatctctagccaggcttttgggtggaagtgaagctatttgcctttcaaagccagttgataaagactgggagagaggtggctgtttcttcagttgcacaaacacctgtgcaaagctacaagaactcaatcagggaaacgtgacacaaaaaaacaaaatctccagaaactgaccctaaagaaatagagatgaattgcctgacagagaattcaaaataattgtcttataaagctcactgagttacacgaaaacatagacaacttaacaaaacaagaaaaataaaaattcacaaaattaaaatatcaacaaggagctaaaaattatgaagaaccaaacaaattttggaatacgataactgaaaaattcactagaggtcttcaacagcagacttggacaagtagatgaattggcaaacttgtagacggatcatttgaaattatctaatcagaggattaaaaataataaaaaagcataaaggaagtccaagtgacttctgggacaccatcaaatgaaccaatttgtgtgtatggaagttccagaaggaggaaagtgagaggggcagaaagcatatttaaagacatactggctgaggccaggtgtagtggctcacacctgtaatcccagcactgtgggaggccaaagtggacggatcacatgaacacaggagttcgagatcagcttgggcaacatggtgaaaccttgtctctagaataaatacaaaaaaaataatccagccagtcgcgatggctcacacctgtaatcccagcactttgggaggccgaggcaggaggatcacaaggtcaagagatcgagaccattctggccaacatggtgaaaccccgtctctattaaaaatacaaaaaattagctgggtgtggtggcgcgcacttgtagtcccatctactcaggaggctgaggcaggagaatcgcttgaacctggaaggcagcggttcagcaagctgagatcatgctactgcactctagcctggcgacagagcaagactccatctcaaaaaaataaaataacataatatgtgggtggtggcatacacctgtagtcccagtacttgggaggctgaggtgagatgattgcttcagcccaggagacagaggttgtatggagccgagattgtaccactgcactccagcatgggtgacagagtaagaccctgtcttgcaaaaaaaaaaaaaaaaaaaaaaagaatgagtgaaataatggctgaaacttcctgaaactgggaagggaaattggacatctacattcacgaagcccaaagagttgaacaacactgttaatcaacttgacctaattgaattttgtaaaacattccttgtacccattaagaatcacaccctatcccttctttgctgccaccccccactctagacaactactaatctcctttgtctgtatgtatttgcttattctggacatctcatataaatggaatcatacaatatgtgtgtttttttgtttattttattttttgagatggagtctcactctgttgcccaggctagaatctcagctcactgcaacctccgcatcccaggttcgagcgattatcctacctcagcctgccaagtagctgggattacagatgcgtgccaccacacctggctgatctttgcatttttgttgagatggggtttcaccacgttggccaggctggtctctgaactcctgacctcaggtgatccatccgcctcagtcccccaaagtactgggattacaggtgttagccactgtgcctggcccaatatgaattcttttatgtttgtcttcttttatttaggacagcacaatgttttcatgttttatccatgttgttgcatgaatcagtacttgatttctttttatagatgaatgatttctactgaatggtgcacatttactttatgcactcatcagttgatggacatttgagttgttttcacgttttggctcttctggatattgttgctatgaacattcatgtaaaagtttttgggtagataatgtgttttcctttctaatgggtagatacctagacatgaaattgttgggtctttttaaacttcgttgtttaactattttaggaactcttagactgtttttccaaagtcattgcatccttttacatcattgctggcagtgtatgaggattcattgcttcacattattaccaacacttgttcttgtctgtcctttttattatagccgtccaagtgggtgtgaagtggtatctcattgtgatttttgacgtgcatttccctagtgattgatgataagttctttttttgtgtgcttgttatatatcttttttagtgaaatacattcagatcctgtgcctatttttaatagaattgtttgtctttttattgttgtattttcagtttgttatttatttaggatgctagacccttatcagatgtatgatttgcaaaaattttttcttattctgtgggctttttatattcttgatggtgacctttgaagcacaaaagttttttaattttaagtccaatttgccttttttttctttgttgcttgtgcttttggtgtcagagagcattgctgaaaccaaggttgcaaagatttatgtaagatttatacttacattttcttttacgagttttatagttttggctgttacatttacagcattggtctactttaagttagttttgtatatggtgtgcagtagtgttctaacttcatccttttgcatgtggatattaagttgtccagtaagctttttaatagaaaaggataagctgatccaaaaattcatgtggaaattcaaatgacagaatggctgaaacaactttgaattttaaaataaaatcatagaagttaacactatttgatttcaatccttattttaaagctgtaataataaatatagttgatattgatataaagacaaatacatcagttgaccagattagagaatccagaaatagatctacacatatatagtcattcagctttagaaaaaggtaaaagaggaattcactggcaaaaggatagtcttttaaacaaatgcgccttgagtatttggatatctgtttgcaaaaaactgaattttgatgcatacatggcactgtatacagtattaatccaaaatggattatagacctgaatgtaaaaactaaaacttttaggaaaaagtctttgcgatgttgtattagccaaagttttcttggatatgattcaaaagcaaggttgctaaaagaaaaaatgtagttgtgtctcatcagtaacaaaagcttctttaaatgacactgttaagagaaagaaaagagaagccacagtgtgggagaagatatttacaatcatgtagcagataaaagacttgtttgtagaatatacagtttataaaactcattttgaagaaaacgtaaagcccaatggaaaaagtaggcaaaagatttgaacacataattcaccaaagaagatataggtttcaaaaagcacgtgcaaaaatgctcaacataattcatattagagaaatgaagattaaaaccacaatgagaaaactgatccataccaagtgttggcaagattgtagaggaagtagaactctcatacactgtttctatcgatgtcatatcataaaagcacttcagaaaatagtctggcagtttcttaacaagttagacatacgtttattgtagagcccagtcattccactcctaggtatttacccagaataaatgaaagcattttatccatatgaccgattgtacacaaatggtcatacagtgttatttgtaatagaaaaagttgtgaacaactcaaatgcccatcaacacctgaatggagaaacaaaatgtagcatatccatacaatgaaatcccactcagcaattaaaagaaattaagtattgatatgtaaaaacatggatagatctcaaaataattacatggcatgaacaaagccaaacaaaaaagaggacatactatttttatgtaagactctagaaattgcaaattcgtctatagtaacagaaagcaagtactgttttcatgtacaagtctagaaaatgcaaagtagactatagttgcaaaacacagaataagtaacattctcttaatccctcaggttttttctcgcttcttgatttttattgtttatatcttattgggaatactgtgttctcattattgaaatgctaccaagaacaattttgctttccgtatctgttaattaagactaacttaggacaagaaaaatctccattaagttggatataactcagtgagatatttctgttcctctttctgcattttaaaaattcacatggacagataacaagtctcagattaggactgtgatgtaggtatggttccagaaatttcttctagatctgtggcctgtcttatactaaatttttttagtctagctagaaatttgaaagtggactgtgaattagaatcacatctgaagaattacctccattttagttcttgggagaaatccagattgtgggccttctggaataatgaaatggttcacaagatgcccatttgtgatttctgtcatggttcctagcccgtgtgtcttggtgtcattgtaaaaggttgttgatttgcttctgaatttcctacaaaagctgatgctagaatgaatattgttaccatatgagggatctctgctactcaaaatatgtgggaaacactcttttgtcaagtctcttgactaacagttactccatagtattttttaaagaacctaataaaagaattatgtttttaaatattgctttttgatttatggtacaaactgaaagttttaaagcaatagtttattttgaaatatgtatggcaggcttgtccaacctgcagcccatgggctgcatgcggcccaggatggctttgaatacagccaaacacaaatttgtaaactttcttaaaacattatgagtttttttttatgatttttttaagctcatcaactattgttagtgttacaattcttccaatacggcccagagaaacccaaaaattggacacccctgatgtaagggagctgaattgctttagagcttaaaacttgttttaaatacttaaattagccttcatgagtttaatttgtaatgtgtccaaacaaagtatttagagttaggtattgagtttattttttcttttgcagatggtgatgcccagtcacttaaggaacaccttattgatgaattggattacatactgttgccaactgaaggttggaataaacttgtcagctggtacacattgatggaaggtcaagagccaatagcacgaaaggtacattttaataataactgactataaatattatttttcttgattagttcacattttattattaattcaatgaattgtgaagtttcatcacttatcttagagaaaaagccagcaaaataaccgtacactgtgttacaataatggcaagtaacatgttaagaaggtttacttatgctagccactattgtaagtatgtattattgattaatcctctatatatagagagaaaactctgtaaggtaagtagtaggaaatgaggataaaaagttaggatctagttattttagaaagtcatatcaggatacagactttggcaacctgaccctgttttctgtgctgcactgtttttgataaaacaattagaaaacaatgaagaaactaaaagttgaagcaatgttttttggaacataaaaattttttaaacttgaaaatgtagattttttttcatatcctttaacattttaaaattgtagtctagaaacattaagaataaccaatttcgtttttttagggaactaaaaagcaataagtaagggtgttgctgtagtagaataccaaatattcaaggtaaatgagtgaaccttacacatgtatttgatcatttattgtaggaggggtgggaggctgagaagggaccaaaatctcttggcataattttgtatctggtttgggtcccccgaccctccccccatcccccgccacatagaaacaattaaaaagttggattaggtaacataagggtaaaaaaacctctagtagacctaactatatttgaatttatttggaattgatgctacaaagttgccatgttaacaatttgtatttgtgtatccatggttttaggtatattagaagctaaccttggatcttattttctgaatagatcttgaatgtaccttttatttatttttgtttagttttattccttagtttcactcagccacttcaaaattagaatttctctgttgtaggaatgctagccttatagatctgtgaaatgatctagttgctttatctatagttgctggagaattgagtgttttgatcaaaggtagcctatttagctgtaaaactgtctagaattatttcattcctaggataaaggaaaatttgtgtccaaaatatctctaaaggtattacactgtattcctttaatcttaatgatacacttttttttcttataaatgtagcacattatacactagcggtcttcagtatgataaacagatcaactaccaatttcattgccattactctttgaaatagtcctcattgagagttcttgaaacctgtgtctaataacaaagtaaaatataatcaaaaatttcacacaagtagaagaaaaaacattgacaaatctcttgggagaccacatacttatttttaacaagatgaatgaaatatattcaacctgtaaaatagtttgcaaatgttcatgtgctatattacattgcgtggagttcttattacagatgcaatttcctacaacattaaatctgcagtaaaatttaattaatcacacttaaatttgggaatttcatttgcattttcactgtggcccacatgactgatgcaggtggaactcaaagaagtaaatagaccagcttatagtgtctgaagcccaactttcaatgttacccatctctgattgcattaaagaatctaggattggtggttcccctagctataatgcagaaaccaagttaaacatcttcctgtacctcaaagatctctaaaatgcgtcatttatagtgtcaacactcaaagaatggacgaaaagaaagcaaggatataagcagaaaatacgatggaatcaaaatccaagagaaacagcagacaatagaaacagacccataagaaacccaggtaattgagttagtagattttagaatagtgggcttattatgcttaaaaaaaaaaaaaaaggcagatgagaagtagggcaaaactattaaagaagaagcaaatagaattctaaaactaataatatggaaattttatggatttaatgtttgggaataaaattattagaccaaacagaactgaagagaaaatttgtaaactaaatgatttgtcaatagaaaatatagagtctaaagcttagagagacaaaagaatagaaaatacagaaaaaagctaaggcataaatggaatgcagtaagtaagtttaacatgcatacatatagttggaatcttggagaggaaagaaagagtgggtagaactaataccaaaggacgtaatagctgagaattttcccaaactgagaaaggtgtcatgctttaaagaaatgctatgaatcccaaactgaaataatacaaacaaaactgtacctagtacaaatgttgaaaagcaaaggcaaaaaaatttctaataatagccagagaaaaagacatgttatcttcaaaataaggataagacaaaataatgatttctcaagagaaaccatggaagccagaaaacaatggactttgatatgttaaaagaaaataactgccaatgtaggattctgtgactaagaaaataatccttcagggatgaaggtgaaaaaagccattttcaaatgaaaactaatagaatttgttacctgcagacgtgtattaaaggcactacaaaataatcttaagaatggaaggaaaattattccagatgaaagcttggagatgcaggaaaacagtgtagactgacaaaatgtaaatgttgtgagtaagtcttaagatggactgttgaaaacattaataataatttttatggagttgaaaatgtgtatagaattaactacacaatagtgttagcatgtaagttaagataatattctctactatgttccctggtgatccccagctcctcatatccatattcttgggcactcttcttccatgttgtactgaggttggtctgtgtggccaatagcatatagcagtactcatggtacatcgctttcgagattaggttataaaaaaacaccgcggcttacatcttgggtgcacacgcactctagctgtctctctttctcatttctcactcggggaattcaactgcatatggcgaggacactcaggcagcctatggagaggcccacatggtgaggaactgagatctctggccaatagagaggaacggaggcctgcaacaaccatgtgagtgaccttggaagtggatcctttagttctagtttagctttcagatgattgaaaccccagccataccttgagagcaacctcatgagaaactctacaccaaatcaacccagttaagctgctcccagattcttgaccctcagaaacattgtgagataatgtttgctgtgttaagctggtaaattttggggtaatttattatgcagcaatagataactaatactaatcatggtacctgtaaataggtgctgatatgaaaacttgaaatgtggcgtggctttggagctgacagtgaatagaggttgtcagaactttaagagtatcaatgaaagcttaaagggccttaaacaaaccgttagtagattactagactttgagatagctgccagtgagaacttgaagtgaggaaagtcttactggaaactggtagaaagtggtctttgttatacagtggtagagtaagtttagcaacatgttgcctgcagtaaactgaaaggttaaagatagtatttaatgaaattataggtctgccaaagtgttaaaagtactgcctagtttctttttgtgttggttatagtcagatgtgagagaagagaaatacactaaagaaaggattgttcaataaaacagagccaatatttactagttttgaagattcctagtccctccagatggcaaacggtgctaatactaagcagtgtttctgagcaaagataaaactcagagtattctcagaaaaaaagtgtgatctaatctggcagccaagggtgtgactgtaagttacctcagaaaaatcaaaggtcatgcctcacagtactattcagacaaaaggccctataaagtatttaagggttaacttagaggttgtcctgtcagtagtaatattaattaatattaagggtgtcttctcaatatgtggcttctaagaacaggagggcttcaagaagcttacgggcaaccccttagctttctcagcataaagccaaagtagagaggacttatcctacagaacatttgtggatatggcttttgtctaatggaatgaactccagtaagatccagtggagacctacattgttttcgaattacctcgcagaaccactgccattttggactgcagaagcagtattaaatgaaagacgcctttgacctcccaaactccaataagtaggaatcaggctgaaaatttacttaacttcaagcatgtgctaatgcatgaaaaaaggatgactcagagaacagaaccaaatgttagatagaataattttcaggcaagggtagaactgagttccagtcaaggaatttctagtatttgtccaggtagatttcataatcgttatggaccattgattcctttgtacgtcctatttcccctcttacaaaacaggaatatttaaaaggctatgttctgtgtgcttcattgttttattttgggtgtatggggggcagaaaacttgtctcttagttcacaggcctatacatcaagaggcactacagtagtcccccttatctatggttttgctttccgcgatttcagttacctgcaagcaaccatggtccaaaaatattaagtgggaaattctggaaataaacaattcgtgagttttaaattgtgcaccattctgagtaacatgatgccatcccactccatgtcctccccatggacactatacactaccttcccgtttgtcacttagtagccatcttggttatcaatctactgtcacagtgctttgttgaagggcattagtagcataatgcagcgttacaatgtacatcattcacttcacctcttctcatcaggtagacatttaatcatctcatatcattacaagaaaaagggtgagtacaatatgataagctaccttgagagaccacatacacataacctttattatagtatattgttctaattgttctattttattattagctattgttaatctcttagtgtgcgtaattaataaattaaacttcgtcataggtatgtatgtttgtaaaggaaaaaacatagtgaatatagggattagtgtgctatttgtagtttcaggcatccactaggggtctcggaatatatgtcttcaaaggcttatagaaaatttataatttgtcaattatagatgacaaatttctgaactccaggttgctaaaatgaattgagactagttggggcctttggaagaactgagtgtattttgtattttgggggaaggaactgtgaatcattgggggccagggggtagactgtggtagccagcctcaaagatgctccccagtgattgtgacctcttagaatccttagtctggtgtaatcctttcccacattgtacgacagttggtctatgcagtcagtagcatgtggcagaagtggtggtatgtcacttctgagattagtccttaatggatgcctgtacttctattgggagtgcacatacctccctcatcccctcccctcggatcactcactctgggcgaagccataactttgcccttaacttaccctatagagagactcacataatgaggaacagaggctgccaacagctacatgagtgagcttgtaattaagatttgaacaacatgattaaccaccataacctaattgacatgtacattgtacttagtcattgcagaatacacatttctattaagtggaatttttaagcaaaattgaccatattctgggttatcaaaattccagtaaacttcaaatgatagaaattgttcactgtattttctgtcattagtgggattaagctaaaatcagtaacaaagagataacctgattatcccccaactatctagaaatggaaaaatatacttttaagtaatccttgaggcaaagagaagaatgaaaattagacatattttaaactgaataataattaaaatacaacttaaaagattggctgaaattctcagaaggaattttatagcttcagtgcaaatattggaaaagaaagtgaaaatctattgtctcaacaagttaaggaaattgaacttaagaagaaacattataatgtagacattaacaaaatagaaaacaaacctacattaaatgaacaaaattcagtcattgtagagagcagtgaaattagaccagtaaagtaaagatgagtcctggcaggattgtttaagaataaaaagagagtaggcacaaataacctatattgcgaatgaaaaaggaaacatcatagcagagtctaaagacttttttgaaaagattatgttttgaacagttttatgtaaatttgaaaatttagatgaagtggataatttctagacaaacagaactttaaaatgtcaatacagtaagaaataggaaactcgaattcacctatgtgattaaagaaattgagtcattgaaaaccttcccacaaagaaagcttcaggccaagaaagctttaccagtgtattctaccaaatatttagggaagccataaaccaataccacacagattctttctgagaatagaagcagtactccccaacttattttataaggctagcataaacatgacataaaacctgaaggacattacaagaaagaaaaattacaggctggtctcactcatgaacatagatgcttaagtcctaaacacaatgttagcaagacaaatccagcattatgtaaaaaggacaaaaatgaccaaggtggatatttttcaaagaatacaattttaactttgaaaagcattcataattttagcagactaaaggagaaaaataatctcaatagagatacaaagaacatttgatgctcaacatccatgtatgatcttaaaaaaaaaaactcctagaaaactaggactagaaatcgcctgtaaatattgtacttattggtaaaatattaaaagttcttcccaagtcaagaataactgtgttagaaatcttagccagtatggtaatatagtaaaaagaactaaaagagtgaatcttgtaaaagaagatacaagactgtcagtgtttttagaaggcacgattctacaggtttaaaattccaaaaatatgtactggtaaacaattagaattaataggtaaatttaacaggttgcctgatataagggcagtatagggaaaccagttttttattggcaacaaataaagtttatttttatttgtacaaattagtggtgtacatgagaaaatctgttacatatatataataagtagtaatgaagtcagggtattttgggtgtccttcacccaaattcaatacatttttgttaagtatagtcaccctgctctgctaccaaacattgaatttattccattttactgtatgtttgtacttttaagccagttcccttcatccttccctgctcccttccttatccttcccagtgtctgttatctatctttccactctttacttcatgtgatcaaattttttagcttccacgtaaaagtaagaacagatgatatttgtcgttttgtccctggcttatttcacttaatataacgacctccggcttcatccatgttgctcaaaagacatgatttcattctttgtaatggcggaatagtactccattgtttatatatatatacaatatttatccattcatccattgatgagcacctaggttggttccatatcttgctattgtagatagtgctacaataaacatgtgagtgcaggtatccctttcatatactgacttcttttcctttgggtagatatgcggtagtaggattgctggattcaatggtaattctgtttttagatttttgagaatctccacactgttttctgtagtggctgtactagtttacattcccatcaacagtgtataagtgttcccttttctccgcatcttcgctaacatctgttgtcttttgtctttttaataataaccattatggcttggttaaggtgatatctcattgtggttttgatttgcatttctctgatgattagtgatgttgaacatttttatatacctgttggccattcatttgtcttttgagaaatgtctattcatgtcctttgcctacttttaaatgggattgatttttacctgttgagttgttgagtccttgtatattctggatattaatcctctgttggatgaatagcttataaatattttctacacttcaacaggttgtctcttaataaagttgaattttaaaataacatttacaggtcaaaatacttaggaataaacctagtaagaactgtgtttttctatactgaaaattgtgaaacattactgggtaaaattaaagaagacttaatgaattaatggatctagcctgaaggtctagaagctgaagatgtaggagaaggagtaggtcactaatgtttttctgtaaagggccagatagtaaatatttttagctttatgcgccctttagtttcttttgaaatgactaaactttgctgatttaggcataaaagcagccctagataattaataattgggtatgaaagtagccgtaaacataaatgaatgggggttgttgtgttccggtaaagcactatatacaaaaatagattgatgggtagatttagccatctaaacctaagtttagccaaacttagttcataagtttgcccatcactagatctaggcattggctttaatgtctaccagcatcacaaaaaaaggagcaactagatgtttgcatcctgttcagagtgagtgtatgtcaccatctatgcagtggtctaaagtaaaaattacaagaataggaaagatggagaacttctaggttaaaagacacttaagagacgaattagtctattggcaatatatggaccttatttggatcctgattcaaacaatacattaaaaatgagacagaaggaaaaatttgacttttgactggatatttgatattaattgattagttttaattttttaggtgtgatgatggtattgtggttatgtttgagtctttgtttctgaatattctgaagtatttgtggatggaaaatcacatacataggatttgtttcttacacattaagaactatgatttcatagttttgttgtatttatctacttctctgtcttcaccgttatctgttctcactcaggctccaggatctaggtctaatttatctgcaccaaatgtaggtactcaataaatgcttttaaaatgaatgaagctagctctacaaaagagtaagtcagtctgttagaggcctggtattatgaaattgtttatatagtactagatttttttagaaattacttatatttctcttcccatttcagggagggagcatacttggaatgaaggtaaagtttccatgaaacttttcatacacagacataaagggtagactatattaggtttatttaatatgtttaatggccttgtaaaaaataccctaaatattcacagcaaaaaatgaacaaatagaaattatttattttaatcctctgtaaacttatatgtagctcaaatacttagtaaagagactttgccttcattatggttataaattaatgaaaatatgtttacatatccataagtcttccattttggacaaggagccagatttcatcatgtactcactttttatttatggtaatataacagtgttataattcacttagagtaaacattataactatcatctataatactgaaacataactatcacttctgaatatcccccttccgatcttatttcaaatacatattttaatagttataataattaggtaaataaaactatactttttttataagcttgtttcttcctgttagtcttcatgaccatcattttcaatgcatacatttttaattaaggtaggaaggagattttatgtaaacaaatatgaaggagattatataagcaaataatctacatgtgaccattacacattgattcgtaaatgtgctaattatttttctttttatggtgctgttattttcaagctttaatagtacatatagtatgaccttttcatataaaaatagtttgacaacaaactcatatttttaaaaacaacaccttgttaatacactactttgggaattagtaaaataaatatcttataaatatagtagcagttttctgagtagtgatgatgaagattttagcaatgtaaaatgtaggaaagaagaaaaaaatgttgagaaaaattctgaatcccagtagtgtggactttgaaatattcttgatattttgttttcatagatctcacaataactctgacagttaagtcaccaggttctttccaggaaaatatctatagtattatgaaaatgtattttcatttttagaaaactatgcctatttagaaagtatatacctcaatataaatcataatgggggttttgttttttaaccatacttattccttttcctgctttgtgttggtcattccatttttctttttcttccataaaaatgaggcctgcagtttaccttagttttagttactaccagtgattagtagctactttaatgtagtttattttaggattttactcagctattgagccccagtatagaaattactgactgataagaatatttgattccttgtttctctacttaaatataactacaagtaatcttataaaattaaatgttactacatttgtaaccatgaagtaaatcagcctaagatgtttaaaacaaatctcagtagtttaacatattggttttacaaaacaaattacatttattagcagaaggagaggtacaggctgctacctgtttaaaaaaattgtaacaagtatgattaagaaaatatatatgacaaagtatcataaaaatgtgtgttggattagatagtaaatactagatgaactgcatttgaattttttcaatgcagtgaaagacaagtttgtaaagtcctcttttgaattgatgtaagcttgtgagtatatcccaacggtcatttggagcctcccttttgccatatttgtctaatggatcacatatcaggcctattactattttcagaaacagtattcatgactgaaatcctacagttaacctttagaagatcgaaaggaattatacttatttaaaaggtgaccttaatatatacatatttcctttttatgctttatggcttgcatgcttaacagctttcttttaattgctgcatagaattactaagtgtgtagttaaaggtcaaacaaagtaagtcactgtagggtgaaactaacatatcagttacctagccatagctggatattttggcaacagtgatttggagttatcattttaatagatatattttaacataacagtgataatatagccattaagttcaaattgtataaacaactttttaaaggttttctgcttgggatcactactaaaagctaagaagtatgtttgtatcttcaatcagaactctgtttatttgtattataatgtataaacagagaacgtacatatatatttgcacatagtcattttgggtaatctttctcattataaatactgaatattaattatttatggtgtactagtgtatcttcatagatcaatagaatgcctttccaaactgtcacttaatgttttaaaatcatgattatttctttcttttaaatatcaaaatttccaaaaagttttcttgcttttgaagttttaactatccaatatctttttttatatatattggcaggctttaatagtgactggtttttcactggagatctgcagttttctaaagtctctttaaatgtattgttattagagtgaaatatattgatataggtgacactgatttgttttgtttcattattttaggtggttgaacagggtatgtttgtaaagcactgcaaagtagaagtatatctcacagaattgaagctatgtgaaaatggaaacatgaataatgttgtaactcgaagatttagcaaagctgacacaataggtaatgcaagatcctgtcttgtttttaatccattgctattagatatttaattagaattatctttgtatatgctacttggatgataaccattttaaggatttatatatagacatttgatttccagctttgatacaatgtcttagagttaaattatttattgtttcttgtatgcttttgcatttattaaatgaattttaacatttgtgctgttttgcttttttataaaacatcaaataattattgtttttatttagcaactggtgtgtcatttgtaacatagacctttaaataaaaacttaattaaaacttggtaaggtagcatggaaaatgacaattggttatttccttttttctcttagtttattctttggtactataaatacagtcaagtagccaaggcagcaggcttagcgttattttgacacattgatttttcaaattaatgagtagcgtaagcagttgtaagtcaaatataagtggacttaattctctctatatattaaaatatatataaattgttttctttctatttaaaagacacatttttaattttaggtaaagaatagattgaataaaatgttttttaaaataaatgattatgaatttaataaaaattacatggtttttgtttcataaaactcaagaatttttaaagtatttaatttcaaatgaagttgtaaaacaagattaatggtaataccattgatcttagaaaatacaaatgaacagtgaagaaggacacataacttgtagaacccagcttggaaacagattagccaatttatgaattatagcgtggcataagatttccttgttggaaccagtcattaaagtaaatgaaagtatttctgaatttcattaactgcatttggctttctttcaccacttacccacttcacagctggaaaatccttttaacccgtattttttatgaaatagtagcattattcaagtactcagtgcttggttaatcctaatgtttgcaccaaataaaatacagcattatgttatgaatctttattctcccctcttcatttagctagaacatttataagttcgagattaagtttcaataagctgatagttggccggacgcagtggctcacacctgtaatcccagcactttgggaggctcaggcgggtggatcgcctgaagtgaggagttcgagaccagcctggccaacatggtgaaaccccatctctactaaaagtacaaaaattagccgggtgtagtgggtgtgcgcctgtagtcccagctacttgggaggctgaggcaaaaaaattgcttgaaccgggaggtggaggttgcagtgggccgaaaccgtacctctgtactctagcctggcaacagagtgagactttatctcaaaaaaaaaaaaaaaagcccatagagtcatctttctaaaatgaatgcttaaaagataaggaatttcatatgtaagttttattataattattattacagataaattgcttgacttttgaatttccacatttgtagaatatattcaggaaaataagatatttctacatattaaaaacaaagttttcaacatatgaaaattattttaatcatatgaatatgtacatgagaagagtctataaatttaataagggtagtctgttaaaattaattcagagagtcgtctctgaagtttatagccaattggaatataaatgagaagctacctcttaaaataatgttttctagttatttttaaagtttggtattttcttctctccctgcctcattttgataggaaaattaaatatgagaccatcagagatattattttagaacattattatactaggtattttgaaactcaggaaaatcagcaactgatttaatttctgaattcaaaacaagaattatgggttctcatgataagaactgtgtaagaatttgtcacgaagatatgtaatttataaaggatcactgcttcaaaaagtttacaatctagcatagattttaatcaacatatatactaatactttaaaatgctagataaattggatatgtactttaacattatatatgaacccaatttttgcatagctataattttttactgtattaaatcattgtttttcaaactggattgttgatattttggtggttcattaaacagttttgggagtaaagaaaattgaatgggagatattagaatacaaaatatcaacatatatgtttatttcctgggtcacaatttcttactatagctcttagtttaaaaaatttgaaagtctgtggtagaatgagtcttcttcttaagcaaaaaggtttgcaaaaattagtcaagtcaggaattttagacacttcatggttatggttatagtacaggttaacagttgttgaatatttactatgttttaagcactttacaggaattttcttgtttgaagttaaacaagcaggtatcttcctcttatagataatgaagctgagatttagaatctacttcaattcaccctggtaccaagtggtagagctagtactttaacttcataagcagagctcttaaactagagtctcatctctcaattgctgccttacacaatctgtgtatgctaaaggaatattcgttttggagatattaactgggctgattttgtttttctaaaggaagtgggttttgaaacacagaatttacataaggaacttaagatggatatgtatttttcccttatggtcttttaagaaatcttgattgaaaatgattaaaatagctatgtatgtgaaatacagctgtataaattttatgaacagatttaggaaatataagtgtctgttttctcttgttaccaaattaataaaatattctgttttcagctagtactacctacactgatatatagtaaaaatgatagcaggccataggccatatctaaatgatttacctatcagggccaaaatcttctgccttcaaatgttttctgccaaaattgatatatttgagcattgagcatgtttaagtaagagataaaataatagttttattttcctttaagattaactaccaaaaacataaaacttcttgaaaaatatgatttaatttctatgacctgtattaatattttttaatttctaatttttgtgagtaacctgtattatttttctacctctgtatgcttttcattaactggctagtacagttgaattaatatgtggaaaaataagcacacactgtcagtcctttgaccattctcaacttcagtgatctcaaccatcagccaagctcagccaccaattattacagttaaaccctaggctgttgttatctgtaactgcacttgccagatctcaattttagcatcctgcattctggccaccactttctctgctcccattttctcttgagcccactacatgagacatcgaaacctaccactctgttggtactactactgtcatagtctctcatgaccttgccattgacaaatccagtggtaatatagaaatcttccattttcctgacctgccagcaaagtacaacacagataaactacttttctatctagaagcactttctcttcacttggcttcctgggcacagtttctcactggctgcatcttgttggagtcctttgtaaaaccttcttcatattctttatctcaaaatatcagtgtctccatattctcccagccctcctttccttggtgatttcttttgttctcctggctttaaatattttccatgtgttgatatcttttaagttgataggtcctgccctgaagtctcccataattccagtttgaactatcccatatcttcatttgtatatctgacaggcttctcaagaagactatcagatataaaactaagctccctttcccaaaaaaccttaggctctgtcattcttccttatctccataattcccacttctgctcttccaattgcttaggccaaaaatcatttctgattcttttatttctcacccttcatgtaatctagcagcatatcttcttagcaattccttcagaatttattctcagtcagaccacttaacactgcttccattgctaccactttggttaggattgttgcagtaacctagtttcccacctttgaccttgaattagtccattctcgcactgctataaagaactactggagactaggtaatttatgaagaaaagaggtttaattgacttacagttccataggccgtacaggaagcatggctagaaggcctcaggaaacttaacagtcatggtggaaggcaaaggggaagcaaccacatcttaccgtggcatagcaagagagagagagcaaagggggaagtgctacacactttcaaacaaccagatcacatgagaactcactcactgtcatgggaacagcaagggggaaatctgcccccatgatccagtcatctcccaccaggtgcctcctcaaacactggggattacaatttggcatgagatttgggtggggacacagagccaaaccttatcagaccttctgcagtgttcttcactaccagcaaaagtgaacatttaaaatgtcagtcatatcatgccacttctcttcccaactcctcaatagctttctcttttgctcagattaaaatataaatactttgataggtcacagaagtgtatataatcctacagaagtacctttatagtctcatttctacctcacttattctacttcagccacattgatgtatcaggctattctaaaacatgccaagcacatttgcacctcaaggcttttgcgttactacccctatgcctgtaatgttcccccatatgtaaattagatcacaaaactcaatgaagaggaaatttccacatttgtttataacatgttatgtacacagatgcctgtattaatagaaaaaacatctagaagaaatatcagaatgtcaacagtggttatatctaggtagacattttatttatatttgtcagtatttttggtatttttgccaaaagcaaaaattatttctgccctcaggaaacatttattcatttttatagaaagattaaaacagctcccttccttggcttcttcctttatcctctttctaggtaatgttttgtttcttgatcttggtgcaatttacatgggtgtgtccactttggaaatttatcacaagatactgatgattagtgcatgtttctgtatacatgttcactttaataaaaagaacaaaaagaaaaaaatacaaccctgccaaagtagaaagcagtactgataaggcttggctatgtgttcccacccaaatctcatgtcaaattgtaatcccccatgtgttggaggaggtgcctgctgggaggtgtttagatcatagaggcagatttcccccttgctgttcttgtgatagtgaatgagttctcatgagatacggttgtttgtgtgtagcacttcccccttcgcactctctcctgctcctccatgataagatgtgcttgcttccccttcgccttccaccatgattgtaagtttcctgaggcctcctagccatgcttcttgtacagcccatggaactgtaagtcaattaaacctcttttcttcataagttacccagtctcaggtagttctctatagcagtgtgagaacagactaatacaagtactaacagtatatttattttatgtaattatttaaatattctgggtgatttgctttaagttttgagataacgctgttgatattttgaattagtgcctttttttcctactgatttaatgcccttatcaaaaccttactgactacaagactattacaaaacattagctgctaagtagatagtattattggactaaattatgtaggatagatgtgggttttcatatttcttcggagaacgtatattattaagtttaatattttataaattttttcaaaactacaactattctaaaatctaaaagtattctgtattcatatatcataaaatattttgattactattttcttgagttgattaggcaagttattgaccagaactagatgaaatttcagtaaattgatttagaaatcagaaaaagacgtgactttactttgaaaatactaaattttggtgaatacagacatcccttcaaacaaggcactttcttttttattgtgtccatatattctagtgagctgttcagtttaatataaattatttttaaattgcttatgtggtacttaaaaaattttgcacactaaaaaaaatctgtaacatctcttaatcatactttaatttctaattcctacatctcctcagaaaatatttgaattatagtatgttaaaatttaaagtttatcctgtgtagcataaattgtattttagtgttaggtgattgaactcttaccttttgagattttaaattccccaagtaatttgttggagtacaaataccattttttccataaaaacttggtcttaaaaacccttttgttggtttgtgttttatagatttattacatatttagtcttgattttctattagtattttaaagaatttttgtgctggtaacatttagctgtatgtggtatattttgaaatacatactatatttatatatctttcctccttaaatctagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattgtttattttaagcatactgtattatacatgaaggtttttggattcacaaactttaataattatcctggcaatatataatgggctgtactgtttctggcttcctctttctaaactcatctcttgtctttccttgctggttactgactctgacttttgattccctccttgagcttgggaataatctacttgttaaaaagaaatcatttttaattagaaaaaaatcccagctaatattataaggtgggtcagcaaactttctgtgaaagaccaaatagtaaacatatatggagcatctcttatttacacagttctttattacaaattacagttctctgcaggccataaagtagcatctaaaacattgccattgtagtacacaaaaacaagcatagatgatacatgaataaatgagtatggctatgttctaataaagctatttatataaatgtgcagcaggctaagtgaactctagtttgccagcccttgttgaaaggtgtcagctcccaatttggcttttttgtttgtttgtttgagacggagtctcactctgttgcccaggctggagtgcagtgatgcaatctcggctcactgcaacctctgcttcccaagttgaagtgattctcctgcctcagcctcttgagtagctgggactgcagacatgtgccaccacacccagctaatttttgtgtttatagtagagatggggtttcatcatgttggccaggatgggccagaatggtctcgatctcttgacctcttgatctgcccgcctcagcctcccaaagtgctgggattacaggtgtgcgccaccgtgcccggccggtatttttttaataaagtattgagaaatgaagaggtttagtcactgtcagcaagtcctactgattctatcttctaactgtgtcttgaagtaatctctgtgctccattctcagcccttatctttcatagtctctttacaaattcctgtatctccaggctcttgtatgtctgttcaatctttcttcctttgtttttttgttattagcagataaccataggacagtcttgtttttgcaagaatactcattctaaaatgtaaacttcactgtcttcctttcataaacttttcctggttccttaataattaagtccaggcactttaagccagcatgcaagttatggtttaaccttgtacctactcttccaccatctctagattatctttgttttgtggtttatactcaagcagtaccaaactgagctgcttatagttccctgaacacactatgctattccatattcttgtgctttctgatgtgttattccatctgcctgatgatgtaaacgtctttggagtccctgtattcatccagcaaaaagtccttttaaccatccatataataaaattaaccatcccataccatcatgtaggccagccgtatcagattattcatccttcaggttctagctcaactgtcacatcatctattcagccttccctatttctctcaatgtccattgaggtataggatgtttctactttggagaaaagaattgcttccttaacttccacaaagatgtatgtatatttgttttgtatcgttcattatatgctttagttatttgtattttaatctccccagactatgaggtccttgttttggttagactttgtaccctatttttattttcagaacctaacatgcccggtgctctgataaatggaagatttttttgttttgtttaaaaattactgttaacatcaataatatgattctgagttgtggaaaaattcagataaagtgagggaaattaatttttagtaaatgcccactatatgtcaagaattgtactaggctgtcaaaatacagtggttttcagatttattttagtcattatattcttaagagaaatcttacaaaatccaatatgtattacagttaaaagggaaatgaagctgatagaagcttgaagtgtggaccttggaaatccactgattagccaacaccgcccttttatgtagccagctctctctttctgtcttccagtagacataacctctctccttggttttcatccattaggccttgaggtagctccaaaagtacaatttgaaatctatagaattctttatttaaaccttttcagcaatcctctgaaatgagtgttactcttttcatcgtgtacattagaaaactgagactcagagaagttaaataatttgatgttcttgataggtatgtatttatcagatggcagatgagaaaataatttaataagattaagtatccttaaggacttgacctttaaaaacaggaatgtttcaaagaatagtcattaaatttttcagactttataataattcttcagccagagaagataagtgacataaaccctctcctggacctttttttttttaatacttagattgaaagtatccttactagaaaataaaacaaagacatattattgaagagtttgcctcccaaaatgtgaagcatttcttctctcctttttgtgtgggtttaattttaattttgaaatcttttcaaaaatatttttatttggagttaaagttttaactataacaaaattttatgcagaaaatgatgcacttgaataaaggactgaattttaatctttctgatggtcttcagcattagtatttgtggtttttaaaacatggaattttaagtataaatactgttaggaattaaggcattatggttaaataattatattaaatgcataactttgaaatcttctatagctaaaatctcttgttttaaaactgatttaagtcctcaaatgattgtaaagtttatatgtatatttatacatatagttaatatgtaactgttactcttgtataaattgcagtaaagcaaaacattctggagaagtgaaaaatcactctctaaattctactttgtaaatcttcataaatttataaaactatatcagaatgaaaatcagaaaattgagacagtgattacttgtctctagtaggtagggagaggaaggtgatcaggaagggatcagtatattaggtacatggtacatttattttttatatggtacaaatacactttttaatgtgtgaaataatagattttttaaagctaactttaatattttaattagcatctcttttaacaacaagatttcatgaatttttttaaaatcaacattttattgttacatatactctgaaacatgcttacattttacatagctaggctctaaatgccaatttataaatgacctggaaacatatagttcacaaaaatatattactaagtgcatgtagagtagtttatgaaattgcaactttaagaaaaagacttaatgaaacagtaaatgaaatgtattcaaatttataatgccttggatttatttcacgtcatattgtctgtattacagtttttcaatggaaattgtagattttaactttttattggtattatcgtatatttcctttgctaatttaattatttttgctaagtttttcttctttgcacagactaatccatagcaaaaactagaaagacttattagactggacgatataaggaaagattttcgggtgttttaaaataaagtatagctctccctaagcctatactttttatttattagaggtgatttctgtctgcctcatccatgctgtaacagagaacttcagtctgattctcataaatgggactctatcatttgtatatttaaagattctataatttccattgtgataatgtaaatacacactaatttcaaaaccccaaataaattctacataatctgtaatttggaattatctgtgtcgcccttcgtctgcatttgcataaaaataagttacccaagatcctatgtaagtatgtttaacaactgcaaacatttattgaccatctgttatttacagagttctctgttcaacctacaaatacaaatagaaaatatattctctaaattcaaggaatttatattctgtttacttggtttaagttttcttatacttaatggaaccaatagtttctttacagtttatcttctaggattccttctcactatcattactgatttcttgttatttgaggtcttttagtctcacctgcctagctttggaatcgaaatgcagattacctgttcaccttgtctactgttttcctttaaataatcacagagttactttagtttcttagtttatccagctatcttctaaagttattttaacttcagagttatggaaaaacacccttttattgtgtcatatttgcaggtattagtgatagaacagaaaaatgaagatggaacatggccaaggggtccttctactcctaagtaagtgctcccacttcttatggcttattgtatgattttgaagcccttgatgctagataatcaaatccacaatgatagaagaacctagatgtgtattgcagaaattcatgccttgtttatatttgagtattttgttcttagtatacaagctatctaaatttgctcttaattaatatgttactattttaaaagcctccaattcaaatatcttaaggcatagtataaatgtatggtataaatgagaaagttgcgttgtctgatacagtcaaatcattaaacatttgtttaatttcttgaagctttttcgtggtttttaaaagtatcttaaaatatttctttatcaaaatgaatctgatgtgaaagtaatatatttattcaaatgaaaagttttagaataaaaaagaacaaatagaggtagaggagtatatgaggtatttttgagggtaaatgaaagaagaattaggaatctttttatctgttttagaactaatagatctacactccattatcaaaacacaaggccagttgtgtttaaatatacagacttctcaaagctctaagaagtaatatggtacatgtccctccattactgtaatgtttctgtttctgcaaaaggacacttctttataatcaaacacattaatattttttcagcaaatattcacactaagtgggataaataaggactataaatagcattatatcagttcaggttaggttgccaccaaatgaactgtgaaaaaatttttaagtttttggagctttggaatttcacatgttctgataagggattgtgaacatatattttgaaattcttaaaataatgatatttttaaaaaactaataacaatttagtacattttaaccaagtgaataaaaaaatctgctactttatttgatttaaaactacaatgccctccgggtgcagtggcacatccctgtaatcccagcactttgggaggcgaagacaggcagatcaagaggtcaggagtttaagaccagcctggccaacatggtgaaaccccatctctactaaaaatacaaaaattagccaggagtgatgatgcatccctgtaatcccagctactcgggaggctgatgcatgagaatcacttgaacccaggaggcagaggttgcagtgagctgagatcgtgctgctgtacttccagcctggccaacagaatgcgactttctccaaaaaataaataaatataaataaataaaataaaactacaatgtaccttttataagtggttttctatccttttttatcttacgtgaaatttttttttcccatttaaaaatatcatgagaaggcacctaaatatgttaattacatggaggtgatttttattcttaccctacttagttggatgcagtacaagggtagaacttagtataaaagtagaacttttaagaagatgttaatattaaaagcatgtgggttgaattatggagatttcataactgatgaaggtttagataggaatattttttgtgaacatttacttttagtcttcaaagcagaaccactgttgtttcctaaatgtttagattgctatgtacttgctatatctttaagttatttttgaaattacaaaattgtttgtggattaatattaaaaaaaacccatgagttctaaagattgagaaatcttttctacttaaaatgactgatttttgcccaaaagatgactaattttatattttcttttattccctaatagcacaatatcatttttatttattccaacaactttagtacttggctttgtgtgaaagaaaacagaattccctatgtaatacccaacacaccatactcatgcaataaatattggtgaatacaggtgctgtactagagatgacaaaagtacaattaagagtcctatttttcactggatctactagttgaataaggatgccatatactaaagcatagaaaagttaaatatccattccctataaaatctaagaaatactatgcagtaatatgtcataaattgccaaataataatttactgtaatacagaaaaagatctgcacctatgtatgaaaagattctcagaaaactaagaataaagggaaattctaacttgatacatcctgtgcacctcaagtctatagcaaaagttacatttcattgagaaattttgagcacaatttaagtaagaggagaagataagaaagaagaaataaagttcactattcgtatatgatatagtcatttgtataaaatccaaaacagcaaactactagaactgagaaaattcagcaaggttgtctaatataagattaatttataaaaagcagttgttttttctataccgagagatcagcaatcttttttaaatgttttcagctttgtgggccatatggtctctgtcataactataactgctgatgtagtatgaaagcagccttagacatcatgtcaagacatggcaatgcctgtgttccaataaagctttctttgtaagtagatggcaagcttggatttggcctgtgagccataaatttctaacccctgccatttatcatgagaaacccacttagaaaatagtctaacaaaaattaacttaattaaaaacgcataaaaccttcatgggaaaaaaaaaatctaagtttattagaaaataaaagattgttatgtgatatatggcttaacctagtaatgcctgttttctttaaagcacatcagtgtctcctgttcaaaattttttttttcctagaaacttgacaaattcattttaaagttagcatagaccaatacaggtccagaattagctgagtcagttttgacagaaagaggaaggaaggaacactagacctacaaggtaaatgagagttactgtaaaattatactaataaaaacaacataatgctagcaaaagaaaggcaaatagattggtataaactagtaatctcagaaagattcatgtatatttgacaacttggtatatgatgtggcacaactaggtagtgaggttgcttaaagaagatgattatttagatttagtaggagtactggctatttggaaaaaaaagctagatccctactttcaactttatatgcaaaggctaactcttgaaggattaaagacctaaataagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtatggtggtggacacctgtagtcccagctactcgggaggctgaggcaggagaatcacttgaacccaggaggcggaggtttccgtgagccaagatcgtgccactgcactccagcctcggtgacacagtgagactctatctgaaaataaataaataaataaatgtgaatagtagaaattttggagaataactacatcatagggatcatagaacataatgttcaaatttagtagatctgattacatcagaattaaagatttctgttaaaagaactatacacagagttaaaagtcagatgtcagctttggaacttttaaaacctaaagggaataatacctgtaatatattaagaactcctaaaagttaacagaaacaaagaacaatagcttttaaaaaaataggtaaaagatactaacagacaatttaaataaagggtagctaagtgctaacaggtagatgagaagatagacaaactcactagtaatcagaaaaaaatgaaagtaaatgagatacaatttttcacccatcaaaatgacaaatatttaaaagttttctgatgccaagtattgggtatggtgtagatatctgtgtacttacgatgtgagtgtaaactaatattgtcattctgtaaaccagtcaataattaaatcagaagtgtttaatccctctgacccagcactcagaggaatttttaaacagatctttgaggatataatctttgtagctgcatagtttgtagtagtggggatttggagatagcctagctaaatatccatcactggtaaatagagcaaataagaaaaatgaaatgggagtaacaatggtgagatctttaaaactagatgaaactttaaaacatacagttgagagaaagaaacaatgagattcataaatatttaagaaaatagaaaaagcacagtagaaggaaatcggagtagagataataggaggaaagaggaaacaagtttgaggaaatatcacttgctaaatttatttatattatatttctatagatgaagcaaggatgatacagattcttttttctggatgaagcctggcttgaaaaaaaaacaaatggggctgggcacagtggctcatgcctgtaatcctagcactttgggaggccgaggcaggcagatcatttgaggtcaggatttcaaaaccagcctgatcaacatggtgaaaccccatctctactaaaaatacaaaaattaggcatggtaacaggcgcctgtaaccccagctattcaggaggctgaggcaaggagaattgcttgaacccaggaggcagaggttgcagtgagccaagatcacaccactacaccccagcctgggtgatagagtgagactccatctcaaaaaaaaaaaaaaaaatagaatgcctctgtgttcattgaaaagcacattttaggctgagcaaggtggctcacacctgtaatcctagcattttgggaggccagaataggagtatcacttgagcccaggagttcaagacgactctgtgcaacataacaagaccccgtctctacaaaaaaaaaaaaacaaaaattagccagttatggtggcatgcacctgtagtctcagctactccagaagctggggtgggaagattgcatgagcccaggagttcaaggctgcaaagagctgtgatcacacaactgcactctagcctgtgcaaaagagtgagactctgtctccaaaaaggaaaaaaaaaaaaaaaaacagaaaagcatgttataagcacatgatgttagcttaggcaaatttaactccagcacagaacacgtaattttaagtccttaggaaggacttcaagatattaagatacagaacagtttatactcctcaaaattctcacatttgccagaagacaacccctggccttcaagatggcatgaaaatgctagttctgatatatatcactaacctggaatttgtccataatgttgcatagcacataaccagttcctagctagggtgtcaaacaccaaagaaagataattaaagctgtaatatggtgatagaaagaagaatcactggtagaatttattaaaacagtttcctgggccccatcctcagaatttcttattatgtctgggtgtggctcatttctaataagcttgcaggtcacaccaatgctgttggtctaaggatgacactcagaaattttgtaggtgatgtttattgacatttactaggtgaaccacatagtggcatccagggttcccaccccagaccagcaaaatataaatatagttagccaaggaatttgcattttaagtacttcatatgaacaagaaaatagaagaatattaccacaagtaggcacacgtgaaaccacatgttagtattttgtctgttctatactgctgaaaatagaggaacctacttagtgctctgatgtcctattgtattggccccattttgattagttttgaaactgtgtcttcagctgaagcataaatttttgggctccttgagaagaaatgctaaatattcaaaaaatgttaagggtaaaatttaatttaaaacatgtagtcatttagttacaaaaaaaatatgtgtatatgcttttaatcagcacctaaaacaactcaaagtctgtattagagatctaagaacctacccaaaaaatactcactcaaaagtcttctgttcaagcacagtggctcactcctatgatcccagcactttgggaggccaaggtgaacggatcacttgaggccaggagtttgagaccagcctggccaacatggtgaaaccccgtctccactaaaaatacaaaaattagccaggggtggtggcggcgcctgtagtcccagctactcgggaggctgaggccggagaatcacttgaatgctaaaggtgaaggttgcagtgagctgagatcgcgccagtgcactccactttgggtagcagagcaagactctgtctcaaaaagaaaaaaaaaaaaaaagttttctaactgaatttttctactagatatcaacaaagaatttgaaatttttatttttatgttcatgctgcatttttaacactacttgttttatcaggatttgcatttcttatctagtttttaagtttgatttcttaaacagcctcttaaaaacatgatcttttctaatgataccttagaaaaagttttcccccctagttttaaaaattctgtaaaatttcatttctttttttttaaggatgttagcattgggtggataatctagttgttctattgcagacgtgtagctagtaaaatcttggatttctaaaaaatgattttacagtggagtcattatagaaacctgggggttcctaaagagaaaatttgatttaaatttattcattttcattgattagtcaaaaagtattgtcaaaagatatgtgcttaagtattgggtggaaaaaaaataagagtcattgatgattttgaagaggtgatttttcttggactggaaaacatccagagaaaaatgtactatcgtccagaataggacatgagtggcagaaagaaaaatcaaatggaaaaccatgctaatagctcttactcatacactgtccctctgccatttgtggtgttctgattaagggaattccaaattgatgactgaaacactataaacttaatttcatgacacaatagtattttcacagcactgtcttcttgagtgctctgcttggagagaggaagaactttataaataaaaccattgcatactacttttttggttgagacagatagtaagcacttaggtgattctgcaatattctgtttttattttttttacactatcttaaacgtctttagaaatttttagagagtattcaatccctgtttgcatttataactgcgaagcagctaaatggatttggaaatgatgcatagactcatttggttaaaaattattaaaatacatgttggctgtagccattctttattccttgtcattcagccagttcatacatttcagtaacaccaatcttcaatttgaaatgcaatctgtgaaccataaatctagagtgatactccaaaatctataatttgttgttgttgttgttttaagacaggacctcactctcattacccaggctggaatgcagtggagcagtcacagctcactgtagcctcaaattcccaggctcaggtgatcctcccacctcagcctcccaagtagctgggactacaggcacaccaccacacctggctaatttttgggtttttttgttcttttgtttgtttgttttgttttgtttttataaagatggggtttcaccatgttgcccaggctggtctcctgggctcaagcagtctgcccacttcagcctcccaaagtgttgggattacaagtgtgagccaccatgcccagctgttatctttttaaaagacattttgaatccttaaatttccttttatgcctttttttatgttgttattctcattaagaaacagatgtagaatggtgttttctgagactttaaagttggaggtaatgaaatagccaaacaaaaatgcttaggttacaattaaagggaactgcagtatggagtactgagaactgcaggtatggagtcatattcctataaatgggaatataagcatatataaattatctaaccaaaaatgtagagacaacataccaaaaccttaaagagcatcctgaggtaatgaagaaggacagttggcatcaaatagaataatcatgaaggctcaggaaaacttgtgctgattaaaacaaaaaatcccttattttttagggatacatacatactgttgtgttttcaggtgaaattatgggtgtctagaatttgcttcaaactactccagcaaaagagggggtcggagggaagctgaagggattatagaaaaagtaagaatggtagaatgttaatttttgaataccatccttttgtagtggccatactaatcttctctgtatcgttccaattttggtatatgtgctgctgaagcgagcactagaatgttatttttaaagctaagtttctgatattaggtacatgagggttaatgtatgtttcaaaatttctgtaataaagtttaaaaatgggttgcaagttttggtgcttagattcataattggctgaaaaaattattgtaatttcatttatttaaaatggaacattttgtgttatcaaatattatatgtaaaagtaagcagtcaaaataaggaaaaatagagctatgaaaaacaatttatatatagtataaatctacttaaactctcttttgtgtatctttaagtacctaacaccctacctggcatataggaagcatacagtaaatgctgttgaactgaactaatctgtatcttacaacagtaaaagtgtttaattttttaggagatttagaattttctttttctttcagaacttgtcttagaatgttgattagaaatggagagtgtaatgttggtcttgttttagttactaagctaatttttgttttatgatgttaggttgtatgaagttacgttgttttacaatgttgggtttgaaaatataaaaatctttaaataactgttttgctgtctcaacgttcagacttaacttctctgtattttggttgcttaatatggtggtagatttccatgagtgttaaatgtttagttgacttactaaaagcaagttatgtttttctattgaagtaagaggctcaacttagccttgaattgcatgtttttagttgaaacatattgggcatagggaaattcagatactacaaacttccatttgtcaggagtaaggctgaattttctgtcttcatgaaaccacttcagctaaatggaagtcttacctttttctgtctgagggcacgatatgttacacctagcccaaactggccaaaattagtttaattctaggtaagtggtttgatgtctagttaatgtatgatattcttagcacttttttttctcctttttctagaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttagctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttgccacccattcaggatttaacaaagttcttatttgtctttcttttaacctagtttatttgacctgtctttagtatttctttttgataaccatcttctaaagaaattctctgaatttgaatgcatgatacgaccttttatgccaaggactttgcctctctgaccagtcctttgtctgtctagctcggttcctctttagggttgccacatttagttttgcaaattgtgcacagctctaggaggcatcattcatatcatatgtagtctatgtgataggccctccttggcacggtgcagtgcagcttcactaactgtttgcagcagctctactcagaccttaaatgcattgacattcactaaatttctgtcagaagacctcttttatcataccatagtaggtgttcaaaattaggtgattctatgctaatcctctcccccagctcaaactgacacaaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagttgcattgttttttatttttgaaatttctttactatctgactgaatagaggacagctaaattcttgtatattcttctgcatttaatttattgtaatacaatgtttgggttgaagtacatgaagcaaaatcagcctcacacagatacatagttgaaaaggagtattttcagatcattaatactacatcaaaacttgactagtggtggtttaagtcttaaagttaaatgatagaatctgaaaccatatcaatgaaccttttatagtattaaaatctttcaaatgtaaatttcatgcattttggtcatttgggaaatattcacggagttatgcagatcttccaaatgttgacacattttattctacaatttttttcaaatcacattttttaaaacatcacctatcttatgagaaacgcctaagtattgggaagctgtcaactttgtggtgtcagagtcaagttttccaagattctaattcttcatcgaaagcccaaattttatcattggctgcaaatacattgttttccttaaagacacagccttccttcattcatttttcagaaaacctctgcttgatagctgtattagtccattttcatgctgctgataaagacatataggagacggggcaatttacaaaagaaagaggtttattggatttacagttccacatggctagcgaggcctcacaatcatggtggaaggcaaggaggagcaagtcacgtctcagagcttgtgcagagaaactcccgttttgttttgttttgttttttgtcttttttaaattttattttattttaagttctgggatacacgtgcagaatgtgcaggtttgttacatagctatgcatgtgccgtggtagtttgctgcacctatcaacccatcatctaggttttaagccccacatgcattaggtatttgtcctaatgctctccctccccttgcccccaccccccaacaggccctggtgtgtgttgttccccctccctgtgtccatgtgttctcattgttcaactcccacttatgagtgagaacatgtggtgtttgattttctgttcctgtgttagtttgctgagaatgatggtttccagcttcacccatgtccctgcaaaggacatgaactcattcttttttatggctgcatagtattccatggtgtatatgtgccacattttctttatccagtctatcaggatggagatttgggttggttccaattctttgctgttgtaaatagtgctgcaataaacatacatgtgcatgtgtctttatagtagaatggtttataatcctttgggtatatacctagtaatgggattgctggggcaaatggtatttctggttctagatccttgaggaatcgccacactgtcttccacaatggttgaactaatttacggtcccaccagtagtgtaaaagcattcctgtttctccacatcttctccagcatcttttgtttcctgactttttaataatcactattctgactggtgtgagatggtatctcatcgtggtgtgatttgcatttgtctaatgaccagtgatgaagagctttttttcatatgtttttggctgcataaatgtcttcttttgtgaattgtctgttcatatcctttgcccactttttgatgggatttttctttctcatgtaaatttgtttatgttccttgtagattctggataatagccctttgtcagatggatagattgcagaaattttctcccattctgtaggttgcctgttcactctgatgatagtttcttttcctgtgtagaagctctttagtttgattagatcccatttgtcaattttggcttttgttgtgattgcttttggtgttttagtcatgaaatcattgcccatgactgtgtcctgaatggtattgcctaggttttcttctaggtttttatggttttgggttttacatttaagtctttaatctatcttaattttttataaggtataaggaaggggtccagtttctgttttctgcatatggctagccagttttcccagcactgtttattaaatagggaatcatttccctattgcttgtatttgtcaggtttgtgtaagatcacatggttgtagatgtgtggagttatttctggggtctctgttctgttgcattggtctatatatcttttttggtaccagtaccatgctgttttggttactatagccttgtagtatagtttgaagtcaggtagtgtgatgcctccagctttgttatttttgcttaggactgtcttggctatacaggctcattttttgtttcacatgaaatttaaagtagttttttctaattctgtgaagaatgtcaatgtcaattcaatggggatagcattgaatctataaattactttgggcaatgtggccattttcacagtagttctccttgaagaggtccttcacgtccattgtaggtggtattcgtaggtattttattccctttgtagcagttatgaatgggagttcactcatgatttggctctctgcttgtctattttcggtgtataggaatgcttgtgatttttgcacgttgattttgtatcctgagattttgctgaagttgcttatcaggttaaggagattttggactgagacaatgggcttttctaaatatacaatcatgtcatctgcaaacagagaccatttgacttcctctcttcctatttaaatactctttatttctttctcttgcctagttgccctggccagaacttccagtactttgttgaataggagtggtgagagggcatccttgtcttgtgctggttttcagagggagtgcttccagcttttgcccattcaatatgatattggctatgggtctgtcataaatagctcttattattttgagatatgtttcatcaatagtttattgagagtttttaacatgaagggatgttgaattttattgaaggccttttgtgcatctattgagttacttatgtggtttttgtcattggttctgtttatgtgatggattacttttattgatttgcatatgttgaaccagctttgcatcccagggatgaagctcacttgatcatggtggataagctttttgatgtgctgctggattcggttgaccaatattttattaaggatttttgcatcaatgtgcatcagggatattggcctgaaattttctttttttgttgtgtctctgccagcttttggtatcaggatgatgctggccccataaaatgagttagagaggagtccctctttttcaattgtttggaatattttcagaaggaatggtaccagctcctctttgtacctctggtacaatttggctgtgaatcagtctggtcctgggccttttgtggttggtaggctattgattactgcctcaatttcagaacttgttattggtctattcagggattcgacttcttcctggtttagtctggggagggtgtatgtgtccaggaatttatccgtttcttctagattttctagtttatttgcatagaggtgtttatagtactctctgatggtagtttttatttctgtgggatcagtggtgatatcccctttatcatttttattgtgtctatttgattcttctctctttattcttcattagtctagctagcagtctatctattttatttttttccaaaaaaccagctcctggattcgtttatttttattttttgaagggttcttcctgtctctatctccttcagttctgctctgatcttagttgtttcttgtcttctgctagcttttgaatttgtttgctcttccttctttagttcttttaattgtgatattagggtttcaatttcatatctttccagctttctgatatgggcatttagtgctataaatttccctctacacactgctttagcagaatctctggtacattgtctctttgttctcattggtttcaaagaacttctttatttctgccttcattttgttacttactcaggagtcattcaggagcaggttcttcaatttccatgtagttgtgccattttgggtgagtttcttatcctgagttcttacttgattgcactgtggtctgagagactgttaggatttctgttcttttgcatttgctgaggagtgttttacttccatttatgtgattgattttagaataagtgccatgcggtgctgagaagaatgtatattctgttgattagtggtgaagagtttgtagatgtctgtgaggtccacttgatccagagctgagttcaagtcctgaatatccttgttaattttctatctcattgatctgtctagtattgacagtagggtgttaaagagtcccactattattgcatgggagtctgagtctctttctaggtctctaagaacttgttttatgaatctgggtgctcctatattgggtccacatatatttaggatagttagctcttcttgtggcattgatccctttaccgttatgtaatgcccttctttgtcttttttgatctttgttggttttatgtctgttttatcagagactagtatttcaacccctgctttttttttttcctttccatttgcttggtaagtactcctccaaccctttattttgagcctatgtatgtctttgcatgtgagatgggtgtcctgaataaagcacaccaatgggtcttgactcttcatccaatttgccagtctatgtcttttaattggggcatttagcccatttatatttaaggctaaatattgttatgtgtgaatttgatccagtcatcatgatgctagctggtttttttgcacattagttgatgcagtttcttcatagtgtcattggtcattatattttggtgtgtttttgcagtggctggtaccagtttttcctttccatatttagtgcttccttcaggaattcttgtaagggctacctggtggtgacaaaatccctctgcatttgcttgtctggaaaggattttatttctcctttgcttctgaagctttgtttgcctggatatgaaactctgggttgaaaaatcctttctttaagaatgttgaatattggcccccactctcttctggcttgtagggtttctgcagagagatctgctgttagtctgatgggcttccctttgtaggtgacctgacctttctctctggctgcccttaacgttgtttccttcatttcaaccttggagaatctgacgattatgtgtcttggggttgatcttctcatggagtatcttagtggtggtctgtgtatttcctgaatgggaatgttggcctgtcttacaaggttggggaggttctcctgaactaggttgaggaagttctcctgagagttcacgtctctctgaagtgtgttttccaacttggttccattctccccgtcactttcagttacactaatcaattgtaggtttggtcttttcacatagtcccatatttcttggaggctttgttcattccttttcattcttttttctctaatcttgtcttcacaccttatttcagcaaggtgatcttcaatctgtggtatcctttcttccgcttgatcgattgagctattgatacttctgtatgcttctctgatttctcgtgctatgtttttcagttccatcaggccatttatgttcctcgctaaactggttattgtagttagcagttcctgtaaccttttatcaaggttcttagcttccttgcattgggttagaacatgctgctttagctcagaggagtttgttattacccaccttctgaaatcttttgttaattcatcagtctcagtctccatccagttttgtgcccttgctggagaggagttgtgatcatttggagaagaagcattctggcttttggaattttcagcgtttttgtgctggtttatcctcatcttcatgatttgtctacctttggtctttgaggctgatgacctttggatggggtttttattggggggtctttttgttgatgttgttgctttctgcttgtttgtttttcttctaacagtcgggcccctcttctgcaggtctgctgcagtttgctggaggtctactccagaccctgttcgcctggttatcaccagtggaggctgcagaacagcaaagattgctgcctactccttcctctggaagcttcgtcccagaggggcactggcctgatgccagccggagctctcccgtatgaggtgtctgtcaacccctgttgggaggtctctcccaggcaggagacacgggatcagggacccacttgaggaggcagcctgtcccttagcagagctggtacgctgtgctgggagaatcccccttgtcaggatcagctgctctcttcagagccagcagccaggaaagattaagtccactgaagctacacccacagccgtccctccccccagtgtctctgtcccagggagatgagagtttcatctgtaagcccctggctggggctgctgcattttcttcagagatgccctgcccagtgaggaggaatgtagagaagcagtctggccacagccactttgccacactgtggtgaatcctgcccagtcaaaacctcccagtctccatagcactgtcaggggaaaccacctactaaagcctcagtaatggcagatgcccctcccctaaacaagctcgatcgtcccaggtcaactccagacctgtgctggcagtgagaatttccagccagtggttcctagctttctgggatccatgggagtgggacccgctgagcgagaccacttggctccctggcttcagccccctttccaggggagcgaatggttctgtctcgctggcattccaggcaccactgtagttacgagaaaaactcctacagctagctcagtgcctgcccaaacagccacccagttttgtgcttgaaacccagggccctggtggtgtaggcacaggagggaatctcctaatctgcagattgcaaaaaccatgggaaaagcgtagtacccgggccaggtagcacagtccctcatggcttcccttggctggaggagggaggtcccccaactccttgcacttccctggtgaagcagtgccccaccctgcttctgctcactctctgtgggttgtacccactacctaaccagtcccaatgagatggatacctcagttggaaatgcagaaatcacctaccttctccattgatctccctgggaacctcagaccagagctgtttctatttggccatcttggcccctccccgaaactgccatttttaaaaccatcagatctcatgagacccattcactatcacagaacagcatggaaaagactcgcctccatgattcagtcatctcccacaaggcccatcccacaacacatgggaattacaggagctacaagatgagatttgggtggggacacagagccaaaccatatcattctgcccctggcccctcccaaatctcatctcttcacatttcaaaaccagtcatgccctcccaacagtcccctaaagtctcaactcatttcagcattaactcagaagtacacagtccagtgtctcattcaagacaaggcaagtcccttccacctatgagcctgtaaaatcaaaaacaagttagttacttcctagatacaaggaagatacaggcattgggtcaacacagccattccaaatgggagaaattggccaaaacaaagggtctataggcccagtgcaagtccgaaatccagcagggcagtcaaatcttaaagctccaaaatgatctcctttgactccatgtcttgcatctgggtcacgctggcacaagaggtgggctcccacagccttgagcagctctttccctgtggctttgcagggtgtagccccactcctggctgttttcatgggccagcattgtctgcagcttttccaggtgcacagtgcaagctgtcagtagatctaccattctggggtctggaggacagcggccctcttctcacagctccagtaggtggtgccccagtagggactctctatgggggctccaaacccatatttcccttcctggctgccctagcagaggttctccatgaggaccccgcccctacagcaacttctgcctggttatccaggcgtttccatacatcctctgaaatcaaggtggaggttcccaaacctcaattcttgacttctgtacacacacaggcccaacaccacatggaagctgccaagatttggggcttccacactctgaagcaacagcctgagctgtaccttggccccttttagccatggccagagcagctgaaacacagggtaccaagtccctaggctgcacagagcagggtggtcctgggcccagcccataaaaccatctttccttttaggcctccaggcctgtgatgggaggggctgctgtgaagacctctgacatgccctggagacattttccccattgtcttggggattaacatttggctgctcggtacttttgccggcttgaatttctcctcagaaaatgggattttcatttctattgcattgtcaggctgcaaattctccaaccttttatgctctgttcccattataaaactgaatgcctttagcagcacccaagtcacatcctgaatggtttgctgcttagatttcttctgccaaattccctaaatcatctctcccaagttcaaagttccacaaatctctagggtcggggcaaaatgccaccagtctctttgctaaaacataacaagagtcacccttgctccagttcacaagttcctcatttccatctgagactacctcagcctggactttattgtctataacagtgtcagcattttggtcaaagccattcagcaagtctctaggaagttttaaactttcccacatcgtcctgtctcctgagtcctccaagtctccaggaagttccaaactttcccacattttcctgtcttctgagtcctccaaactgttccaacctctctgcctattacccagttccaaagttgcttacacattttcgggtatcttttcaacaacaccccattctactggtaccaatttactcttttagtcagttttcatactgctgataaagacatacttgagactgggcaatttacagaagaaagaggttcattggacttaacagttccacgtttctggggtgggggggcctcacaatcatggcagaaggcaaggaggagcaagtcatgtcttacatggatggtggcaggcaaagaaagagagcttgtgcagaaaaactcccatttttaagaccatcagatcttgtgagattcattcactatcacaagaactgcatgggaaagacccgcccccgtgattcaatcatttcccaccaggaccctcccacaacaccagaggattatgaaagctacaagatgagatttgggtggggacacagaatcaaaccatatcaatagtcaagttcacataaccacacgtagtcgtttcctaacgtaaaagagaaaaaagagtggtgtcatgaaaacaatgactggttccacttgtagttcatgcagttcaaataactacacaagcttttcctcatgacagccatgatacttcagtttgtagcagatatgctttatgcaaacttcccagtttgtcagataatattaaaaagaaatataagagttaagatttaataaaatcaataattttttatttttttcaatgtggatattctcaagtgaaacttttttactgtgatgtgaagtataggttagtgctactcctttgattcatgctaaggtttcagcagttttatccaccattgcttttgcactatcagtgccaatatccactcagtgaaagaggtcaaataacatttaaataacactttgatattattatgaaaatagttttgacctcaccaatggacaccttaaaaagggtcttgatgacccccaggatccatggactatactttgagaactgcttcctaaacatccaagatatgttgcccttgcccactctactttcttaactccaccccttattaattcttacctttgttgtttttatagttccctaactggtctcccaatcttcagtctttttctcttccttaaaagttcctagaatagaaatctgattttgttgatacactattaaaatctttccacatgctccagcacaattggataaaatccagatttcttcatagaatataaaagaccctttattatcatacctaccttagtaacctctgttcctgtcagtacttcctagtctttcagccaagctgaatttactggtaattccctgaacacatcatggtttctacatgatttctacatgctattcttcctaactgtaatactcttttacttcccacctatccctctaattgtacgtcatttttaaatcaccttatgtcaccacctacaaaattttatattagaatttgttatcatacttgtattgtattatagtcattttgcttatatgtcattttttcctattgtgagctgtttgaggtcaggaactgtgtctttctttgtattcccagtacttatcaagggtgaggcatacagtagtcatttaataaatgtttgagtgtttaaatgaactccataaaaactgaaaatacaaattaattccatggtatttcattttcttttccaatatagttctcagagttgctaattaataataaaaaaggccacagatgagaagaaaaagaaaaaagtgtgtgtgtgtacatatatatatgtacacagacatacacagtgtgtgtgtatatacacaaagtgtatacactgtgcatatatattatatataatatatatgtctcagtcactttattggatgaagcaatggatctttatttccataatttttactataagattcaggggaacattcgatttatatatgtttttgaaaagttgtaatgaattacattttaaaaaattaacctccttaatttattataactcagtctctaatcaatttagacgttttttcctaatttagaattcttaatgtggaggcaaaaatgccaggatatttccatttttattaatattttaaaactactatctgggaatattaggattattaaaattactttttaagtgtgttctatacattgttttatgagaaaacttggttgattctattttgtttttgagtttagtacagtaaaataaaatcttgttaaagggacttctatcagaagggtacgtaactagaaatcccacttaacagaatccagtaatatatatcatttatcagctaaaacaacctcgttgaaaagaaaacatttttttctaagattttataatgtataaaactttaaaagttaaattaggcctggtgcagcctgtaatcacacctgtagtcccagtgctttgggaggctgaggcaagaggatcacttgaggccaggagtttgagactaggctgggcaatatggtgagatctctgtctctgcaaaaaaaatttgtttttaaattagctgggcacggtggcacacgcctatagtttcagtttctcagtaggctgagatggaggagctcttgagcctgggaggtcaaggctgcagtgagctgtgattgtgtcactgccccccagcctgggcaacagaacgaaaccctgtctctaaaaaagtaaataaaaatgaaatttaaaatgtacatttttttatatttaaaaaattttattgcccaccatttgttctgcataatgcattgtagatatatatatttagataaatccaaatcacctaaaagcaaattttgtagattatgcttttctgcctgttgaccatttcattgttcgttagcataatatttaaaagtgaatcattcggggcctcactgatttaaaatttacaatgactgagtcactggactgaagcctagctttttacagccccttgcctagatgttgcctagtaaattaaaataacatgtttacaaaattacaaggggaaataaaacttttagtgacctttatgtacttaaattattgctgtattatagatttgttgattataagtcatgcctttaatacatacttgttgattaaaaaccaatagtaattgcagtttcttcaaaaagattctgaattaataaggtatgtatactatagtcagatttatgacttttccctttggccaaatatagcatattgggattatgcttggaattattttatctattttgtccccattgccttaaatttttaaaaattggaatgttctctgatctctgtgtcagtgttgtacataattagaatgccatggtgtaccagtgagaaacaaagtagaatagtttaattccattgactgatggaaattgatcgtaaaatgttaaaaatggttacctaaactcggaaatgggtatatgtagttagtagatttataggaataatagcaagtcgcatatttaatttgataaattttatttgaaaatagttcccttttgtacttttatgtttttataaggaataatacattcaaaattgaaaaccaaaggataatagtgattttgctcataaatctatttttcagcattcatttactacaaacattgtcatctgttcttttatttcataattaatttaaaaattcttcatttttttatctaatttaacattttcatatttttaaaggtccccaggtgcatccaatttttcaactttaccaaagatctctccttcatctctatcaaataattataacaacatgaacaacagaaagtaagcactgaatcttaaaaactctttgtttaattgatcaccctattatggttgcaaaaaatctcttgtatctaaaatttaggataaaagtcttaatgcattaaaattggttttcttttaaattaccggtcagttcttccatgagtaacaacaaaaaagaaagcaattaaattgcttcttgatttaatacatatactgaaagaaataaaacacttaaattttatatactaaacactaatcattaaaatatatttagaagtttgttagaacacaactttttaggaagaatttaaattcagatgtcattttagaactagatgtgtaatcacatataataaagtatttttaaaaagtgtgtatcagtgattctcaagtggaaagcacacaataaatttttgtttatgaaaaaggcaatcactttttcttgagaagttcagaaaaacaatttccttacctcttgccaaataaaatttagaatcatggaatttataaaaattttattgaagtgtgtgttatattgctataagaaaaacagttgaaagtcaaggttacacagcttcactctgagtgtattatcttgtattgactcttagtgtattaccttgaacattgacatgtttttttaattcaaaaaggaaaaaagaaaacctttattatttgtaattagcccaaattgtgggaagaacattgatctagagatgattatccttttatttttttttgacatgtatagtgccttttatggattagattgaaagtatttagatatttgcactaacatattagtattagatatttatctaatacttatactaattatgtattactattatactaatcaaaaattttagtatttagatttttttcagtttctaaatggcatctgattatctcagtgagtaaattctaaaagactaaagctatttgtgaaataatctttaaaattaaaacaccaataattaaattaaaacaccaataattaaaacaccaatagttaaatttattttctaacagctcagaaacagatctttgtataaaaagaatttaatatgatcaggaggcattgtagactaatacgaatgggcagattatccaggaaatatggttgagaaaattggctcatatctgagaattcttctctggaattttaaatccaagataattgttaagcatatttaaaaaggaaaaataaatggaaaaaagaacttgttacaaatgataaaggatttatattctaaatatatcaagctcataaaaatcagaaattttctaagacagtcttagaaacactgggcaatacaagtaaaggaattaaataagggacaaactttttttgaggtaggatctcaccctgtcacccaggttgaagtacagtgtcacaatcacagctccctgcacccatgacctcccaggctcaagtgatcctcccaccttagcctcttgagtacttggattacagcacacgccactacaccctgctaattttctttttattattttcatagagacagtcccactatgttgcccatgctggtttcgaactcctgggctcaagcaatcctcctgcctcagcctcccaagtgctgagattgcaggcatgagccaccttgcccagctgggataaatattttacattttcacattcactactgattagagatatgtaaattaaaaccatgaaaaaccccatttgctttcccttacctcagtcacattgggaaaaattaaacaatgacatgtatttttataatgattctgagtgtttggagtactagaataattttttctagcaaaattgtttaccaatatgaatcaagaacatttaaaacatttacattcttatttcagtaattcataaaaagatatgtgcactatgtgtaataatattacaacatagtgtaatactaaaatactgaagacactgaatattcagaattacactgcagtatcttctcttctatttaaaaatgtatgtgcacaggccaaaaaaaaagagtgaaaataacccctcgtaatttggtttgtattacatgagagctttaagtaaacttaccaaaagtcattttttcatactagataaaatattacttatgatttactcattgcagatggctctcatacttactgtaagagaattcatttacaggtatttacagtcattctttggagagatttttaacattgtatatagactatgttgaatgtagactatattttgaccagaattaccatattggtatgagtggtctggtgtgtttctggttttgttctgtttgcattcttagtaaatacgtgacagtataatctaatctcaaaacctctgactgcagaaactattgagagaaattagagtcttaagtttgaatgattctatcatatgactacattatatttttagctatttatatttttttaattcaaacactaaaatagccctgtcatattatggaattttaatagcgaatagtcactgaggtaccatgaagctgtgaaccattttgagcttaaaaatacatttttatgtaaggattatctttcttagtaaggaacagaacttaagcattcgtaaaatggaaagttttttttttttaactttaaaaaacttgaattctatcgtatttaaacaactgttttacatacaatttatttcttgaatttccattcagcttgtgggaagacttcagatagaaatagcatagtttctttaaaaatatgtaaaataggtaatgacctttttggattaagtatgtttttgaaaccttatgtatgtggaaatagtctacaagtataagtaatatattaaaatcaatagtttatgaaatttatttataaattcaagatttaaccctacactgatacatttctaagatataaaatttttatttccagaaataagaatattgttataaaataattccaagtaataaagtatacttggaattatttcatttaagtttaataagtttttattaaaaaccagtattatgaaaaatccattactgtaatatagtttgtttaccttgtgtcataattttacctattagtcccttgtgtatttggttttgcctcagttataatttaagtacatttttaaatatctgtcagattgtctttctggtaatagttctataacctgtatttttctgccctgctatatttgctttggtatattactaatactgccttttaaaaatatttttaacgtgtttattgtctcaatttgacattccaaatgcagaacacttttttatttttctgttaattcatttatatctttttctttgaaatgaaaatgactccctgtatgagattgagcctcaacaggaactgtgaattttggaaactaccagagctagccatctggctcttgataaatttgttagctaaaagcatcatttcattaactgaaaaatgggcataattatagttttgaggattaaattatatatttataaagtcaggtgtcagtgctagtttaaaagtcaatctgacatcttttatggaaaggtaaggttcaatttcacaaaaaaaaagtgtatttttagtgtatttttattaaagaaggatataatacagaattaatctaatataatattacaattcccattactattactgtaaatttatttttgcaaagtagcatagccttaaaagatgatgactagcttaagatctttaggaaataattagtagacatagtcatgaaaggtactagaggctatctttagggcccagattttcatatattttttgaattatataaactgctagttttgatattttccatgacaagccttaatatttcatttagagcacacataatatgtggattataagtgaccgatcaagatattaaagtatcttaaattgattgattttcattatcattttgagcatctagactatctcaatctttgagcaaagttgtagatattatttagggatttagatttttttaaaaacaaaaccaaaaaactgctttgcaagtaagttttttgttcagttctcagtaaatagcaatttctatcccatcaaattccatcatgttgctgcaaagaagagtagagcttccagcatccctttgtgttacacgtggggagagacaggatatctgaatatatacttatggaatgagcatgtaaatgtgcttttagtcttttcacgtgtgtgtgtgtgtataggcatgaccatgcatttgggcatactttcctgtgtgctctggctgcttaaattttactatgattttacagccagaagttttttcttctctgtaatgtgtagaatgtgtagaaaatgaaagccttgctttttttaaaataatatacagcagatcttcatttttagcactacttaaacttataaaagaaaaacaggattttttttgtacttcagctttttgttgtgtgtacccaaagttagattcaataatccaattatgagcgaaaatacttaaaattgctaataggcgctttgtactttattagttactaggaatatgaaataaaatgtgaatcatgggctaatgatttgccaaagaaagatgcatgaattatattttttgtgttttgttttagtttaagtcaagtaaatagctataagtctagcaattccgaatttgaattgattaatgttacatttctttggcgcctgctgtttttatctcagggtggattattttttcagagttgaggagttgacctcttttgtttgtagaagaaaggagtgttttttaaaaaatgcaaaaacattagtaggccaacattgtatgtgtaattttaggttggtttggttttgtgtgttttctctgggggtggtgtgtgtgtgtgtgcgtgtgtgtgtgtgtatgtgtgtttactaaagactttcttagaacaggtagtatagttcacataaacttttataataataaagtgagagcgtcctatatggaataataaagtgaagtatttaaaattataagaaaaaactactttaaaaaagtaataccaggaataaattatagccagttgtgaattgctagagatactgatttatcatgctcatttataaagctgttctatttatagcatcatttgcttttaggaaagatctcattcaggttttttctaattaataaaaacagattgaaagcatgcttttgaattatatccaaaatattcatcatacatattttataagataacctattaaaaaataagaaagaatccattctttttcacaaaattattttttattatatgccaaaggaagagggatcgtttaacttattttcttctttctaaaaattatactgattttgtaacttttagaatattacagttttttaatattaacatttaaaatatcttgaggttatatttatctgattaaataaactacattgttctgagaaaccaaaagaaagaaaaggcaaataacactgggatatacttgcgtggaatcatttttgcattcctgttcacccaggcttttttctgcatttgaatactagtttttgctggtctcgcatagaaactataaatggaatcttcagtgcatcataacagtgaggtcacagtggccttggaaatctctgctcttacctgtaactttttaaagcataactcttactgtttctaccatttttactctattacaataacagaatgcaaagggtcataaaggagatgatttgttgctgcgggtggtatttaaaatctgaatgttttaaatttgatggagcaatggggaatggagcaaactgtaaagctgctctagttaatcaaaggtaggaagatataatagtgctttgtattggttggtgtggtatatgagagttattttgttgattggataaggagtatcttaattcagggtgagttatttttttgaggttcaagtctttaaaaaagtatctgagttgagtactttataaaagaaatgtaatgatcaaccacatatctcataaataggcctaaagtactctttattataaatatgttgtaatataattggctgcattatgaaaattttttttcttccagtgtgaaaaactcaaattactgtcttccatcatataccgcttataagaactatgattattcggaacctggaagaaacaatgaacagccaggcctctgtggcctaagtaacttgggaaatacgtgtttcatgaactcagctattcaggtaggtctttgtaaacaaaatgaaactcatgtttcatggaaatctgtaatacaagaagataaagttgggtttttcatgccagaacatgagtatatgttttgaaagttcatttttcatggaagatttaagcatacatatttgacttattcattctactactggtagtggaatatatgtttctcaattaggtgacctgtgattgattaacataatgtacaagattatatatcactttgcaaaaatataatatcagacagaaaacttaagctgtctaaaaagggagggaaaaaaaagcaaaactaatgagttccctccattattcagtagaagtctgttgcactttttttttcttttttttttttttttgtcttaatgggaaattaaaattttaaaaaggaaaatcttgggaacttctttttgtatacatactttaacaaatcactttcccttaaaggtcttttaatttggggatataagagataactacttttcccctgcccccaccccctttttcttttctttctgctctagtctatatcctcaacttgttaaatatttatgtctttgattgattctgaagtaatgagagagatatattttttaatatcactgttactgtgtataaacttagggctggttattttattccccttttacagataaaatttctgtgtttataaaagctcagaataatggcaaaccatttttgatatttgaattttaacctttttttcgtcagtctcttgtgaattctggatttttagttttaaatctaaacttttctgttctctattcttatttttttgttgaatctcctatgcccaggaggcagcctcaaaagatatagattaaatgcagggtatagattgataaggacattattagacatctttctcactatctgagaaaaggatgactcttcaccattcagtattctaagtgaatctttttgtacatcatcattcatacagctgtttcctaaattaaccattgcctttatagcattcttggaaattagaatctgtcatacactataggccaggagttagcatccttttagaaattgaatagggaaggcataatcgatttctggtattttgctttagagttgaaccacttgggaagtggcctatctgcctaagcagataggttaatatataggttaataaactcttcctttaaatcttcaaatgagtaatcctgctcatagtatagtgtgaattactttattcaaaatagtttttcaagaattctagcactagttagacatagagacaatttaaatttttatctttatttttctagatgaggaagaaagccaaaatgtattattatcctaatagttaaataacaaagtaaagtacatgggtgcttagctttcagagataggaatgggacagacaaattataatatctgttggaccatctctggaacatgttttatgtaaattgtgtttataccagtactagaaaaccctgttctcagatcaccaagttatattaatttttatgtacctctttatccttgaactgccaaaattactttggttccagatgcttgatatcagctagagttttttttcctagtttagaaaaccaatcttggtgctttttcataaatattaataaaatatttcaacaacatagggattcaaaatttgaatctgtcaggagagcacaagagtttgtgttgatgctaatcattcatgggaggcttgggccagcattcagactaaattccttctaaagcaatactgcatcctagttttctgtgcctttgatacatctgtttagtattgtctgcatatggttaactgcaatttctcagaaataggtattcaaattgaatcttttaaccagctaggttaagctagatttggcatcgtttagctttcttgcatgttatgtttaaggtgtgaggatcttcagtttattcatttttgcttctattcaaaactattttattagaataaattgatagctctattgcagacactcctaatatattttaccatcacgtattccatttcatctgagacacagccgtgagcgtgatggtttataattttatggtaatagccataaaattttttgacaaaaattttagcagtgagtattttaagcagtggatattatttcatcattatagctttatttagttggaaactatattgtctctaaaataaaattcttcaaacaatttggagaagagaaaaatgagtttttacttgtgcggctttagcttttagttcacatctggaattagaaaagctaggcctttagttttattttcttaaaacttccatgatttttaattgattaagatgtcagctctcgagctgaaaattgactgtaagagggagtacaaaatggtggcagtagcctttactcctctatttcacaaaaattcatgtagttcatagatccaaaaataaaaagggtaatagataactaatagaatagattctttaggttttgtcagatactatttcttcagtatgcttttttcaagtttccttgtaacttctttgaaattgaagacgttcatgaattttagaaaatattatcaaatattatctctactgacaatttgaattttaatgtaacctcttaaattaattcagtgtcctccaaatttaagtgatcatttcagcacatcaggtggtatagtattaacatatgttaaaaaaaaaagagtgtaaaaagtatacttttttaatgtaagcgtgggttatacttagcccatcagtagccttgagatagtgaaatcttttgaccacacatgattaaaaactaagcagcaccaatctgagtgtgatttaacattattactgttattatttaatttaatgatattggtacttaagattttctgatgtaatggtatgagtattaaccttgtttggtgaatatggtactgccatatagcacagtaaaaaataacaatacaacagtttgtccaggcatggtgactcatgcctgtaatcccagcactttgggaggccaaggcgagtggatcacctgaagtcaggagtttgagaccagcctggccaacatgatgaaagctcatctctactaaaaaatacaaaaattagccgggcatgatggtggacacctgtaatccaagctactcgggaggctaaggcaggagaatcgcttgaacccgggaggcagaggttgcagtgagccaagattacaccattacactccagcctgggtgacaagagcaaaactccatctcaaaaataaataaataaatgacaatttaaaataatgtgaattttaaaacaatgcagtataacaattaacatagcatttacattttattaagtattataacaaatctagagatgatttaaagtatatgtgaagatatatgtaggttatatacaaataacaacaccattttatatcaagaacttgagcatctgtggattttggtatccccaaggtggagagggggctcctgtgaccaatcccctgtggataccaagaacaactgtatatcctgaccttatgaagattatagcctagatattgtgattttcaaactctttgtattttagcatcaaaacttttttttaagttaccgtggaaagtttaattgtatccccaatatttaagtagatatggtaaaattgctttggttgggtgaagttcccagaaccccatctgctttcctttactttccacaatggccccagaagctttctcatggatcccaggactctgaggaacagtttgaaagccaaagtctggcttgaaaaaaaaaaaaaaaaagaaacacataaaaaactaataatacagattaagatcacagtttatggagttacactacttggattaaaaacatggccttcctgcttattataataactgtatttccctagacaagttaattccacaattcatttttctcatcgtctgacaagaaaataatagtaccctatcttaggagttttgtaagggttacgtgagttgatggttttaactcgtaggatgctgactggcacattataaatactgaatacatattatgtagaaattatctcatctttttttaaaattcaacaagttaagcagaatgactctggaaagattctgttctccataaccgttctatctgtcctcttttcttgagtctttttccacgtggaccttagtggactaagaagaaataattgagtgtacttttatttttcatatagtgttattgtaggaatggtatttatcaaccctttaatttctgaactatgctaatttaactcttcctaggcaagctgataaggaagggatataatagcatagaattgtttatgaatattctatctgtagggcactaggaaattcaaaattgttgagtttggttacccctagcccctgcctcctgagtagttatgattataggcatataccaccatgtcccattggttcaaataatataataagatagttttctagttccctaaatctgttactccatctagagaatgcccagtttttaaattttgcattattggtgataattttaattagcattagttcagtagattcaagagcacttcaacccttgtctttttcattgtcaaggcctacctaggaggctcatggttagtttcctggatgaagcatctcctcagatggatttgaagcaggggagtaatgtggtcttttccattggaaagcagcatggcataagatggttattttcaaaatatttacttggacataatagagctccttagatagattctaggaagtcattgaaaaaaatgatactaatcaaagacttattcattattcctgtcataatatataaaataaattgggatttcaagcatttttaaggtcagcttttttttctatgatctgtttattaggaaaaaacttaatttcaaaaatttagaagaatgttaaatagaaagtttaaacttttttaaagatttaatttaagagaataagtaatactacacagaaataacatttttaagaaactagatagatcttcattacattgtaaaacagagaaaaagttatttctgaagctgttatttctatgttacattacttcaactagcctactcttaccttgagactttctttttgcatttattggaactcagtttcttagaagtccagtttaacactaaaccttctagttttatttaaattaccaaccttatatttaaatgaatatacttttcatcgtaaaaggaaaaacctcacttctgagacacaaaacactttttaaaaaatagtttaggatcttatatttgttctgataaactgagaacgtggctaatgaaaaatttaaaactactactttctaggtcaggttttcatcctaatccaggatgttaaactcaattatgtgagttcctttcatgttatgtgccagaaattacatagcaaattgtcatcaaaaatatattcaatcctctgtcaaatgacaactcagtcaggtcatctatccattttgataaaagcaaaaaaaaaaaatgtaaacaaccttacttgcattagaaccattcatttttctcaacatgaataccaatgtttttacttttccctttggactagaatagcccttcctttttgaaagagaacagaggtgggaaagaagaacctacgttctcagacagattattttaagaaagagtatatatgggatagttctgtaaaaatttagtgttcacaactaggggaaaaatggtatctctaaaagaatgccttgcacttgtgtaacttggctaataatgatttgttatgaaaacatgcctttcttaatctcagatggagacatgagatttgatttgtcgctgttcacattcttctcagtgaataagcaaaattccctaagattagtgcctctttctgaattaagtttttatgtgtttatctgtccctaattctgtagtaggaaaatgacataatagagatcttagagaaatagagaggttcttttaaagagttgtaaattattacatctaattctaaaatacaaagtggttttactatcctggctaggaaaggccaacaccaatttaataatatacttattagatagtattgtagtgactacatcttataacagaagttattaatgtaattaggctgaagtatcttgtatcaattattataattatttcaaggattttttttgtaattaaaagcaaaacaaaagaaatgtcaatctgtagtctgtaatgggaactacagatttgctccctccctccaagaaaataaaaggaaagaaaaacctatttcagatttacttctcttacttaaaatcaagcagctcatttttttgatgtcaaaatgttttctaaaagtttaccatttacttctttacaatgatttataaactattctgggcaggggagagggtcagtgagttggttacttaaaccattgttcgattaatagtaatatctaaatcaattactagttctcatataaacccatattaaaacattaacagccctgtattgaacctgcagcctctgttaagagtggtacccttctttgcataatgcaggttatttttttatattgtttttcacttaattttctcttcacagaggtctgtgagttagggcataagaatctctattccactaatgaggaaattgaagcaaggaaagtttgatttccagtcactaagacaagttattatgagttgttattcagtacattttgagataatgtatttttttgaaattatgccaatcaacctataagaaatgcttatgttttgttttttgtggtaaaatataacaatttgccagtttaaccattttaagtgtatagtaacattaagtatattcacatgttgtacaattattaaaaatgtttttatgtttagttcaaatgattggcccccataatacaagatgctctcattaagtagcattaatgttgtgccatttaaaacagtttccctaggaggtgatatacacacttactcattcaatgttcagaatgttaaaaactattcaagtactccttttggaattgcttttattcttctgagtatcactggtggatatttttcatccttcaatgacaaagttgatttttgaaagccagaagttattcagagcactattttcagaatattgtagattatcaagctgggtaatttttttcaagtaattcataagtaatgaatgactgatgaagtcatttactcagcaaatatttattgaaggtctattaggtgactctcactctcataatcactaattatgccatgatgaacaaaacagttttttcccatggagtttacagtctaatgagggagacaaatattaaatcaatcatgaattatgataagtatcatgaaagagaaagtagagtgctaacaggaacttggagagcacctgttttaagctgggtgtcatatttacgaaaagtaacatgagctttgaccaaagaatatgtatgagtttggcaggtgaagttagaaggaccaaaaacatgtgcaaagccactaagaagggcaagtttgaggaatcagaagtgtagtttgtggaataatgtatgaaggggagtgagacaaaatgagtttgaaggagtaggcaaaagccagatcatatagggagaatttagattttaatgttacaaaggcactaaaggtttcaggctactatcttcttaactggttcattccatttgtctgctagctggtttctttgcttctatccttaccctccacaatctgttcttaaaagaacagccagcaattcgtttcaaacctaaggcattttctattacttaggcaataacacaaaatgccttctcatttcactcaacgatcaatgaaagccagagtccttaaaaaaaagtacaaagccctgtaggatctggccccatgctagcttatttcctatcacttacctccatgcttaccttgttccatcctcaccctcacatgtgccaagagcgtgcctgccttagggtctgtgaacttgcagtttcctatacctgtaatgttcttcctctaaatatatatattcttgcactctcacttccattaggtcgctattatctatcagtgaggtgcttcttcagtcaccctgtaaaaaataatgactgccccacattccacacagtactcataaccatctggcatgttttatttctattagggttttttgcttgtctgtgtatcttcccctactcccaacacagacaccctctccccgcgtccccaccccgtgctctctctctccctctctccctctctcccatgactgctggaattttgttttagtcactgttgtagccccattgcctggaatagtgtctggcatgtagaaggcactcaaattaatgaaaggtgaagggaatcacaagtgtctctctagtttttggcttatatatcataatgatagatgtaaccatttaatgaaattccagagtagtaggaagaagaacatagtaggagaagtaaatttggggtggggaggagattatgagttaattttaggcatgttcagtttgtgatgtctgtgaaacatccaagcagatagatcatagacagttggatattctagtatggaatgtagatcagaggcctaagctggaaataaaaatctgcgtgtcgtaggtggtggttaaaatcatggaaatggttgtttctaaatgagggtatctatgaaaaagacgtccgagaactaagccctgcaatacatttgaatggaggaatgagacttcgtttgcaataggaggaaagaaagggattacggatgcaagcaatgtctagattctctgacggcttccattatccccaaaatacaagactagatcattagctaagaatgaaagggtaagaagattgctcagcagtattgaggtctcatttgatattggagatcatcaattcagaatagtataaatgtattcacttgaaatttttttccaacaatgttcagttgcatggtgcataaaacagatgcctagattcatctagagttggaaagagaaaggggcaaaggagttattaataaaaagcaaccaaacttgttttcttgtttgtatttatttatttatttagtgaatggaattatttttttaatttttcttttttatcatattattatactttaagttctggggtacatgtgcgcaaaatgcagttttgttacaaaggtatacacgtgccaaggtggtttgctgtactcatcaacctgtcaccttcattaggtatttatcctaatgctatcccttctctagccccccaacccccaacaagccctggtgtgtgatgtccccctccctgtgtccatgtgttctcatttttcaactcccacttatgagtgagaacatgcagtgtttgattttctgttgtgatagtttgctgagaatgatggtttccagcttcatccatgtccctgcaaaggacatgaactcatccttttttatggctgcataatataccatggtgtatatgtgccacttttttttatgcagtctgtcattgatggacatttgggttggttccaagactttgctattgtgaaaagtgccgcagtaagtgtatgtgtgcatgtgtctttttaatcaaataatttataatcctttgggtatatacccagtaatgggattgctgggtcaaatggtatttctagttctagatccttgaggaattgccacactgtcttccacagtggttgaactaatttacactcccaccaacagtgtaaaagcattcctatttctccacatcctttccagcatctgttgtttcctgactaatgatcgccattctaactggtatatgagatggtatctcattgtgattttgatttgcatttctctaatgaccagtgatgaagagctttttttcatatgtttgttggctgcataagtgtcttcgagtagtgtctgttcatatcctttgcccactttttgatggggttgtttgtttttttcttgtaaatttgtttaagttctttgtagattctggatattagccctttgtcagatggatagattgcaaaaattttctcccattctgtaggttgcctgttcacgctcatggtagtttcttttcctgtgcagaagctttttagtttaattagatcccatttgtcaattttgacttttgttgccattgcttttggtgttttagacatgaagtctttgctcatgcctgtgtcctgaatggtattgcctaggttttcttctaggatttttgtggttttaggtcttacatttaagtctttaatccatcttgaattgatttttgtataagttgtaaggaaggggtccagtttctgttttctgcatgtggctagccagttttcccaacaacatttattaaatagagaatcctttccccgttgcttgtttgtgtcaggtttgtcaaagatcagattgatgtaaatgtgtggtgttatttctgatgcctctgttctgttgcattggtctatatatctgttttggtaccagtaccatgctgttttggctactgtagccttgtagtatagtttcaagtcaggtaacatgatgccttcagctttgttctctttgcttaggattgtcttggctatgccggctcttttctggttccatatgaagtttaaagtagttttttccaattctgtgaagaaagtcagtgtagcttgatggggatagcattgaaagtaaatcactttgggaagcatggccattttcacagtattgattcttcctatccatgagcatggaatgtttttccatttgtttgtgtcctctcttatttccttgagcagtggtttgtagttctccttgaagaggtccttcacatcccttgtaagtggtattcgtaggtattttattcccttagtagcaattgtgaatggaagtgcactcatgatttggctctctgtttatctgttattggtatataggaatgcttgtgatttttgcacattgattttgtatcctgagactttgctgaagttgcttatcaggttaaggagatttagggctgagacgatggggttttctaaatatacaatcatgccatctgccaacagagacaatttgacttcctcttttcctgtttgaataccctttatttctttctcttgcctagttgccctggccagaacttccaataatatgttgaataggagtggtgagagagggcatccctgtcttgtgccagttttcaaaggaatgcttccagtttttgcccattcagtatgatattggctgtgggtttgtcataaatagctcttattattttgagatgcattccatcaatacctagtttattgagagtttttagcatgaaagggtgttgaattttgtcgaaggccttttctgcatctattgagatattcatgtggtttttgtcattggttctgtttacgtgatggattacttttattgatttgcatatgttgaaccagccttgcatcccagggatgaagccgacttaatcatggtggataagctttttgatgtggtgctggattcggtttgccagtattttcttgaggattttcacgtcgatgttcatcagggatattggcctgaaattttctttttttgttgtgtctctgccaggttttggtatcaggatgatgccagcctcataaaatgagttagggtggagtccctcttttgtattgtttggaatagtttcagctgctctttgtacctctggtagaattcggctatgaatacatgtggtcctggaatgtttttggtaggtagactattaattactgccttgatttcggagttgtttttttgtttgtttgtttgttttttgtttttttgagatggagtctcactctgtcgcccaggctggagtgcagtggcgtgatctcagctcactgcaagctctgcctcccaggttcatgccattctcctgcctcagcctcccgagtagctgggactccaggcgcccgccaccacacctggataattgtattttttagtagagatggggtttcaccagttagccaggatggtctcgatctcctgacctcgtgatccgcctgccttggcctcccaaagaaatttcagacttttttatgggcctattcagggatttgacttcttcctggtttagtcttgggagagtgtatgtgtccaggaatttatccatttcttccagattttctaggtgtttatagtattctctgatggtagtttttatttctgtggggtcagtggtgataacccctttatcattttttattgcgtctttttgattcttctctcttttcttctttattagtctggctagcagtctgtctattttgtttatcttttctaaaaactagctcctagatttcattgatttttttgaaaggtttttcgtgtctctgtctccttcagttctgctctgatcttagttatctcttgtcttctgctatcttttgaatttgtttgctcttgcttctctagttcttttaattgtgatgttagggtgtcaattttagatctttcctgctttctcttgtgggcatttagtgctataaatttccctctacactgctttgaatgtgtcccagagattctggtacgttgtatctttgttctcattggtttcaaagaacatctttatttctgccttcatttcattatttacccagtagtcattcaggagcaggttgttcagtttccatgtagttgtgcagttttgagtgagtttcttaatcctgagttctaatttgattttactgtggtctgagagactgtttgttatgatttccgttcttttgcatttgctgaggagtattttacttcttattatttggtcaattttagaataagtacagtgaggtgccaagaagaatgtatgttttgttgatttggggtggagagttctgtaaatgtctattaggtctgcttcgtccagagctgagttcaagtcccgaatatccttgttaattttctctctcattgatctgtctaatattaacagtggggtgttaaaatcttccactattactgtgtgagagtctaagtctctttgtaggtctctaagaacttgctttatgaatctgggtgctcctgtgttgggtgcatatatatttaggatagttagttcttcttgatgcattgatcctttaccagtatgtaatgcccttctttgtctcttttgatccttgttggtttaaagtatgttttatcaaagattacgcaacccctgcttttttttcttgctttccatttggttggtaaatattcttccatccttttattttgagcctatgtgtgtctttgcacatgagatgggtctcctgaatacagcacattcatgggtcttgactctttatccagtttgcctgtgtcttttaattgaggcatttagcccatttacatttaaggtgaatatttgttatgtgtgaatttgttcctgtcattacgatagtaactggttattttgcccattggttgatgctgttttttcatagtgtcaatggtctttacaatttggtatgtttttgcagtggctggtactggttgttctttccgtgtttttagtagctaatttatttagctgactcaacaagcattcattgagtctctactatgtgccatgcattattctagacattggcatacccagttttaaaagacagtacttgtcctctagaagttcatgtttagtgaatgaggtagacatataaataagatataatatgttatataatagaaaacatgatcagcaaaatgtcatggaagcaaagttctttctttgagtctatgggacataagtgaggctgtatcaggagggtgaaatttgagtcacatttttatttcatttattagagcacattactgtccattataacttatatgttcatttggtcataaaatagagaattaccagggatgcaaattaaaacattatagcttatgctagtttctacatttttttcacctcagaaattcccgtatcagaaatccgttttgccacagcaaaaacacattgttcacacactcaataaaaacatattggaatcctttatatgccaactggtttttttttttcctgctacctgatttttttattttttcatgtgccagctgtcgatgctttttcacacatgtgccagctctaaaaagaggagtacctaaaatatcttgagcaatatataatgcttattcttaatgcctcaattatataccggatttggtgtataccacataatgctgcttctgttatttactatatttgatacgtaattgaggcattatgaataatttctagggcttttctaagtgcagttttctatactttgccaggagaagacttctaataagtatttttaaaatgaaacaaatttgtgacaaaaatgttacttttttaaataaggaaatccttaatattaatagtagaatgaaacatacatttagcttccttttatacttacagtagtatcattgtataataacataccaaaaatatatgtgtcatcatgatgatacctggaacccctcttaccatccctgagacctgttcccttgtttactctttgttttattcttcttttttgtttggttttttgagacggagtctcgctgtatcaccaggctggagtgcagtagcgcaatctcagcttactgcaacctctgcctcccgggttcaagcgattctcctgctttagcctcccgagtagctgggaccacaagcgtgcaccaccactcccggctaatatttgtatttttagtagagacagggtgatctgcccgtctcggcctcccaaagtgctgggattacaggcatgagccaccacgcctggccttgttttatacttttaacctcacctcttcactgtctttcttcctttcagcgtatatacatagtcaagtcttttttcatctgggaagtagagtgagggagacccatgaccttgaacaggatgatctgtgctttccccctactttcccatctcccattcaatagtccttatctcaccatagcctgtcagctgcttagcatggtaggtcaaagcatggattttggaactagactgcctgtattcaaatcctaattctgccacttacaagttgtgtgaccttggataagaaacttcgtagtttcttcatctgtgaaatgaagataaagtgcttaggaagtgcttggcacatgtaaacatataaaaatatcaaatactgttatcattactgttgtcatgataccaccctatagaaattgcttttgattagctcactcttgacctcctgtttgctaggttccttgtaccccctttacctttgagaatttgacatccatctatatactaatatccaaaatttccctcatccgtaattctctcttctgaatttccctccaatatgtaactgttaaatggacattcctgccaagttaaactacatgtaacttaaactcaagatgcctacttacactaatcttgattattttatttcctacactttcttataggtacaacccagtaacccaagtcaaaaaccgaagacttatcccaagtcctgttcattctacttcttatatagcacatatttttccctttcctctcctgttacattatttcaatgcttaagcatcttttttgtgaactatcaaaatatatctgtgtcatctctttgttccatcatttgtcctcttcaaatccattgaatacagtgcttccaaatttattgttttataaggcaaatatgattattatgtgtttaaaacctgtgccccatcacctaaaggataaaattcaaactggattctgtctacctgtttagccaaaactactttcaattcttagaatttattatgtttcaaaactctttgtatatactgttaccgcttccctacttgcgtttttcatactttctctctttcttctatccatttctcatggacaaatacgtattatgtggtgagaattgtgaaagcagaggctatctttggttttcttttatatccccagtgttagtatagtaccagataatcgtaagcacagtagaacagtgttttttacaatgtgtctatggacaagataattctggtcaacaataaaataagcacagaaattgtaagtgatcaaaagtctctatagcaatttgatagggtaattttatatcaagtttaataataaaaagcaagacttgttttttatatgagtgtttttaattttatttttctagcggttcatttttattatatcttacacaagtaccaatctgtggtggaatttttaaaaaattagtcctttccatgtaattattgcactttcacacccacaataaagcttctacctgaagtgccttctaggtcattgagaaacatggaaaattatcttccatatagatttagaggaaagtgtattttgctgtggagctaatcatttgaaaactgggaatagcatcaggaggtaaaaatagctcgagcggaaatatttgggtttgtatattagctctgcaacttcttctgtgtgtgtgagtaagcaggttacttatctattccaagacttagtttcttcagctctaaaacaggagataacgcttactaaatttacttttcagagctgttgcaagaattagtgaaatgtacatcaagatgtattttaataaaaataatgtgttcggtattttaaaaaaaattagttctttcacacacctggtttgcaaaacactgcattagaaaaaattatttaccagagatatttgaaacttgacctgagctatctaaattcccaaagattgcacagtaattttagtaagaattatagcacataatatatatatttatttcttgcaactggagggtcagagagctacctatatatgtataataactcttggaccatatacggtcctgcaaatgcagtcgatctgatagcacttgaattgagctggcatgttagtcacagctgggcagatcatatcagtaccaccatggaaatagttccttgaaagatttcagtgaatgataggaaaaaaattcttttagaacattatttgtatacttacagagactcttgaagtaatgatctcttaatatttgttgaacaattaaagtttttttattacaaaaatggcttgtttctcttaaagaatgtaacaaatcaataaactttaaaaaaaaattctgctgtcctttcctgtatgcctttgcagaagaactaagatcagtaaactcacacaattcttaatatttatttattcaaaattgtttctttactgaatattatgtgcaagggactgaacacatacaaaattataaagaaccattttttcataaatcctttgactgtcttgcttgcctaaaaagttaattcttttaaatttcattgtgagtcagttttgaattattaatgggataggaaataacgtaatttaacattaaaattgaattccattcaattcttctatttaagcttccattctttaaaataaatataacttacaccaacatttcttaatgttattagaaccttctggttttagcatacttcccataaagtgaatatatgaaaaagttttaaaattcacgaatagcctgttactaaaaataaaataatgaagtcagacaactgctgacataatctagtattaatagtttcaaaaccttatttaaaaacaacttgtcctagtcttctagcctttttgctggtgaaataattatcacagagacttccacttttatctgtgtcataagtgaatcctctatccatattttttttggctttcaatatgaaaattaatggtcttcacataatcatggcttttttaacattgacatctgtagttacagaatttactcactgcaagtaatagggtagtctttttgacaaacttagagttttccttccttggtcctgtgtagatgagggcaaaaaaggattgacatttctttgctagccaacaaaatgtttcccatcagtgtcagtatttatacttcctagaactttgataattcttcattgaattcaaatagtatgtgaagaagaaataccatagaatttcaaagaagggacaacagtggggactttaaatgaagtttaattttattcatgtcttaagcacagggaccagattaatgatatatattcaagtgttaggacaacatccttgtccagttcaaaaaccttgcctttaaaactacctttatttaacattttaatattttaagtagagtatgctagttctctcttcactgacgggggaaaaaaagcagttaaaagtcttaaaaatataagaggaaaattatatccatttctattttacttgcctaagtttgttctttttttaaagttgaagaaaaatggagatataaagtaaaacagagctgtagctgtattgctgtcacaaaatatgtgatcttcagaattgatctctcaaatttaatgagatttccctttcttagaaaaaatataacaaaaataagaacatcaagtgacttaaaatatatcattttaaaaatctgcttgatgaagaaacaggcctatatttgtagtttttaattgaaaaagtttacctcaaactttgctgtgttatccacttgtgtagcattacagaactagagccaatatcccaatattagtagattgctttggaatcatacagtaccttttcagaatgcttatactattgtcatgattaattagaaaacaattgacatggcgaatatgaaaattcttttccatctaaccttaaaatccagaaaaaaactgtttaaaggtattccaagatgactttaaccatggattacttcaagttttattttttaaatcataacaaactaagaatgaatcccttattttatttagaatgggcttttatttttagtactggtcagttagaaggtatagccatttttttaagggttgtgagtggtattaccttttgattagttatagaatgagttacacaactcaaaagctttaggtaatcaaaaattaagtttgttttctttcctgttctagttaccggtttactaaaatagtgagcatacatgatcacttgagaattgggcttctggagcacctgaacagaaagggagtggttcatattcagcattacaaaagacaactttctctttttgaaggggattactttggctattttccaggtactggggaaattccaaatgcattacaagttattgggatggctattaattattcatttcctaaaatatgttgactgaagacttgagatttggttatataatagaacattatttgacttcatcaatttataaaaaacttatgtagaaatttagcaaaatacaaaattgagactcttacatgcagcagttatattttttcagataactctagaaacatcaggcttattagtcagaacatacttagtagaagtactttctgaaaataatggaagagcaatagaatttgtgcatgtgtatataaagaaaagttatgtgcaatgcattgcatctttccaagtaattacataacaaaagaaaatcatattttgcataatatttcagttttaggatattaggttaaggaagggtatttataactagagagtttttaatagagaattagtactttaataaagaatgcataaaccattcaaatatttttataaataattcttcaaggtgtaattaatggcctgaatatattgaaccatatcacagagtgtccattggatgagacatttgattatttagaataattcttctttagaatttttatgtctgcttcgaggttgaagatttaggggaaatgatcttcataaaaatatatttccaaacatatttcctttgcataccttttccttacggatttatcttgatagttgttggggaaatcataagggttattttccttcattaggaaaacctctttaggcatcatttggacttttatttttgaacatggagaactttgggctgcatttgaattataacagagtgcaattcagatctcattttagtcaagttttttctcactgctctaagtctctctaaggactacttctaatctttctactatacaagttcccattcattccacatacctgtttgagtgtgcccgatattgtgatagaccctgaggtacaagggtgaataagacatagactctgctctcaagtgcggtgtaacggagttcgaggtatcaagttagcccagagaaaggaatattcgttcttccttgatacacagaggaagatacgacatttagaagagatgttgaaataagtgtttaagaataaataggaatttcttataggggatgaatattctaagaaaggcaagagtgcatgcagtctcaatacattaaactaaggaatatgtcttaagacgcctaattcaaattcgagtactcttattacttgcagtttcccatataaaatatatatgaaggcacaagtagagaaccacaaagccagttcaaaaccacaaaaccacttagcagtcatttctcactaaataattgtcttgcacatacaatagccattgttacctttccttgtggatcagcttttcataatagctcatgtcctaaactttccaacagtcattatatcatagtgaattccaaaagtctaccatatattaaatatgaaatttagttttttaatcattactcatggatcaacttttcataatagctcatgtcctaaactttccaaccagtcattatatcatggttagtgagctccaaaagtctaccatatactaaatatgaaatttagttttttaatccttaaattttcaaatgctgttgtcagttttgtgtgctaataacttacataggagcatttgaaaatatttaaatataaaaataacctagttaataagtacatttacttgttaatataaatttttttctttttctctttttcattaaaaattggaactattagtacaaagtctttttctttagtctggctattgctttatttttaacatatttaaattctacccaattttaggaccaacagtaggtaccattatgatataaacaaaaatgtggcttaagaaatatgttttatgatcagtcacatagcctcatatttggaccttgttatattagtgataaattttaagatctagttctcctgaaacactgaagttttggcatttgttaatgtcaggcagttgaactccaataaattaacaggggcatagctccaaatggcatgagactggtagacatgtcacaaaacttataagtagccacaaaaataacatactaactaatactgtttatataatctctttcatttgtcatgatacattcatatatattctcagtttttattaagaacaaccatggctgttgcagaaagttttgtcctgtttaacagtccaggaagcattgagagtaagagatattcacgtaggcacaacacatatccgatttttagtccatattataatgcatcactcagtaaagtgtcttacaggataaaagggaagttttctactgctacctacacatggaagatttttaaaacatatatgtctttaagaaaagaattgttttgggatagtctcatctgataggaaaatgatttttttatagtagaagaatcttcgagatagatacttcagaactgattattattttaattaccttataaaaattatacatttttaattttatgtatttttaatttttatgggtacatagtaggtgtatacatttagggggtacatgaggtattttgataaaggaattcaatgtataataatcacatcagggtaaattaggtatccatcacttcaagcatttatccctccttcatgtttcaaataatccaattatgctcttttagttatttttaaatgtacaataaattattgttgactgaaaattatctttgttcattaaaacatggtatttaattgcagccagtccaagtaactagtgttcttataattgtcaaaaatgttcatgttctaagatagcctcatgtgaaaatgttaaataatgaattgcataaagtaattactaatcaaactacattatgaccaactttaagaaactggcttcagccaggtgcggtggctcacgcctgtaatcctagcactttgagaggccaaggtgggcagatcacttgaggtcaggagttcaagaccagcctggccaacatggtgaaaccccgtctccactaaaaatacaaaaattagccaggcatggtggcacgtgcctgtaatcccagctacttgggaggctgaggcaggagaatttcttgaacctgggaggcagagattgcagtgagctgagatcacgccattgtgctctgcactccagcctggacaacaaagtgagattccatctccaaaaaaaaaaagaaaccggcttcttttttctgccagaatgatgacattgaatactgatataacatcacgtggggcgtggcaatatttttaattgcttgatttttttttccatttatgccttgaaatttagcaaaaattatgagaacttttaatattttaaccggtctttatgctattttaagaacatactaactcaaggtctggtgcagtggctcatgactgtaatcccagcactttgggaagccaaggcgggcagatcacctgaggtcaggagtttgagaccagcctggccaacatggcgaaaccccaactctacaaaaaatacaaaaattagccaggtgcggtggtgggcgcctataatcccagctactggggaggctcaggcaggagaatcgcttgaactcgggaggtggaggttgcagtgagccaagattgtgccactgcactccagcctgggtgacagagtgagactccatctcagaacaaaaaataaaatgaacatattgactcctaatggtattttcaagatgagggtggaaaggatggtatttttatgagggagaaatatcggacatcatcttagtttttaaactaatatgatttgtgtattagtagaacaattatattgactattgaatttatgtatttatatgtgtttatacaacttgttaggaagtgtagcttgttagaatatatgtttaacaaatagaatgtttatttgggcccatttaggactaaatagcttaaatttaaatattggttatgatatcttcacagataacacaggcaaattatcattaaaatgatttgtgttttgttgttatttgttaacattgaattataatcagtttgaaaccagcatgtatcactgtgaaaataaatgctggtctctgtttcaaggagtttttaaaaatcaaagcagaggatcatttacaaagcagatagtagattgaatgaaaaatcagacaaaggggcagaaaaatttgtactgcccgtatggtttagtattaggtagaagtacttgaagatatttttgagattattctttagaaatatatttttcctccatttagtaagtagtatttcattcaacaaaaatttattgaaccctctatgccaaacattgaaggaaaagagtaaaaatcaagaggataaatgcattagtaaatacaggcaaaaatatttttagtaagcatacatttattgtgaacatgatcagtgctacgtgacatagtgctcagtgctggaaatataaataagaataccctggtacctgctttcatggaggtctcagttcatttggcaaaacaaactaaaaattaaagttacagtatattatcaaataagtgctgtaataaaagtaagcagtaagcattaaggaaacatacaggagaaaacactgtaaggaaatctaagggaggcttcccagataggatgccagaatcttgatggatttatagaagttagtaaggccaaaaaaaaaaaaaaagtacatttccaagtagatgaagtaatgttgcagactttcagattgagagagtatgtggaggaatgactaattaaataaagctggaacagttgaaaagaaaagggtattgacaaaggatgaggctacatagatgagcaaaagacagacccttctaagaatttgggcttccaatctgtaagcagggagagccgttaaaggatttatagcaaggaagcaacatgatgagatgtacattttagggagagcactctggatactactggaaagctaaaaaatgttcagttatacctttaagctctttccaagataagagtatatgtgaataattaagttataacaaagtttaagaattactcaggtttgtgcaacttggttcttttgagatatttgtaaattaggttctttatataattgcattaacagacaataatggaatgttacattcttagcataaccctgagctgatcaaatataagaagcggaaaactattgataattgttggaaattcctatctgacctgtcctttgtctgactatttaatgttgatcttattttgtactaaatcagatgatactaagtgatggcatttaccctctgtgtagctatgatgcattctaaattgcctggatctccctttagtgctgggtttataattaaaaggacatataatacaaaggaagaagagaaactgaaactcaaaaggagtataagattatgagagaggttgagatctaagaggtaaaaagttagggaagcatcctttctcttaattgcctcctacactgtagcatacctctctttctcctgctcacatatattaaaaagttctactgctgaaaatatgtatatgactctaaaggcctatatagctcactccaaacattttagctgtttttattattttcgttgcctaagaattatataatcgtaaattccatgatattataaccagttgtcccttttgccttgaggtaggggccaggctagcaatttataataaataatattatttttattatatagaaagtttctaaatagatattattgactacttcagtaaacatgttgatttataattgaaaccacaaaattgagtaccagaattattctaaaaaactaagtaaatgttgactctgcttattttggaattttagctaaacaatgcatagtatatagtcgtagtttatggcatgtaagttatctgtgtgaattcaacaggctgaacctttcatagctaccaaacctgtctaacttaatacaaatgactataagcaagcttcgaaaaactctgatttccattaatgtgaatccaggctctcataagagtgagtttctactattttccatgcaagcaactagcttccttgcagcactttgccacttaattccaacacaaatatcatcctacagcaaaaaaaatttacttatgtgaccatatgtctgtgttagtcgttgcatattatagacatctaattgataatgtaatactgggtttgtattgaggtcaaattatatggatcatcaccttaaaattattccaacttgagataaaatgttgaaaaattgtacgtctgccatgttttattttaaatatgaaattttttaattcggaattggaaagagttggaaaattaacttatttatagtttttattttgccataaaggaaaattgtatcgtttatgaaattaaagagctggaagtgagaacacacttaccagagttcacatactaaagtttgttctctcaggctcaagtaatctgtactgtctcttctaaaaatggttgaccatatggaaggtttaaaggctgctctttcatgataaataattgacaatggaagcagtaaatacctctattaagttaatttcttgcttgcactctatctcagtttttacctactcaggctaatttgcaggtgcctgggatgagtagacaatccataatttctaccaatcaagtaaaagaaggaaagaaaactgagcttctctcccagttaccaggtagtttgctgtggttaaaattaatgcagattttacagcagcggatattagcatttttatttattataagtaattattttgaaatttgggaaatgaatagttgagtacatcatttgagtgtttatttgaccagttattagtgcaagaaaccatcatttaaatgttctctgtgttatagcaaatcaatttgtttctctcttcatattaatgtgttttaagaaaaattcattatgattacttttacttgaaaatatattttattttttgcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaaggttagtgtggtaaatgcattttagcaagggtacctgcaagggtacaaaagttggttcttggggatagggggagtgaaaaatagtagctattacaatggtttgtggccctccaaaggaacacagtacataaatagatatacagtacatctgtgatataaaatttaggtgggagggatatggaacagtttatctgttttgtttttgtttttgtttttgttttacatctaaatctggaatggagagaataatgaaaaaaagttgaaaaacactggtgtggtacaagaatgagtatagagacagcaatgagcgtttgtatagttgttttggaatatagtacatctctggaaaacctatgtgaatattctatacaaatgtaaaagactaaatttgggcatgttactgaactctaagaacccattttactttgagagtcattatgaatttgaaaaattatcaaaatgaaaatagtctgcaaaccaagcattaaaaattaaatgtactttcaatatagttcttaaacttttaaggttattcacatgtgtgaattgttacttatcaaataatttattgttcaaataagaattgagctgaaatttagctttatggctgaaatttagctttatattgttaaaaaaatgcctacttaattatataggtgaaactttgagaagttttaaacttgtagagagaataagcagttttaagtcgttatttatacaagtaatttaaatggcattgatagaggacatctactggacaacattttttattagctatatactagttcttagaaaataaaaaaccagcaaatcaaaatgcctctgtattgtcttccttaacattctaaactttggacaaactagtccagacaaaccatctctcagctcttactagcattctaattggttttattttggtagattttctctcttaaaattatgtgtaaataggttctttatgtgtgactttttttctgtcagatgatgattcatactattacatttattttcagtctcatccaaaaacaaaaatacttagtgatgaaagattaggaaaattgaatatgaacattaatgtttctgttatctctgtgatactcatcctccttttgcgcatagaaactaagtgagagcctagagtagttatcttaaaaatgctttcagatacgtaattatctttatgtggtaatatagcaaggatgagaacctgcctcttcctgtctacctaccagacatttataggaggaggcaataggaatacctaaagctaagaattaaggacatctggaaaatcctttgacaaatagtgaaacaacaattaatgacaatgaaatctatgaccaaacaaagatcaatacatttttatatattaaagattacatgtgttgatctattttgtcccagataagctttgttgagtgcttactaggaatgcaaaacaaaatataattcatatatattcctgttgttcgtgtatacaatttttattattcacaggagttatgttcaatgaagctgccacaaacactgaaataacaactactgaaccattactcctagggaaactatagggtttgattcctccaagcctttgttcacaacattttcgtcaaccagacaatgtataactttgttttgcatgtgtttctgtttaaaaacaacttgtttaatatatattgttgagtccttaacattgaactcacagcaaacagtgctataactcatgtcttaatgaagcatatctaacacatactttttctccataaagcacatcacagctttcttgcatttaggaacactagctggcatgtttgtacttcatttagtgaccattttaaacactgaaattaacaacaaaacaaacaaaaatgtgaaaaaacataacactaaataaactacaaaggacacttgtttatagattcagagctgaaacaacaagccaaagcatcaccttgttcaaccccagctggtaacatgcatatcaggtgactcaaattttttgccactctgaaaatatctacaaatgaccatgaattgattttggggttacaaatacattttagaaagcaggcaaattcacaaatgtggaatccatgaataatgagaatctattgtacatatgtttaaaaatcaaccctgttcctagaactgatttgatggttttgcatttcttacagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtaaatttcatgatcctattgtcaccattgttataattttgtgatacctctttctaatttgtgtctattatccttgtaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcaggtaaatcatgggttggtttgttttgtttttttttttttttttttgcatttgttatttttattaaaaaattagtgttgagtccttattataaaaattaagtattgaattatcaagcccaatcaataatgtttatttgtataagagattttataagctgaatactttggaaatcagtgtaactttttacagtcttgaaagagcaacgtgtgtcttataaaaaattctcaaaaggctttttatagaggtttatttttataatattggggtgaatattagcttatgaagatcaacataatatttttaatttttttaaacttcaactttctttagtgttaattgtaatttttttttactagtggctattggaagtaaagctaatacttttaattcatagtgtgatagtagtgtatttaaatacctgtaatttttaggcattttaggaacttaaaagaaagtagaaattcagttagactaaaaatattttgttcagtgatgttctctaatttctaatactttgaagtatcacatattgtttattctgtgcaaaagtcctgtggtaagtcttactgtcaaattgtctgcctgattccgttacctagtgttataattggattatttatattttgtgggtaaagcactatcttttctcccttatttattaatcagttaatcctcttctgacacttgacccatcccagtgaaagtaacttcttctttttctacctctctttccctaaattctaacacttaactaattttgttataacttttggcttacttttatcttttatccctagactacaagtctttgaagacagagaccttgtaaacctttgtatttccagcttttgtggctggtaaatattaatgcacaagaagtattcaaaaattttattcatcaagatacttaactatgcacctactaagtataaagctctttggctaaacaaaaaagatatgattcctgctttagaagattgttttctgtaaatttttagccaaatagctcagtttgttagtgcataatagtcacgatgtctatatgaaagctatatttgaacaaaattatgatcttaccattcagggatgtatttgggtttattgtcaacaaagacagggtatatgtagtgttcataaacacacagtccttttattcaaagtaattaaagtctagtagatactaggtatgtactcagttatgcaaatttaagcaatttgtttttctgctgctttatgttttctttatgaactcattgaacacaatgccctcatatcagtatttcactggagagtgctaagtactatcccttatctgtgagcagagccaataaagacctgcttttacttttggcctggggaatatgtgttcacatttttaaagttatatcctttagatattcacttattcactcgtttataagtacaagattgtcaacattcttttcaatggtgagaaactataacagtgccaaaccacatccttacctctctagtttataactttgcagatatacaccaatgagtgtaatggagcaagagagcgtagaataataagtataaatttactgcaacaaaaaataaatgtagatgttttatttctctacagcacatttgttagagataatattctcccatgccaataatataaggtaatctatatcaatagtggcaaattgcattaatttacacattagtccataaggtatatgataagtgctcttccataaattgggctctaaattatttttccagcaatgtgaatttcattgacttatcacttttctcatttggtgacaataatataaatttgcggaggttagagccatggttagcacagagaaattcgtttgtttttgtgttttgtgttttttttttttccttttttccatttagaggcagtaacaactcaaatacaaaatgatcacctcatttcattaacactatgctttgaccagcttgtaagaaaagtgaaattagctgagtttccctatttgttgagttttcccgtcattgaagttgatttaggtcatggaagcttattaggaaaaatattgaatatatattatatcttaggctcttatgctgtgcaaggtgctagaaatataatggtgtttctagtccttgttcttcaagaagcttgtcatacagtgtgaaaattgctctgacagggtgctgcaagagaacacagagtaacctacccaaactggttatgaggcctgtgataaattctgaaggacaattaggttataagcaggtgaaaactagaaataaaagcattataggccaagataatggcatgtacaaagaacttatgggagaagaggacatggcccacttctgtaatctacagtagttaatatggcaagcaggagctagatcacgaagaactttgatgccagtataggaagtttgaacttcatcctaaaaactagggaagccattaaagactattaagtatagatattatatggccacaattatgtttcagaaagatgattctgggtagcacagagatcagttagaaaaggcttagtactaagaccaggtaagaagcttttaatgatcagacgacagacaaatgacaaacacttcaactctgtcaggatggcagtttgaagaaccagttgaatgtaggaagtgaaaatgtgtaagtatattcaaagatgatgccaagtttacttgacaggaaaagaggagacagcagtgctgttttagtggaatatataggaagaacaagttgaagaaggaatccattttagtattgaacgtggtggcctaacatgacccaaacctgtgtttagtattggatatgctgacttacagatgcatgaggaacacttaggtagagatatccagtaggcattgaatttgtgtatctagaccaaaggagagagactgctttagctataaattggacaatcagctctatgaaaatgatagtgttttagaaggatgagattacttaaggctaaggtgaccccgtgatttatcatctaaacaagaactcttgaaaatagaagggactgtcattaataattatactaggatagcaggctaatccaggactggccaaagcaaatcaggagacactgttgcctcttccaaggagagcatataaaattgagaagaaggctaaagacaacactctaaagaacaatgtaggagaacttcaaaagaggaatatgatcacagcaatagaaaagaattaaaagtagtcgtgttataaggaaagggaattttttaaggagaaagtggtcagcagtcatattacaaagaggtcaataaaataaagactgataagttgtacaacattattggcaaccttggaaacaagttaaataaagaggcgaagacaagccagcaagagggttgagaagtaaatgggagataaggaagttatgataatatagatatcattaataaagttatttataaaatagaggagaaggggagataattagagggaaagcaatgaggtacccttgttttttgagagactttatattccaatgcttatgcaagagttgagataaaatggaagaaagaataattgcttggtttaggtcccagagaaagcagaagagcatgggatttagaacatagacgctaaggttagctttgaataagaagagagacatctttctttccatgtgttgcaagagacagaaaagtacctatgtggattcaaagaagttagtagaacaggaagttggagattttcccacccagtagtttctgtttttgagatgaaataggtattctgctgatattaagggagcagtagtgaaataggaagcctaaagaatggtgaagatttttttttttttttttttttttttgttaatgagacagggtcttgctctgtcacccaagttggagtacattagggtgtgatctcagctcactgcaacctccgcctcctgggctcaagggattctcccgcctcagactcccaagtagctgggactacaggtgtgcgcctccgagcccagctaattttttgtatttttgtagcaacagggttttgccatgttatccaggctggtctcgaactttcgggcttaagcgattcacctgccttggcctcccaaagtgttgggattacaggcgtgagccactgggcccagcccaatgaagattttaaatagttattgagataaatgagagaataaccacatgtgtgatatgcagaattatttctgagtactgtcaaaggatcaattgatattgggcactgtggatttgtagcacaccagcctctaaaattgggaaattctcttcagcacatgtgaacagctctgagaaagtttagcaagagtggaatgaatagaattgagtaacaaagacattaaaggttcgtgataaagcatgtagggcctggatggaagggctagaagacagtagggagctggtaaactgggagaaaacaagagttaaaaggaatagaaatctctgtgcaagacaagaagagataagaatgaatttccaggagaagcaagaagtagtggttagacagtaacccgagtttaagatactaaaagtggggccgggtgcagtggctcagtcctgtaatcccagcattttgggagactgaggcagaaggtcacttgaatccaggattttgagaccattctgggcaacataatgagaccttgtctctaaaaaataaaaattagccagtcatggtgtcacacgcatgtagtcctagctacgcaagaggctgaattcggaagatggcttgagcccgggaggttgaggctgcggtgagccaagatcatgccactgcactccagcctgggcaacagagtgagtgagagcctgtctctaaacaacaaacaaaaaaagatagcaaaagtgggagcagtttcaagtaatgacaggatctaataagttgactgaggttgaattaatgcaagtgtctttgaattgaggagccaaggaatgataaaactaggacaaattatccatgtgggcattgtcacacaggacccaggatagtggcaagattggagacaaacactaatccaaatgccaaatgaatgtgagatagcaaccatgaggtcactctcatttactgaattttttttccaaaataataaattcattacaattttttttgttttttagtacaaagtggttgtccccaaaattggaaacatattagatctttgtacagcattgtctgctttgtcaggaatacctgcagataaggtaagatgtttctggggttgaagtatataagttggtatttagtttctcagtgctgtaaaaccagcttaatagaaattcgtttccttttagatgatagttactgatatatacaatcatagatttcacagaatattcgctatggatgaaaaccttagtagtattatggaacgggatgatatttatgtgtaagtataaaactcattgtgcaaaatattacttgaaaaaaaattaatagaagtaacataaaattttgagagtttatggtcagttttgtccttgtaggtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtggtaagtgccagacaattctacattgacaaaataaatatgggaataaaatataaaatagctaataaaaataaacacataaggtactattggaatataattattcaagtctgtattatctcaattttgttcatagtcagattatagtcctaatccactttcttattcatgtaaaacatattatggaggtaatttcaaacccaggaagcacgaagtctgtagcagttttaaaccaaaagtttacagttagaaggacataggaatttatgttataataattatgtgttacatgttcattctgtgaaatcataacaaatgtcaaatgccatatgtttgcactgtgaaataacaaatgtcaaatgcttcatttctttatatacattaccagttcatgattaatagtattgtaaggcagcctattttttgccttcctgaataaatcccttgatttgaattatgaagttatcaagaatgtcatttgatcccttttatccttgaaagctggtatatttagtattctttcttgcatatctaattattatagtttcataacccatatataaagatcacattatacaaatataagtgtttttagcaacaatatataccatctaaatagggtaagttgagaaattatttgcaacaaacatttaacatttaacctaaaaggtaacatattaattatttttataaagatgagcaaaacaaattactagtcagttatacttatggtactaaaagtttgaatttatctttgaatctactaagtgaccactgttactgcattaaaaagttttgttttactgatagaaggaaaactttttaaaagtttttatctttgtagtactgaacttgtttgatttttgattttacttaagccgatatgtcaaaatatctactgaaactgaagaaactgaaggatccctacactgctgtaaggaccaaaatattaatgggaatggcccaaatggcatacatgaagaaggctcaccaagtaagacttttctgttaaattgtacaaatgtttcacttagataattgcctcagagaaaaagttaagaaaatgggaattaaagaactaaaaaatacctggaaacctaggattaataatattaataatttaaaaatatagcattgggtttatttaaagctctctaatatctaaaattaggtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatggtaagtatttgtgaaaaatggcttgaacattaaacaagccgagcatgttattttttttttaggtgaaaaccatgaaattcagctctgtcaagaaatataccatttacttttctatctcaaattttacatgaaaggacttaatatctaagtagactaaaatgtgtgtttgtgtttcataaatggagattgaactcatgcttcagttttctatctttttttaaactcttaaattatttcaatggcttggaaactgctgtttgccctaatcaccagtacaagtagaaaagattgctgtttgtttattctggtgtatatcctaacattaaaatatactttaatactaagacatattaaattttaaagaaaaaatatgttttccaccttagaaagatcttttcttgctttggattgggatcctgatttgaaaaaaagatattttgatgaaaatgctgctgaggtaagtcatcactcactcacttatttacctttccttgatttactttatgtgattaccagagataatcatactgttgtgttacactctttgcttccaccaaatatgtttattttgccagtaaaaaattggtcatgaactagaaaaaaaagtctttgcaaaaataccttttttttttaaaggttcagagttcattttgaacgtgttttggtcatccatatagaagtgtacaggaattatttagaagtatataaatctcaactgaaataagctttatgattcttttgagaaagtttaggagttttcattattattcatagtaagatggtatcactaaaatgagttttgtttcatttgttctcttaactcaagaaatacttctctttaggactttgaaaaacatgaaagtgtggagtataaacctcctaaaaaaccctttgtgaaattaaaagattgcattgaactttttacaacaaaagaaaagctaggtgctgaagatccctggtaagagacaaaattaaataattgtttttgttttctttaaggatttattctgagatatgtgccacatcaagttgaaaaagtaattactaaattctctttgatgttttaaatagtaaaggattctttatataagttgtagcctattaagagggatgggaatgtcttaaaaaatacgattacagtgttgccttaattttattactgtgtttttcataatagccattatactattaattcattttagttaccttttttccaagaaattttagctatgtaatcattttgagagaagctttttaggaaaaatgtagtgatatattttgtggtgttattccattagagcccagatttgagattttctaatacctgtcttccagcacagatttgtgacctatgtcttttttgcatactaaaagagaaataatctagccctcattatgtctttaagtatttatttgtatattaatttgtaatggtttaacctatttggaaaatgtcttgaaaataaaaataataagagttgctttcaacctggtacatattaggcatactataattgcccactgaataaatgtagaactttccaaacatttttgtttattattttcattaatgggggttgtttgtacctctatcaagtgttaaatacttctgtttattcttaggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaagtaagctttaattgtactttataagcattgggcaactcttctttcaaacttatttgatgctttttgttattatcctttagtaaacatcaggtgccattggacccaatttcagctttcaagtttgtttttgagtagttctaacagtttataaggatcagtgtttcaaaatttttattttttcttagagattttccaaagatcaaagagaaaatatactttaaaaaaataaaaacaataaaaatccttctgtgttatattacctatgggttaattggtctcatttataaatctaagatactttatggtacttagtgattttgtttatcctaggaattacttcatcattactcatcacttactcctaaatatgttggggttttttggtgtttcttttgtttgttttttgagacagggtctcactctgttgcccaggctggagtgcaatggtgcaatctcggctcactgcaacctccacctcctggattcaggtgattctcctgcctcagccttccaagtaactgggattatagccacccgccatcatgcccggctaatttttagtacagacgaggtttcaccatattgaccaggctggtctcgaactcctgacctcaagtgatccacccgccttggcctcccaaagtgctgggattacaggcatgagccactgtgcccagccctaaatatgctgttttcaaaaagactaaaataaaacaacaatggaattgcttagaaggataacacagtagtgaaataaatcatccctattgcattatccttcagttttcctattgccattatatgacatcatatttgtaaaaagatatatctatggccataccaccttgaacgtaccctgatcttgtctgtaaaaagatacaaagaagtctgtatacatcttcacactttatctctctttttttcttcccctgcttttaacagttgagaattcagaatgacaaaaagggaacattgtattccccgtcacttagttattcagcagaaggacttcatcacacaatattttgtacaagtacttggtactatcccattttgcaaaaagaactttcagcggtattatttcatatcctgtgatatttgtacaccaaaatgtacttgatacagttagtaagtagacaattgctaaaggcaggtgtatctataaaggtaactagaaggaaatagattacataaaacaaaatattcactggattactcattctaattggtggctataaatttaaaatttaaaattatttgtaattattgagtgaaaaaaagatcattttctctttaacaaaatagtgagccataagttttcaagaatatagcatttggcaatgtaagtataagaaaaagaatcagggctgggcacagtggctcacgcctgtaatcccagcactttgggaggccgaggtgggtggatcacaaggtcaggagagcaagactatcctagccaacgtggtgaaaccccatctctaccaaaattcaaaaacattagccgggcatggttgtgcgcgcctgtagtcccagctactcgggaggctaaggcaggggaatcgcttgaacccaggaggcggagatttcagtgagctgagatcgcgccactgcactccaggctgcctggcgacagagcgagactccctctcaaaaaaaaaaaaaaagaatcagaagtaatgacaaactagaatctatcagagatgtatttaaaatttagaatcattattgctttttaatgatgcaaatacaagaagaacaaccagaaataataataagctatttacaagaagtcgttttccaggttcttgaatgatagattttgattagtcagttacattcaaaggatgttgcccatttcgggtatataggtcatcaaagacagcaaatgtagaataaaaattaaggtttgatatattaatattttttaaaacttctaaggaagttttcactattcctgtatttttcttcatataaatcacttcctcttttttaatctctgaccctgcccataaattactttctaaaattgactgtaaaataaagatctactggacccagatggtcaatagtgatgactgtttttcctggtatactgagagttaaatgtgttagcatgaaaacgtttatctgaatgacaacattccacatttttattttattttatttttttatttttgtgggtacatagtaggtgtatatatttgtggggtacatgagatgttttgatggagtgtgaaatagtcacattatggagaatggggtatccatcctctcaagcgtttatcgtttgtgttataatccagtcacactcttagttatttttaaatgtataattaagttattattgactatagtcaccctgttgtgtgatcaaatagtatgttttattcattcgtttttttttttaacccgttaaccatccccaccttacatctcccctaccttcccaccacacttgtcatcctctagtaatcatccttctactctgtctgtctatgagctcaatttttttttatttttagatcccacaaatgagaacatgggatgtttgtctttctgtgcctggcttatttgatttaacataatctccagttccatccatgttgttggaaatggcaggatctcattcctttttatagctgaatagtacttcattgtgtatatgtaccagattttctttagccatttatctgttgatagacacttagttccatcaacattgcaacacatagtttcgtcaaatcaacaagatttggttgtttccaaatgttagctgttgtgaccattgctgcgacaaacatggggagtgcagatatctcttcagtatactcaatgaagcattttaaaattttcaacccataaacaaatgtttgccaaaacattaatatctcagaggtacatgtatgatttgttttgtaagttatttgactcatgataatttccttagtgagatatatatatatatagatagatatatatagatggatagatatagatatatatatgtatgtcaaacaacaatggcagaagggaatagaattcattgcatttagggacaacataaaaattaacttggtttcttttttaaacagtgacttggatatgtcggaattcttaattaatccaaatgcaggtccttgccgctataatctgattgctgtttccaaccactatggagggatgggaggaggacactgtaagttgacagtttgcctttttacccaaatcatggtgtttgaagaactccagacttttttctttaagatatttattacttcttaaggataaaatatcagatgtgtcttgcatatagtagttcagtattgattaatgaatgagtcagcttttgaaccttttttttttcacatagggtatagagaattgagttcatcatactcctcagttcaaggcctagtagggaatgttgtcccatttagagtgcatttccctccacgttctccttcccctttgctttctaacatgtttgatgcatatactcttgtaaatcattaatatttattcatttatataattggtactgtgctgtagatatcactaggtctcgacacttatgaagacttatctgtgttgctttgtgtccatttagtcagttgtttctcactgcttatgatttacatctgccatattttatctctccacttacctcatgatagacatctaaattccctttcacttcctaccactgtaagactgataaaccattgtttatggtatcgtatgtaagaatttatttgggctgcgtgcccaaaagtgaaattgctgagtttaagtgagtaagtgttgccagattgccccccaccccccaggatggctctaacactcgacactctgcaagcagttgatttttctgttgaacagtatttacattccttggatatatcctacttatcattatatatttttagacacacagttggattcagtcagatttatttagggttgttacaatttcattcataagtgaaatggttttgtaagttttttatattttcattatcttagtttggaataaagattagagtcataaaacaagctgagatgctttatcctttttctggtttttggaacagctagtacaatataggaattaactgttcatcaaagtctagtagaattaacctgtaaagccatctaggctttgcagccataattgtttttatttatgtcatgcatattggtctattcagttttctttttccttttctgtatattttgatgttctgtttctaaaaatgtatccatttcatttaggtttttcaatttatttaagaattgttgtttataatgcttatattacactatttttgtccttttttcattctttttctcttttttttttaaatcaaccttcctggccaggcacagtggctcacgcctgtgatcccaacactttgggaagtggaggcgggtgaatcatgaggccatgagatcaagaccatcctggccaacatggtgaaaccctgtctgtactaaaaatacaaaaattagttgggtgtggtggcacgtgcctgtaatcccagccactcgggaggctgaggtaggagaatcacttgaaccagggagccggaggttgcagagagcccagatcacaccactgcactccagcctggcaacagagcaagactctgtctcaaaaaaaaaaaaaagtatcagtcttcccagatttctatcttgttagtcttttcaaagaattacttttcatcttattaaatttttatttttgttattgtatgtatttatactttatattattattatattttattttatctatacgttttttttttgagactggctctctctctgtcaccaggctggagtgcagtcgcatgatattggctcactgcaacctccacctcctgggttcaagcgatcctaccacctttgcctcccgagtagctggactacaggcacatgccaccacacccagctaatttttttgtatttttagtagcagtggggtttcaccatggtgcccaggctggtcttgaactcctgggctcaagcgatcctcctacctcagcctcctgagtatcagggactacaggtgcatgccacgacacctggcttgtatgtatttattctgtctaattgatttcttcccttcccttcattgtatggttcctcttgttactttgggtttctatgttactcttcttacaacttcttgaattgaatgcttagctttgcttttcattgtttctcctatattgaaggctgtaattaaaaggctataaatttctgctaagtactgctttagctgtacttcagattttcattatctttcaattgtatgtatgttttaatttcctttatgatttcctaattagcacaatgtcatttaatcatatgcttagttttcaaatgtagagagttttgtcacttcattcttacctttattacatagcagttgagagcattgtctatattaatctttaggagtccgaaagttgtaacatgtcttaatacatggtcagttccttaaacgtgtgtatgcttggaaaaaaatatacattccccatttagatacagagttctttatatctctgataatttaagcttatcaagtgtattcaaaccattactatccctggttattttttgtgttcattttattcctgagaggaatttgtcaggactcctactaaagtgttgattgacctgcttctcccagcagttttattagttgttattaatattttgcataattatacttatgttcataatgggtagctcttctttctctgttccttttaacaccaggatttgacattctttgcccctttttttttaggtattacaagtgttactctagctttctttttggtatcatttaatttacaaactctgtgcctttttgttgaatgtgtctcttatagatcacacagatctaagtgcagcatctgctctgcactgatcttgggttgagatcaacaaactcacagcacgcaaaagcattcacccagcaccaggtttacttagatttaagaaaggatacaggtcaagaaacaatacagcatgcacagcaacagcttagcagaggtcctgtgtagctggaaggagagaaaatagggaaaagtgtgctcaaaggaagctgttcatcccatggctatttccttccactcctcaccaaggctgatttttaaccagagttcatggggtacagtcatattagttgtcaaatattttgttagcccaacaggacttttaaacagcaataagactctgattcaggtagcctgagtattgctgatttctgtgacaaaaattgaagcaagaaatttaaacgctttcttctagattgttttctcatttctgcctccatccattctgtcgcattcttcagccatgttgcatgcacacaaatattcttgagttcatatattgagaacagggttctcaatttttttttgttagttcctttgactctaacttccatctctttctacggtttctctccatggttgatatttgaggagagggaaccaacaacagatagaatatgaaacatttcttccacatggtagttactcagtaaaattgttaaccaaacaacttagagtttaaaccattattttattgtgattggttggttggttggctggtcggttgattggcttgtcttttgaattatcttctgaccgccagtggagtttcaccaaagataatgcttaccttactttcaaagtattgccattccctctgaacatcatccaaacaggtaacttaatagaaagagaatattgccctttgatttcagccttattaaggataatacctcaatttcttatttatatacaaatgggaagaataattactttaggatgggaagaattatttagaagccgtaccctacaaagtgtcactttttagaaacaatgaccacatataattattttggaaacattgtgcaactttatttcttcagttattgagtagtttatacaaggcatgggatggggaaaggggcatttttttaacttaaagataaagcagatctttaaaaattatgtggattaatgaatcactttttgcctttttcttgctgtgtacagtcatccctttgtatcagtggataccacagatgttcaaattccttatgtaaaatattgtagtatttgcatataacctaaccacatcctctcatatacttgtatgtgtagattatttataatacctaatacaatgcctgcacgtcacttcattcacataaattgaacatagtactcagcacgtggcaaattcaagttttactcttcaggactttgtggaatttttttttttcctcaaatatgtttgatctgtggttggttgggttcagggacgcagaacccatgtatgcacaggaccgactacacttttgttaaagactaaaagagattctggtgttaaaaaaaaaaaaaaacactatagcataatgagtagaggtatcagaaaagaaatcgtcatagaaaatttaataataagttgaaatttcaaactatgaagtcagaaacagatctaggtttaaatcctaactgctagctaacagtatagtaccttgagtaaattatccttcttttgatgccttaatttcccatctctcaggtggggagaataataatgataataccttctttatgagacaatacatgtaaagtgcataacactatgcctggtacacagtaagcactacatgaatgttaattaccatttattatcattagtgttattatgtgaatttaaaaataatctgttttttcctgagatgaaaaaagaatgtttcaacttacatgaaaattatttttggcatctaattgtagaaattagaaatcatttgaatcaattgaatatgtaataaataagcctcatagatgattatcagtgttaatagatattccttatatagatgattatagagttttgaggagtccccagaaaaccaagatcattttcgtcacagtgattatatttttttcattagatactgcttttgcaaaaaataaagatgatggaaaatggtactattttgatgacagtagtgtctccactgcatctgaagaccaaattgtggtaagtttgtcttatatttcctgagaactatgggattcactgtcttaaggagtgaatataaattaataaaaggggctcatggaacactgtagtctatattctagcagcttgagtagctaaaagacactaactcttatttaaagaaatgtcaaattgtcccctaaatggaaatttgtcttctaaatttgcccactaacaaaagcataaattgcaaggtgaaaaaatttttggtagttttcaacatggagtttctaataaaaataattaagttttgctttggaaagtagattcagctcttaactttctagacattgagtacttaaagccagaatgtttaaacaagagaaaaaaaatccttgaagtaccttaccgtacctgtgatctttaaagtcatatcctgccttatgaaaattaactaaactcaaaatgacataattagataaaacaaattacagatttataaaagattaatacttgtgtacttactactttgatattttctgaatagtaaaaaaaatgaggaagttccgtctgttcacacttacatcagtttatcatccaccgctgactctcagtatgggtttgtgtgtgtgtgtgtatatgtatatatacacacagatgcatacatatatatgtatatatacatatatatatatatatactgttatttctctccctatatctatgacaaaaagagacttgaatactataaatttttaaaattgtgttagttttaattaaccacattttttgtttatatttaaactcctaattttttttctgcaaaagaaaatcaattctgttctcctcaaattgcccacctcctccatcagtctttttaacaacactgccctaatcttggcttcaaataaacagttatcttgtttatatatagtatacaaatttgaggttgccatgcattttaacaatgatgattcttcatttagtcaacaaattgaatatgatatatatagagagagagagatacacaaaagactccattctaaacagagttaaaaagatagctgtcactcagtccagagtttaaaagatagctatctctgatttataaaccaaagaagataagtaaattaacaattacagcatgataagtactattaaataccttactatggccacttagaaagggaacttctgtctcaactcagatttggggtttgaggggacaataaccagcacagggaagttcatgtggtaaagatgatgtctgacctgagtctagtaaaaataagagtaaattaaacaaaaggtgttctaagcaaagaaaacggtatctacaaaaacaaggaggcatgacaaagcgtgacattttaagggaacagcacataattggatgtgactcaaaggaaaagctcttaaagggacatggggaagaaattagtctggagataaatttagcgcttagatcaagaaaagtggcattctagttgtttagacattttcttacagactatgagtagccattagattgttaaacaagagaataacattgttcagtttgtatcttaacatttctctgagaacatcatagaagatagattggagacactgagtaaagaaacagaaaagccatacaggaggctgtcacataatttaagcaattaaaatagtagttagaacaatacaaacaaggggagaatggatttatgagatatttactggacagaattaatataacttgataaaagatataataaggataatagatgtagagatccagagaaggagaagtttaagatgacttttacttcaccattcaccaagattgggaatataggaagaatagttgctgttgaagtttgagatgcctgtatgatagctgtgtggaaatttccattaggttgttggactcataagacaggagttcaggggtgagaactgatttaggttatacatttgagttgtcagcctcaggcagcagttgaagccataggtttaaatgagtcacctagtgagaggattcaggttgagacaatggtgggctgaggacagaacatagtatgtttaaaggtcaggatttaataagtccacagaagagcctgagaagaaaccaaagagatagtaggagatctgagtagtgttgtcacagaagcaaaaaattgtttgttgataggaaaagaaatagtgaagcattaaatgctactgagagattgaccaaaagaactggaaaggtcacccatttcagttgtttattaggttattgaccctgctgaaagccattttgctagaatggtttggggaaaagctagattactttgagttgagaagtgtgcatgagagtgaatgatgagtattgacaactctgtttatcaccctgactatgaggaagaggaagagaggtatatggcagctagaaggggaagtagaatggagagggacttatgataggaaaaaccttaggtattttttaatgccaaagagacaagtccagtggataaggactcattgaagatacacagtgatgattgatggaacagcatccttaagatggtaggaaaagttggactctacagcaaacatgggatgaagtgactagtattagaagggaggaatttaccttttccttaagagatggtaggaaagaaagcatagaattctatttttacgttagaattgtgatacagtttgtgtatcacagttagaactgtgatacagttgcatttatttctttgtccaaataatttagaagcacataaaaatttgtaattctaataacgattctttattagaaatcatcttatatttaatgaattttagtaacttccatttgaccatgcatggtttttctatttgatttatgccctcttaccaaaattggtgaccagctaaaaattcataatgtatttaacgtgatctttgagaatcataactgttttaacatcctttgttttgacagtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggccttatttagtcttttatttcttactcttaatcttttaataaaaatcccctactttatggttagatgactatatgctagactttttagttataaatagttaatactagaaaggaaattatgtcagagcaaaatgaatcctactattaaggacgttttaaagttgatttttgtccactttaatatttattcattaaacatatgtttgtgtaccaatcactgttgtagagtctggagatacagcagtaaacaaatatccttaccttcacagagcttacattctttctgccatctaccaactaatgaactatatttccatttttctgaagatttaaagaaaagtcaaagctaaatcttttaaacctatattgtggtctccatcctaattcttcagagaccactttctttttaatgcctgtcattaacttctgttcccactaaaagaagtgatgttaataatgccattgaaactgccaaactcaaatgtcatttttcagctgcaagaagtatactttaaaaatagtgcaaaaggataatacatattctaattaaaagtaggcattcagactgggcacggtggttcatgcctgtaatcccagcactttgggagactcaggcgggaggatcacttgagcccaggagtttgagaccagcctgagtaacatagtgagaacctcatctgtacaaatatatgtatttttttttaattagctgggtgtgcacacacctgtgttcccagctactggggaggctgaggtgagagaattgcttgagcccaggcagtcaaggccgcagttagccgaaatcacacccctgcactccagcctgtgcaacatagcaagactctgtctcaaaaaaaaaaaagatattcataggtaatacagggtaatgggaatatatctagactagaatttctacttctagctttgccacttagcaatcatatgactttgaacttaatctttgatagtgtttctttacctgtagaataatgatgataatagccagcatttattgagcacttactatggaccaggcactatattaaagtgtttatatgcattctctcatttaatcccacaacagctatgaggtagggatagttgtcatccccatttttcatatgaagaaaccaagatacaaagcatttaagtaatattcccaagctcacacaattgctatggggtagagccaatattctatcctcagatatatactacctctcactgtgttatagtgtctgcctcataggattgttgagagctcaaatgagatcatgtattttatgggaagagctttgtaaactttattacacactcactgatttcttcagtctaaatagaaagacatcttgaagtctaataactttgcttctaaaagtatatttagctcagtattcgagcattgaataagaaagtacccactggaatattgactaacccattcccttttaaaaattaatttcatttaatttatatacctttattacaattttaattaaatggtaaatacaatgtgacatttttttcttaccttttcatctaacttgtgtccccttctttccatttccccaaatgcaaccctgaatttcaggactttgtaaactctactctagttttgctttctgtttgtttgtttgtttgtttagagacaaggtctccctctgtcgcccaggctggagtgcagtgacataatcatagttcactgtaaccttgaactcctgggttaaagtgatcctcctgcctcagccttataatttagttttaattaacctccttgaaaaagttgcagcctggtgctttatttaaatatcttgctttctcataatctgtgttattttagtagtcctgtatttatccttgctttcctgacaactggatataaaactacacaaaacattgatttgggcacaaagaaaatcagtaagtaccaaaatagatacaacataaaggtggtggggttttttatgaactaatttgattgaagtgagtttatcttataaaataagccgggagactgaaatggagtctccttcagtggtacaccaaagggagtgtagggtgtagtaggagctctctgcctccgagaggaggaatatattagactgataacgtttaagtctgatgtatggtgacaagaaaaaggccaattttttgttttgttatttttaagttacctacagataatgcatttcattattgcctacttccaactctccctatgtagtatgtttctgatcttctgtgcttgtgcagtgtagatgagctcaccgctttaatttttaagatagaaatgtggaaaactcttgaatcatagactaggggaaggaaccagaggtcctctaaaatatcagaggagtgagaaggaaaggaagagctcctttctagggccatagaataagagtagaagtttttgctcattttttttgtttgtttttactttacaaaaaaataaaaaattttttgctctttgaataacttaacatgaggaatttggaaacaacctctcttgaaaatatattggtattcattcccaaataattcttctaagtaccacttgaccagaggatagggaaaggaggaaaaggtgagtgtatttatatccttgctagtttttgttatatattcagttgcagatctatattatatatcattttattatcagattttctagtgagaaatatatatgatggttttttaataatcattttaggtttggaggccatttcaattcaatatgtatgtgttttacgtgtttaattcgtatttactatatattaaaagaatttccaaatagctcagataagaaaactttggtttaaaattgagttattttataagctacatagaatacatcaaaattttataagctgcatagaataggctttaaaatatcagaattaggaaaataaaatatagatggtaaaaattcaaatatttatcaagacttttttcttcactaatgatggggtaaagaatttttaaatggataatataaaacagacagttcaaaaattatttttggaaaatatatgcatcgggaaacataccccacacggtgccatggtttaattattccccagctctacttttgggagcctggaacttgtcagggttgtgaaatagatctcagactattaaggacattcagaaactggctaagccattcaaggaaaatcaggaatttacgtaatatattggactacagtctcaaaggacagagagaaaatcagtcaaatgggttttgatatttttttttcctagaaatgtgtagcaaatgtgattttacaaagcagctaaaaatacaactatctctctggaattgaaaatgtgtaaaataagaccacacactttcaatatgcacaaaatatattttaaatgtttaagttgtattggtaatttactatgttctcctgtagaaaatcataattaaagttggtgctcgtgttgctaaagttttttttctcatgtcaggaacttgcagcttgttctatatagtttggtgaaacaaacaaaacagtttttatctgctgtgacatttaagtttgttgttagctggagttaaatctacatacataaaagtaaaacaataaatatggaaacatcccaa

SEQ ID NO: 2848 - DNA, 76354 bp, Homo sapiens
  source 1..76354: mol_type = genomic DNA
gggacgccattcccataatgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtaagagaaaggggttgagatgcccgcggttgcccgaggatagtggagaagtgggcgggagccgcgagctggttctttcgctagtgacaggtgcgggcaggtccggcggcggccgccggggcagcgggattttggccgcttctgaaatgttggggcaaaggttggactctagatgagggtcagggttcttggcttgccagggcatgctgaaaggtatccggggagcggcggcggcggcggttctgactcgtgcggttctcttcgtcctccttccttccgtagtgccgctcccacctcaggccttcccgaatgataggttatagtggtttggtttgagtcttatatacgccgttttgacaggtcccggtgccgcggcttatcacgatctcaccggctttacttctctgttcatttcctttcctagaattgtcggcgtccaagttcccttttattctgattcttggtcttccgggaggcaggctgcaggatgtttgcggtctgtactacacaggtggcatgtcagggctccacataagagaaagaaaccctagtttccagttccttgtcaaaggagggagaggagtagggaaccttgggcttatgagagaccacgtggtcttgtgctttagtggtggcttgatagaagccggcagcgtttctgttagacgtgcagcccttcccttctgtttgaaagataatgtaggcctgcaaaaagtagataagtccacttgaggcttaactaactgctaatattcaaacttgtaaaataccaaaggttatacatttaaaatactgaaggatgtatgtggacattttcacacttgtcgaccatatcaagtggcatctacaataacttaaatatgtgaatatgtaacataatttaaaattccttattttttgggaagcataatgtgcctcttcattataataaaacatattttcactttccactgttaccataacagtagtatataattcatagagtgtttcagtatggcatagtgaaaggaacagtaagatttagacctgagttatgtcacagtttcaccactcaacttgcagtatggctttgaggagagttaatttaaatcattgcacctcattatcttcatgctgtaaaatggacagtaattttattataaggattttatcttgattcgttttaatatcttaagaatttcatatttatgagatatcaaattttagttatcctcttatctctgctctttactcctgacaaaaggctgtgatattgggatcattttcagttaagctaataggtggcagacttaggaccttaatttaaccttgatctaagtcttagtctcttttttcttttttggtaggctatatactatgtttgtatgatagaaatccctaaggatgtaaatacatacttgtttcattatatcaaaaaaatagaatcttcaagtgacttaataatagttattgttggcctggcagggtggttcacgcctgtaacccagcactttgggaggccgaggagggaggatcacttgaactcaggagttccagaccagcctgggcaccatggtgaaaccccgtctctacaaaaatacaaaaaaattagctgggcatggtggcacgcctgtggtcccagctactcaggaggctgaggtgggaggattgcctgagcctaggaagcggaggttgcagtgagccgagatccggccactgcactctagcctgggcaacgtgagactccatctcaaaaaaagaaaaaaaaaagttattgtttttattataatgttagatgtttattactgtggggaaattggacatttcctaggacacccatgtttaccttggcttgtggtaatgacaaataagtccccgctggctattgtaagttaaagaacatttaaaaattcttaattcacccaacctagtaccaccttattttaaaaagtgaatttccttaaaatagaaatctgtaagtctataagttaaaatataagtgttattgtctctcattaatgtcacgtttttgtatatagagtaattggtagcattgacactacaggatgataggagcaatatgtgcattgtgggcgtttaactttatgaagtttggtattttcaaataagtatatttttgcttttttacaaaattaatgtaaattgttttatatatgtgcgtgtgtgtgtgcgtgtatagctgtataggtacagtgtctcactatattgcccatgctgatcttgaactcctggcttcaagtgatccacctcagcctcccaaaatgctagtattacaagtatgaaccatgactaaatacaagaggctcataaatttaagtcatttcagtgcttttattttaaataaaagtaaactgagggccacatatttagataaaagcagattgtgcaagtttatcctcacgttaattttctcttaaaggaaaaaaactgcaagagaaagatggtactgggagttgcagaaaccagtttggtttatttgtgagccagtttatttgcaaattagcaagtgaaacctgtccaaaaacaaagtagtagagagcaaaaatttgattcagaattttaaagagaataatttgataagtataaatttgatgatgaacttacaggtacagaactggtggtgatatgtaataatttagtttatgtttttggaactcactagaaagttgtttttccttttaatatctttttttaatctttgaatcaggttatttgaaatttgccctgtggaatattgtcgtggcatatgtatgtaactgtctaggaaagactgattgggctgttgagaaaaaatggtgggtttaccataagtttattcttgaaagtttaatacacatgtctgaagttatagtcatatgcatcacagtgaataaatttcatttactagcttttgagcactttgcagataatgactgtctcatggtaactcgggtaactaacttccatacctaggcaagtataaagatttatttcattctgtgtaagtactacagtttctctttatttgtaagcagtgaatgatttttatctaaaaactgattttctagagatgaaaataagttacacaagtgtgagatgaagagaaacatactttatgatgtatttagttctagactttatattgagaagtaaatcaaaattaatacgagagtaatacctttttaaaaagcaagaagaaggtagcactgatttgtataaggaataaagcagtctcaaaatgatatttgttgatctgtgtttcaatttcaacaagagatcagaaaaacacgaacaaaatttagagtttaggaactataggaaagagataaatgaactagaattgtatcgcttaggatgaattaaaaacaattttcagatacatggtggtttcttctgatgagacaaaaagataatttgcttaaggtacatatgagtattttaggaacatatttaaggaatggtagttaatgagttacaaagaaaattatgggttataaaatactctctttggaaaaaaagtttttgaaacagagtctcgctgtgtcgcccaggctagagtacagtgcgtggtctcggctcaccgcaaccacctccagggttcaagtgatcctcccacctcagcctccgcagtagctgggcctgcaggcacatgccaccacgcccagctaattttttatttttagtagagacagggtttccccatgttacccgggttggtctcgaactcctggcctcaagtgatctgcctaccttggcctcccagagggccgggattacaggtgtgaaccacctgcaaaatttctggcctggaaatttttaaagaaatgggcctattatgagtaagtaaaacataaccacaaatcatccaaagcactgcttcgtttccaccatttttattaaatgttattcatctgccaatcattttcagtaatttttatgtgtgattatgttaagtggtaatgtgtagttaacttttgcagtttagcaaaacattgcatgccatttttgtataaaccctaataactgtagtaggtaactttacagagtaagtaatttgtgtgtgaagtcatttaaaatctctgtgacattttcatttcaataattgccaaagaatctgatcagtgaagttttagacaagagacattgatttcagtttttagagctttctgtccattccgacttttacttagaaatctttgaggcttaattttatttgatcccttatgttcgtgcaactttgaaactaaaagaaaataaccttatactcacaaatcccttaataatgaaaaggaacactattactcaacatgaatttcaaaatatttagtgtatacttaaagaaatttttatattactattacttttaaaattagtttcagtagtgccagggtgtttacgaccagagtagggtatatactacatcatttataggaaatgaaactaaaaggaaaaacttcttcagtcttggtaaattggtgaaaacaaggacagagatagtgaccttaaggcatgtttcacatcttagatgcttaaaaatctaggaaagcaacttttcttaatttaagcctttttcgtaagtttttaaatgacttctgttagtgagtccagggttaatgtaccctaatagtccaggaaggtccagagctagtcaatgatttcgtttatctgttttgtgaaattaaggctttttttcctaaattataccattttcctgttagcacatataaggcattaaatgacctttttgcaaaatggttttgtgacagttaacaattttgcttctacgtaagtgtaacaagataaaatcagtttgtcaggccatgacctgtaatattacatttaaaaacactatgtgccaggtactgttataaatgcatattgacttatttactcatcaccatattaccacaattctgggaatcggtgttattcacatttgacaaaataggaatcataggctcaaaaaggttttcacatagtggtatagctgggatttgaacccaagtagtttaggtctttggtttgtgcccttaaagcactgtaccacattgcctctgattttatttaaaaaaattttttctagagacagagtctcgcttcatcacccaggctggagtgtagtggcatagtcatagctcactgtagcttcaaactccttggctcaagcaattttcctgcctcagcctctgaaatagctggaactacaggtgtgcgccaccacacccagctaatttttaaagtttttgtggagacgggatcttactgtgttgcctagactggtttgaaactcctgacctcaaatgatcctctgacttcagcctcgcaagtattaatagctgggattacaggtgtgaacccctatgcccagcctctgtctcttattttaaagattcattttttaaaaagtagattcactttaaaaagaaaagaacctatttttctttttaaaggaagtctattttatatttagtagcagaattctaccatttgcctcttgtgactgttcagtttagatatgatagaacatgtaggaaatcttaacaccttgcttctggatattaaaacatgcttaaagattgataggtgaataattgaatgtacagagcaaatgtcattttgatccacaagtacattcagacaaaaaaatttgaggtcatttactattgagcttttgaattttaattgtctatcaataatcataagctcttattagagatgatatggccccttcacatatagttttacagaaataacccatgaagcatatagtaagatcttgtaggctattttgtttcggtacttggtccatattttaaaagtatggtattggtttactataagccacaaatacatacggctttcttcttggacttaaatccatatgaaccactcagcacagaaaatgcaaatatgaatgcattattatgttcaccaactgattttttccctagagataactcttaaagaatttttgaagtgaaagaacatttaaattaagatagtggaagatacaatgataataaaacagtcaattttgctatcttagtcttgaatttatcttatgatgtgagtttagagtgattcttctttttttcactgaaaatcacttcattaataagtcatgattattgacaaaagtaaattgaaaccattgggcatattggtagggaaataaggggaagatagagaacaactgataaaggttgattatgtgcattacgagatttgatcctcaaaagaaggaccaaaatatatatatttatatgacttatagatgaggaatctgagagaaattaatttgcttgctcatagtttactaccagcggacatttattaaatgcttagtctgtcgcagccactattttaaatgctttacacttacatagcctttaaagtacatgctcttattacacttcattttatctttgatgatttcagagctggtttaaatacctggtttataaagatttaaagtactagatactatctaatactaagaatagatccttagtattaaaaatggttttatgctgtcactactcgaatgtaattcaaacaatatttcattaaaccatgggaatttctcttttttcttagtccttgtatagaatttttcaacaattactaaatactttttttcttccctgagtaatgtcagtctagcttgtttcttttaatttcctcacttaccactgtaattcacattctgtgtctcatattcattcctctgaagccacttcgccagactcgttctcccatttatcctttaaacaggggaatgtagatcctttagattttatcacccagtttacacaaaagtcactattcaagaaatctagcataagcctagtaagtagcctcagttttggatacagattaaaattatttgagggaagggtcaaaaatggctccttacaaagaaggaaataagttccaattataatataaaacagaaaacccctgtaggattaacctgcatttgattatgtctagactgcctttactacttccatcactaagattctacatggtttccttatagctctccaaaaagaaaagagtaatgatgcctttttttcctccaaggaatggagaactaagaatgctaactgtcccttccattctccctttagttttgagaagacccagatattagcgtggtaattccccaccataagagaaaatcatttagcagaagtaccagtagcaaggacttctttgtgaaggaagtcaaagatctcacaaagaagttcaagggtggctctgaggccagggtattctaagtttagagccagttaaatcaagacctgagaacatttagagacaaagttacttaactgaaaagagcatcaagttccttgttccaggtagaaaacacctggtaatctggattgatttctgttatttacccatatgtttttacagcttaacaaagtttaacaggttagtcaagagatttgcctttgataaaaagatgggaaatttatattcatacatttgaatggatttcaagctgaagaactttttaattctcaggagagatgtagctaagtatttatatgtaccacatagttgtggctatggtttacaataacttattactcatttactatgttaagagcattttaaaagttctctagatacaggttccatatataatgtaatatatttattccaaatatattacatatatgaaatacatggtagtattctcattttaccagtacagaaactgggatagttaaatgtatatggtcataacacttagtcagtggtagagcaggaggtctaacttaaagcttgcattttaaattctaagtgtactgcctgcctatgtgtgatagagccatacccagattatggaagcaactttttgaaagacaaatacttgaaagtattaaaatcaagaaatgacagctttgtaatacttgttaaacacattttcatttgttattaatatcaagagcctctagaattttgtgagtcttcttgttttagccttgtagtctcagcagtctcatttctaattaacatatctctgttttgatacagatagtgtctcccatttcctgcaaattatttgctttttcctgcttttggggcctttatgccccatttctgttgtttcagatacttcttaaaaattactgactttcatttcaaaacctagttcaaagtcagtctctaaaaccacctctaatctcatccaaatttgtggcccctccattctttgcttttaaaatatatatgtatatataaaacagctttattgtgatgctattcacataccttacaatttgcccacttaaagtggacagttcactgggttttagtatactcgaaagagttgtgcagccatgaccataatcaattttggaatccaaaaaggaacctcatacccattaatagtcacctcccatttctctcccaaactcctctgttctaggcagctactaatctattttctgtctttatatatttgcctattctggatattttatataaatggaatcgtatagtatgtgcgatttttgcatcttgcttcttttacttagcatacatgttttctaggttcatgcatgttatagcatatatcaatgtttatttttactgctgaatgatacagtcatgagtcacttaatgacaaggataacttctgagaaatgtatggttaggcaattttgtcgttgtgtgaacatcttaagggggtacttacacaaatctagatgggattgcctactacatacctaggatgtattgcctattgctcctaggcaaaaaaaacctgtacaacatgttactgtagtgcatactgtagtcaattctaatacaatggtaagtatatatatatgtgtgtgtgtataaatatatatatgtgtgtgtgtgtatatatatatatctaaacatagaaaaggtagagtaaaaatacaatattatgatcttttttgtttttagagacagggtctggctctgtcacccagactgaaatgcagtagcccaatattggctcacattgcccttgatctcctgggctcaagcaattccactgcctcatcctcccaattagctaggactacaggcaagcaccactgtgtctattttttatttttatttttttgtagaaatgaggatcttgctgtgttgcccaggctggtcttgaactcctggcctcaagcactcctcccaccttagtcttccaaagtgttgggattataggcatgagccactgtgtctagccagacataatgtgtctgttattgacctaaatgttgttatgtggtatgtgaccatattccattgtatagatataacacatttgatatatccatttatcaattgatagacatttgaatttccaatttttgcctattttgaataatcctgctatgaacatccattacaagttttcatttctcgtgtatatacctgtaagtggaattgctaggtccctgtttaactttttaaggaactgctagactgtttttctaagtggccgtaattttacattgccaccagcagtgtatgagggttccagttttttcacctcgtcagcacttatgttcttttttttaatatatagccatcttagtggatatgaagtagtatctcattgtagttttgatttgcattttcttgataggtaatgatgttgagtatcttttcacctgcttattggccatttgtatgtcttttggatgtctgtccagattctttgcccatttaaaaaatttggttattttgtctttttattattgcattgtaaaagttctctagatacaggttccttattaaatagttaatttacaaatttttctcccattctgtggattttctttttactttcttggtagtgtccactgaaacatggaagtttttattttattgaaattcaatttgcctgttttttcctttgtcacttttgcttttggtatcatgtctaagaaggcttggcttaactcaaggtcatgaggatttactcatatattttcttttccaagttttgtagttctggctcttacatttaagtctgtaattcaatcgagttaattttttgtgtatatggtcaggggaggagttcaatttcattcttttgcatgtggttatccagttgtcccaaaactatttgtcaaaaagatcattcttttccctgtgcaattatcttggtaccctgcttgaaaatcaattgactgtaaaagtgagggtttatttctagattctatatttgattgacatataccagtaccagattataactgtgtagacagttttaaaatctggaactgtgtcctccaacaacttttcaagtttgttttggccctcttctcttattagtttacactatgttgaaatgttgttttgtaaatattcttaaatatgtgtatttcattactccgtataaatgacacactcatctttttgcagcctgtcttcttaccttctctcattcgaaatctaccccatctctttatttcttagaggtatgtggtatagtagtatttgcagtgaatgttttgtgtcatttaacccatggatctctcttccactcctaatctcatgccccaaaagcacaaacaatgcgctgtcttaagaacatagataagtgtgctaattatcaaaaacacatttacagtacctggaaaatgtaagacaacaccctcagcagatgaaaatgacctggcatcctaaaaggaggctaaactcacattaatccttcaaatgaaaaaatcgtcacatcataccctttaaataatgctttaaaacattcaaaattatttatgaataattatttatgagtctttgtggaaatgcagttatgcaagaaaagtataaaaatattcatggaatgataaatgctaaatcagagtaagggtattccaagagaggggcccacaaggggctatattaatatttatgataattttctttaggtgcttgttttgatggtatgtatatagatgctcgttattattcgaagtttaatgtatgcctttatatgatacaaaatacttttaaaaagcgaagttgattgtaagagctttttattttgaggaagtcccaatttttcttagttttttctgtttattatttttatattgttaataccaaacctaattctcccggtgtagaaaagttacacagagctgagagaatttatgtagagtcaagcattattaattatcatttccttcttgcttcatatatgcttatcacgcttatatgtcacatatggttacaagatatctttagtatggagagacatacacatttaagatattaatggtcatgtatgtgtattctggatgaatagtttaaaaacaatcttacttggcctccttgagtttcttatttgtcttagtttagatctaaaaagagatcataaaaattatttattgctaggtgatggatttaatgtgtggagaagaaaataggttagaagtgcatggaatctaaaaattaagctataaagagatggtaaactattccattggtttatttgagtgaatttcatagttttatttgtttcagttttactgaaaccatgaaattctgagtcttagtttgtggtacttaaaaaaaaagtcagtgaaatatctgatttataataatttaaaatactagatgctgccagtatctccttagtgttgaaaattgttttatgctatcactactcaaatataatttaagcattttgttaaataagagaattagtcataagagtgaattagtatccagaattgtttatgccattctgcacaagatgattataaatatttttctgagattaagtgtgctacattggattaggctgagatttttgtgtatttttttacttataaaaggactgcctatgcctactctgtaaagaggcagataggatttcaaaaaataaacaaggttatatttattttaatattaggcaattaagcaggaacatttatctgaaaattgtcagcataaacatgtacaaatcaataacaacaaaaaaactgctttactacctctctggtttcctaaatcctgctgttggaatttccacatattccttttatactctgttgtatctggaactatttcttaatcatttgttggtccttgtatatctttcttaaatttgcatctagtgtaaaagcaccaaacaacttttgatattctctttctccctgccaactccaaaaccttttacattcatatagtagctttactgcatttgaacagtgtcttaaaattgactctgaagccccagtttctccagagccattgaaaattattctatccacaccataatacaaattatttatcataatgccttcagaatatttagcaccatacaatttagatcattttgaggtattcatgttaatataactttatgtaagtttttgacgtagtatttcacatgtatttgatcgttccagtaatcttgtgaggtagtcccagtggtcttcatgaaatgtaaatcaaatcatatctctttacagttaaaaatctttcagtggttttcagattacttgagatgaaatccttgtcattgcattaaaggcactatttagttcggtctcagtctaactctttagtctcatctaccatttctcccccaccttgtcataaactccaactttatttagtcattccttcaacactcaaaattcccaaagtccttctggccttagcatgtcatcctcattcagtttagatactttttcttaccacttttcttggagtaactcttattcagaggctaaaacattttttcagagagattttcatttattctatatagggccctcattatatgctttcatagctccctgtacgtttacttcacagcacttaacaatattttattatgtaccttgattgcttacttttcctctctcctccactggactcttgaacaaagggaccttggctgttttgccaaccactttattcatatgaagtattttttgaatgaatgaattcccatttctaagatggacagtcgaagggttttattgctgagtaacttttctaagacttcatagcaagtagtgtcaaaaatagaagtttggtgtggtgctttttctatagtaaatttagaatttatatctactcaagtctgatttcaggagataagaatatatataaacaaaaataatcatgaaaacaaattgagattggtatgacaaattcatccacagtttagtgtttgctacatttctaggaaacttcttcagagaatggtagtgtttttgtgtgtgtgtgatctttattgatgtgaaaacatgaatctcttataggcatgcgtgtgaacatttgggctcttattctacgaagtttctgatagtcaaagctctaaccctaaagatactcactttgaaaatactcattttctcaataagtaaagtggattgttagaaattgttggaatttatcttctaaataagccttccagttctatttatagcttggtgataatgttatcatatcctctgctatctcacttttaaaagtgaacttattgtttcataaagagggagtgtggtatatgattttactaggcatctgttacatttctaggtctttgttaaataaatggaatttaaagtttggtgtaatgaaaagaacactgaactttagagtctgaaaactagagtgcgggactttgtgtacccaccgagtagtgttacatgaccttgataagttatataacctctctgagttttggcttttccttctgttaaaaaggaggctgggcacagtggttcacacctgtaatcccaacactttgagaggccctggcaggaggatcacttgaggcgagcagttcaaaaccagcctggggaacataggatttcaaaaaataaacaaggttatatttattttaatattaggcaattaagcaggaacatttatctgaaaattgtcagcataaacatgtacaaatcagcaacaacaaaaaaaaaaaacggtgcatttactacctctctggtttcctcaaattagacctgtccctacaaaaaatttttaaaaattaaccgggtgtggtggtgctgtctgtcgtcccagctacttggaaggctgaggcaagagaatcacttgagctcaggtgtttgaggttacagtgagctatgatcacaacactgcattccagcctgtgcaagagtaagaccacctcaaacaaacaaacagataaataaatgaagataaataaaaggttgctctaccctgtctcaaaggaaggagggaagggagggaagaaaaaggttgctctaccatcaactaatataaaaacactttgtacgaaaaccttatataaacattaaacatttatattatgcagatactaagattttaaacagaagtgagatgatcacgtttgtggttttaaaatgtttggcagcagagtggaggacagcttggaagcaagcaaaacttaaagtagttggacaaatcaagcagctatcatagtaatctatgccactaaaaatagtgtggaaggggagctgcagaactaaagtacttttctgaggatgaagaggcgaggggcagactcttagaaatattctggaggtgcttggttaatggatgttatggagcggggaatataggttaatattctggtttgtggcttgggaaattaaattactgatgaagtcacttgttaaagtaatagtagagaatgggtaaatggagagagagaggattgactcaaggttgagatgtctggaaaatccaagttgacatggactaataggaattggaaatacgattcaagaacttgaggactagctctgagatgcagattttggaattattgatatgaattataggagaatataaacagtgaaagaagaaatcaaagagcagggctatgtaatacatttaagcaaaagagaaggttgtaaaaaaaattgggaggagtatcacccccccacccaaaaaaaaaaaagaattacagaggctaatttttagagggattaatagatatataaaattatgaatccgttggatttgttaaggtggtcattggtgatttgtgagggcccattagactaggaagacctgtaagtgaaagttgaggaaatggaaacttgagaagcttgactgtaaggacaagtcataaaatgagaatagatgagaaaatacgagagttgagaggtgatatgaggggagaggaggaaaagacttaatccctgttgaaatgctggtaggaaaaggtctccaaggaagcagaaggaaattagatccacagcataggagcaaaaattattggcctgggatttgaggaagattacttcctctactgatacgtaagggaatcaggtaagattcaggtgtgatgcagtagagttggacaggcttctgactgctttgtaaggtaggtagcaaggttgttcaacctaatgggttagagactaggtaagactgccaaaggtttgaaataattattgaggatatagaagggtatgctatggacatggtggaagattacaggtcatctttgaaggacttgagagattgaaaaccataggtcttcagtctctatatcattttctttagtaactatgaacccagataatattaacattatgataaaaataatttcagattgatgtatgtaagaatcgtgtgtaatgaccaggtatgaggcaccctcataaaattccttgtaatcctctgaaacaggaagattatagtgattaagccatagatcttttagattatacattggtacatttacttcataacttctttacaggaacacagtcaaatgtcttagtattcagaaatacttcacctttggtttcatttataaagcattgactcctttgtataagaaatttagcctgttcatcacaaaacaatttaattactactctgggctgctcaagatggtttgtacattagtatttagatgaattttagatggttgcaggtctgtagttagtataatatttggtaccaaaatttgatcagcttcaaatcagtaaatatgtcagttttggaattgtttgttttgcttatattatcttccaagatataaagggtaataatctgtcctttatgtgcttttccttttatatgagatatcactcatataaaatcatatatgagataacactcattatttttctggcttattcactggttgctctagttaccaaaaggaagtattttctcaggaatgaatacactaccgtatatcagaatcacattttgataaatttagaaatgattgcaaatgaattgtgcttttccaagtcttgaagaaaattcttcaagacttacgtaaatttttaattaaaatctaatgcaaattcacctgtttagaaaaagtacaactataaaaaataaatacaaaagatcatataaagttatgaattttttcagaaataaaaagtaatgaataaaaactgtgccttttatgcattttgctgtgtatattttgtcccaatttttaaatgtgtttgtaattagttttcttatttttatgcataaaatttccattgttgactgtcactgaacactatcacttttgctagcctcaatattattcttagtctatttgactgtacttcattctgtgtgcatatatgtgaagatgtatctatacataacttctgtgttaaacaaaagacgtttactcttgctgttaaaactttctggcagattttggataaccctccttgcaccacttgataataactcacaagctgcaactcttctgaattccacttccacaagcagacaatcttttttaagataaaatgtcatgtttattatggtatttatatatttcctaaccattcaacacatgtaaagctgtgctactgtttttattatcttctttaaaacatgtcactgacagtgcttcagcaagagaaggaaggggatggtattagggaagcatgcaaacctgtacagcatgttaccatactgaatagtgtaggcagttttaatataatgttaagtatttgtgtttctaaatatagaaaaagaacagtaaaaatggcatataaaagatttttttaaatggtacacttatttagaacacttaccatgaatggagtttgcagggctggacgttgctctgggtgagtcagtgagttagtagagagtgaatgtgaaggcctagggcagggttgtcccatcttttggcttccctgggccaaatcagaagaagaattattgtcttggaccacatgtaaaatacactaacgctaaaaatagatgataagcgaaaaaaaaaatcacaaaaaaatctcataatgttttaagaaagtttacgaatttgtattgggctgcattcaaaggtgtcctgggccacctgtgggcctcaggttggacaagcttggcctagtgcattaatgtacactgctgtaatctttataaacaccatacacttaggctacactaagttaatttaaaaatattttcttcaataataaaattaactttagcttactgtaacatttttacgttataaaccttaaaaatgttttaaatgtttttgactcgtttgttataacacttggtttaaaacaccaatacattatacagctgtacaaaaatattttcttcatatccttattctataagcttttttctatttctaaattttttctaattaaaaagtttttttgccgtaaactaagagacaaacacacattaacctaggcctgcacagtcagggtgatcagtatcactgtcttctgcctccatatcttgtcccattggaaggtcttcatgggcagtaatattcatggagctgtcatctcctgtgatatcagtgccttcatctggaatacttcctgaaggacctgcctgaggctgttctacagctaacttttttttatatataagtagaaggagcacactctaaaataacgattatagtaacaaagtatagtaaatacataaactcataacagttgtttattattgtcaagtattatatgctgtacataattatatgtgctatactgttgtaagattggcagcacagtaggtctgtttacaccagcatcaccgtaaacatgtgagtaatgagttatgctacaacatcacaatggctacatcattaagcaaaagggcttttttaggtacattatggtgtatgggaccaccatcatatatgtagtttgtcattggcaagaaagtcattatgcagtgcatgactgtatacagatggtcctcaacttaatgatggagttacagcctgctaaactcattagaaattgaaaatattgtaagtaaaaaatccatttaatatgcctaacgtaccatacaatataggttagactagcctaccttaaacatgcttagaacacttaaattaatctacagttgggcaaaaccagctaacagaaaatctgttttataataaagcattgactactgtactgaaaatgaaaaacagaatcatcgtatggatattagaaatatggtttctgctgaatgcttatcagtttcacaccattataaagtccaaaaatcttaagtcacaccgtaagttgaactgtctatatcaacttttttcattgtagtaagaatacttaacatgagcgctgccctcttaatttttttctgtacaatataatattgttaactataggcacaatattgtacaatagacttactcattttgcataactgaaactttatacccactgaatatcatcacctccttatttcttcctttccccagcccctggcagtcaccattttactctgtttctatgactatgatgttttagatacctcataagtggaatcatgcaggatttgtctttctgtgactcatttacttcatttagcatagtgaccttcaggttcatccatgttgctgcatatggcaggattttcttttttcaggctaaatagtactccatttttctttattctttcatccatcaaaagacattaaggttgtttccgcatcttggctattgtgaataatgctgcagtaaacatgatagtacatatatcttcaggactctgattttaatccttttggatatgtacccaaaagtaggattgctggatcatatggtcattctatttttaattttttgaggaaccttcataccattttccatagccagtgcaccatattatatagtctacaagagttccaatttctccacatcctcaccaacagttaccttttgtttttttcaataatagccatcctaacacgtgtgaggtgatatctcattgtggttttgatttgcctaattaagtgttgtaacaccttgaaattttcaaaaacaagcattagaaaagaaccgactgcatgtataataagatagagctgtaattgattttttcctttatgcatgatctgttgtgccagtaccttttatagaatagtccatctttgcctattagtttgtaatgatgcttttgacatatgtcttcatatatatgtgagtctggctcttatttctttccactgttttcattggtctttttacttctctctatgccaatatcacattttcttaatcacagctttgacactttgtaaccttgggcaagttaatttctgtgtgtatatatactccatctgaaattaagataatagtacctacttcattgggtaaatgaaaatatatgaatgtgcttagaagtatgcacatggctcaagagtaaaactcaaatattagtgattttgttattaaacttaataaaggtaataattaaccttaatatgttaataattaataataaattaagcttaataaagaggcttagtaatgaggaaactgagatttccactttgtttttcttccagactttctggggaagtggggagagggttatggagggattccctgaagcagtgacatttaggcagatatgtgaaagattatagttgttaactatgtgtcttagccccttcaggctgctataacaaagtacctgtaagtggcttaaaaacagcaaatttatttgtcactgttctggaggctggtaagtccaagatgactaggtactggcaggttctgtgtctggtgaggaggacacagcatactttctggttcatagatggaaccttctagctatagtggaagggatgaggtgtctctctgggagcctcttttataaaggcataaattccattcgtgaggactctgcccttatgatctaatcacctcctaattccctatccttgggggttaggattttaacattaattctgggggaggagacacacgcattcagaccatagctctacatgttgaaaagaataagggaattttctaggtagaaggggttatgaggcagaaaatggtgtgtcaaggaaatgaaagaaggctcttgcagctggatctgggcacaaagaaaaatggtaccagctgagtctaaagaggtagctagggattagatcatgcaagaccttttagacaatgttaagcattttagacttcatcctacatagttataactatttgtattggttgatatcctaatgactttaagtccataaaagaaactcaaagtgaaaattgggcttatctggaccctaatagtatataaggattaagaataccattgagaatatatgaattcaggtctttgttcattgtttgtagtctttgtaatctgttgattccgttctagtattttatcagttcagattgaacattgggaattttggcagatttcatagatgtagaagtatagtttttacagtgcaacagatctatataaatgtattgaaataaaatcttttcatttatttgtctgtgtcatctaatcttacctttcttagtcttctttcttgtctacgtcttctaatctcatctttctaatatatacctaacaacactatacattgtttctggagtagattctcctatttttctttttctgtttgctttttgagacagaatcttgctctattgcccaggctggagtgcagtggcatgctctcagctcagtgcaacctccacctcctgggttcaagcaattcttgtgcctcagcctcctgagtagctggggttacaaaagtatgcgccaccacacttgactaatttttgtatttttagtggagacggggtttcaacatgtgggccaggctggtcttgaactcctggcctcaagtgatccagccatcttggcctcccacagtgctgggattacaggcgtgagccacagcacctggccagattctcctatttttctactttcctgatgtttcattaccataaaattgtgtagatagccctaagagaaatatggtgccctttttcaattgaagatagtattgaaagcaattaaatatcatcaaatgggaaagtctcctatcataatagtatcattgtacagaaagaagtcactacaagatctaggaaagatagttgatacagaaatatatgacaatagacagttgacatagaaatgtatgacattatagaaggtttaccaagtatatacttttagtaccgcagtccctttttatctgcagagtataagttccaagaccctcagtggatgcctgaacctgcaaatagtagcaaaccttatatacactgctttttcctatgcttacatataataaagtttaatttataggccaggcacactggctcatgtctgtaatcccagcactttcggaggccaaagtgggagggcaccttgagcccaggagcttgaaaccatcctgggcaacgtagtgatatctcatctctacaaaaaataaacaaaattagctgagtttgtggcacatgcctgtagtcccagctactcaggagactgaggtgggaagatcacttgagccagggaggttgagactacagtgagctgtgatcatgccccactgcactccagcctgggtgacagagcaagaccctgtctccaaaaaaaaataaataaataagtttaacttataaattagccacaggaagattaacagcaacaattaataataaaataggacagttatgacaatattctgtaaaagttatgtggatgtggtttctcaaaataccttactgtactgtacttaccctttttgtaatagtgtgagatgataaaatgcataggtgatgagatgacatgaggtaaatgacataggcattgtgatgtaaatggaagatttcagaaataatttataggttttaaattacatgtgtgctgcatagcatgatgaaatactgtgccattccacccaaactgccttcaagccctcttggttatcaggttgactgttgcagtatcacaatccttatgttcaagtatcccttattttatttaataatgacccaaaatgcaagagtagtgagagtaccacagttgacagttaacccgcagaaagtgaaactgcagataaaaggaggctactgtataactgtaaaggatttattaagtactttgggagataaaactctatatcttaaaaatgtctaagtaactataaatagaatttctatacttttccacaaattgtttttaatgtgttttataaatgatatttgtaactgtagtattaatgttatctcaagtccatattctatttttaatggatatggcattagctttttaagaaaactaacgggaaattttgcatttccattttaaagggaaaaatcagtaactaagaaaaattaactgaagatcagagtctaccctcccaaatgatactatactccccagtagtttttcatacaagtaaatcattaaggggcagataacccgttacaaactacttttgtagatagtagaagagtaaaagctattccaggtttgttcagaagagtacaggagaaaaagcttggcaagtgcagaaaattttcatcacctttaacacttagtcatgatagtctaaacaaatgttgaatagaaaggaacttctctaagttcataagcagtatttatcaaaaacctacagcaagctaataagcagcatttatcaaaaatctacctagtggtgaaactttaaatgttgtcataaaaaaaaagacaaaaatgtttgctgtctcttcacctatattttaggagccctagccaagaaaaataggcaatagacaagaacaataggaatacaattagaaaggaatgattaaacacattatttgcagcaacagtatgagtttttacatagaaaaatctaagggaacctacaaccaggtaaaactactaagagttcaggatgctggtggatatcagattaatcacttaaaaaaattaggctgagcacagtggttcatgcttgttatcctagcactttgagaggccgaggcaggcggatcacttgaggccaggagtttgagaccagcctggctaagatggcaaaacccggtctttactaaaaatagaaaaattagctgggcatggtggcacaagccataatcccagctactctggaggctgaggcacgagaattgcttgaacctgggaagtggaggttgcagtaagccaagatcgtgccaccacactccagcctgggcagcagagcgagaccctatctccaaaaaacaaacaacaaatattatttctatgcatcaactacaagcagttatagaatttaattaattggggaaaaaatgtaaaattcacatagaaaaactgaggtttctaggaacgaatttagcaaaacatgatttttattggaaaaacatataaaatttattgaaagacattaacctgaataatggagagatacgccgtggctgtggataagaagactcactttggtaaagatggcagtgtccctcaactttgtaagtgtaatgtacttccaatcaaaatcttattagacttttttgtggaactttgcgaagaaagcaagtcgaatgtctgagtataagtaaagtcattgctagtctagtcaatatttattttagaaaataggattttcttaagacttagtccctcaattcttttctcacaaatcttaaattccacaatgtgtgggggctttcaattgcataatcttgacagtgagttcagaatactggtacatagataattctgcatatccacttttagggagttaaactcatgaatattctttaagaaatctgaggttttgttaggttagtgcctttgctttagctattttcggacgtaactgtgggtttttgttcttatagtgctatatatggtaagcatagaaaagaaacactagaatggataatcttctaaaaagctttgttacctgtagtattacacacatgagctttaaatctctcattaacctttatctttacctttgattctgcttgtgattgaacctggttaaatgtgggagaaatgtttctagaaaaatttaaaatcattgtgaaccaatgacaaagcagtattttatagcaggcatactgtagtcagaataaatttttacaatgttttaggtttttttttaatgctttctatcctagtgaactcttgttttactttttctgtcattggtcatctgatgagaagctagtttctaggcagctgaaaataagatggatatagtttcagtaatgtttacagtgttagctgtatcacacttttgaaatcattcaaaaaccaatcctgcttgccccatattttactactataggaggaacagtcagagatagtattgttgttattaacttctgttggtaaagaagcttaattaaggttttaagagttgattatactttctattaatatttttatagatttagggactacaaatgcagttttgttacatggatgaactgcataatggtgaagtaagggcttctaatgtagccatcagctgaatagtgtatattgtactcatttaataatttatcatccctctcctgcctcccacccttctgagtctccaatgtctgttattcacgctctatgtgtatacatgatttagctcccacttataagtgataacatgcagtatttgattttgtatttctgaattatttcccctaagataatggcctccagttccatccatgttgctgcaaaaaacatggcttccttcttttttatggctaagtagtattccatggtgtttgtgtctttgtgtttgtgtatgtgtgtgtgtacatgagtgtgccacattgtctttatccagtcatccatttatggacacttaaagtgtttcctaagataatggcctccacttccatccatggtgctgcaaaaaacatggttttattcttttttatggctgagtagtattccatggtgtgtgtgtgtgtatccatatatgctacattgcctttatccaatcatccactgatggacacttaggttgtttccatatcttcactattgtgaatagtgctgtgataaacatacaagtgcaggtgtctttttgatagaatgatttcatttcctttgggtatatacctagtagtggaattactagatccagtgatagttctatttttagttttttgagaaatctccatactgttttccataaaggttgtactaatttccattccctccattcccaccattccttttcttctgcatccttgccaacatctgttatcttttgagcttctaataatagccattctgactggtatggatgctttttcactgtggttttacttgtatttatctgataattagtgatgtggaattttttttcatatgttgaccattcatatgtgttagtttgaaatttttctgtttagagtaaacagacaatctacaaaatgggagaaaatattttcaaactatgcatacaacaaaagactaatatctggactctataaggaacttaataagaaaaaaaacgcccattaaaaagtggacaaagaacatgaagagaattctccaaagaacacatacagacagccagcaaatgtatgaaaaaatgcacaaaatcactaataatcagagaaatacaaatcaaaaccacagtaagataccatctcacaccagttgaaatggctattattaaaaagttaacagattttagcaagattgcagagaaaagggaatgtttaatatgttattggtgagaatgcaaattagttcagcccctgtggaaagaaagcagtttggagatttctcaaagaactaaaaatagaaataccattcgctcagcagtcccattactagaaaataaatcattctaccaaaaagacacttacactcatatgtttatcacagtactgttcacaatagtaaagacatggaatcaacccaggtgcccatcattgatggattggataaagaaaatgtgatacatggccgggcgtggtggctcatgcctgtaatcccagcactttgggaggctgaggtgggcgggtcacctgaggtcaggagttcgagaccagcctgaccaacatggtaaaaccccgtctctattaaaaatacaaaattagccaggcgaggtggcgcatgcctgtaatcccggctactcggaaggctgaggcaggggaatcgcttgaacccgggaggtggaagttgcggtgagctgagatcgcaccattgcactccagcctgggcaacaagagcgaaactctgtctcaaaaaaaaaaaaaaagtgatacatatataccatgcaatactgtgcagctatcaaaaagaatgaaattgtatcctttacagcaacatggatgcagctggaggccattattctaagcaaattaacacagatacagaagaccaaatactgtgtgttctcacttataagtaggagctaaacattgggtatacacgaacacaaaattgagaacaatagacactggggattccaaaagagaagagggagagaggggagtagcggttggaaaaaaacctctcaggtaccgtatttgctactgggcaacaggatcattagaagccgaaacctcagcatcacgcaatatacccatgtaacaaacctgcatatgtaccccctgaatctaatatttaaaataaaatttaaaattttttaaaacgaatttatgatataaaaataaattttaaaaatctgtgttctttgcccacatttaaatgagtttttttggttgccattgttgtcattgagtagtttgagttccttgtaaattctgaatattagtcctttgttggaggcatagattacagatgttttctcccattgttaggttgtctgttctctcaattatttcctttgctgtacagaagtttttcagttaaactaagtcacttttgtctatttttgttttttgttggatttgtttttgagatgttagtcataaattctttgtgtaggccagtgaacagagagtttttcctaggttttttttaggacttttataaaagtttcaagatcttgaatacaccttgcgttaatttttgttgttgttgtttttccaccttgagttaaatattttatatagtgagaagtaggggcccagtttcattcttctgcatgtggcaatccagttttccctgtaccatttattgaatagggtctcctttcccagcgaatgtttttgtcagcttcgttgaagatcagttggcaaaggtatgtggctttatttctgggctctctattctgttccattgatctgtgtgtctatttttgtaccagtaccatgctgctttggttactataaccttgcagtttaatttgaagttgggtaatgtgatgcctccagctttgttctttttgcttagtattgcttaatctattgagattcttttttttatttcatatgagttttagaattgttttttctaattcagtgaaacatgatgttggtattttgatagaaattacattgaatctgtagattgctttgggcggggaagtatgagttattttaacattatcgattcttctgatccatcagcatgggatgttgttccacttatttgtgtcatctacagtttctttcatcagtgttttgtagttttccttatagaggtctttcacctccttgattagatgtgttccctggcattttactttttttttttttttttttggtagctttggtaaatgaaactgactttgatttggttctcagctcgattgttactagtgtataaaattgcttctggtttttgtaagttgattttgtatgctgaaactttactgagttcgtttctcaaagaagtcttcgtggaatctttagagttatctaggtataagatgatattgtcagcaaacagagataacttggcttcctcttttccaacttggatgacttatttctgttgcctcttttctggctgtgacttttagtactatactgaatcggagtgtgtaagtgggcatttttgtcttgttcccatttttagcaggaattctttcaacttttctccattcgtatgatattggttgtagtttcgttgtttgtgacttttattattttgagatatgttccttctgtgcctagtttgttgcaggtttttatcatgagatgttgaattttaccagatgctgtttttgcgtctattgagattattatatggtttttgtttttaattttgtttaggtggtgaattgcatttattgatttgcatatgttgaacttcctttgcgtgcctggagtaaaacccacttgatcatggtgtattatcttttcgaatgctgttgtattcaatttgctaatattttcttgaggaattttgcatctatattcatcaggagatattgatctgtagttttctttatttgatgagtccttgtttggctttggtatccgggtgacactggccttgtagaattagaaagggaagattccctctactattttggaacagtttcagtgggattggtacaagttctttgtatgtctggtagtattcagctctgaatctgtcctctcctgagcttgttgttgttgttgttgttgttgttgttgggagattttcatcttactgatttaatcttagtactcattattggtctgttcagggcttccagttctttctggttcagtacaatcttgggaggttgtatgtttccaggagtttacccacttcctctaggttttctagtttgtgcatgtagtgatgctcatagtagtctctgatgaccttttgtatttctgcagtatccgttataatatcttcttttttatttccgattgtgtttattcgaatcttctctcttcttggttagtctagctagcagtctgtccgttttgtttctcttttcaaagaactaacttttcatttcattgatctttttgtattgtgtttttggtctcagtgtcacttacttttcctctgatctttatgtcttttcttctgtcaaatttggatttagttcttgtttttctgtttcattgggtgtgacattaggttgttaatttgtgtgtgtgtgtgtgtgtgtgtgtgtgtgtgtgtgtgtgtttagacagcagtataaactttcctcttagcactgcttttgctgtatcccagaggtttggtatgttgtatctcctttttcattcatttaaacattttttaaaattttcatcttaattttgttgttgacccaaagatcgttcaggaacatgttgctgaatttccatgtatttgtatagcttcaagaattcccccttgggattgatttctagctttatttcactgtggtttaagaagatacttgatatgatttcaatttaaaaaaaaattctttaagacttgttttgtggcataccatatggcctattttggagaatgtttcatgcatgatgaaaaagaatgtatattctgctatttggggctagaatgttctgcaaatgtctgccaaatacatttagtttagagtccaatttaattctggtgtttctttgttggttttgtgtcctgatgatctgtctagtgctgtcagtggaatatggaagtcccccactattattgtattgctgtttatatcttttcttaggtctagtaatattagttttatgaatctgggtttgggtcttctggtgttgggtacatatatatttaggattgttatgtctttctattgaattgatccctttataataactttgtgtatttttttactgtttttgatttaaagtcagctttatctgatctaagtatagctactcctacttgtttttggtttccgtttgcatggagtatctttttgcacccctttcttcagtctgtaagtttctttaccactaaggtgagtttattgtaagcagcatatagttggatcttgttttctaaattcgtcctgccaatctttatcttttaagtagagcatttaactcatttatgtttaaggtaaatattgatatgtgaggttttattcctgtagtaatgttaattgttatcacattgctttgtagtttcgttggtgtaattattttacaagacctgtggattttttactttcttacatttttatgatggcaagtattgacccttcatttccatgtttagacttcccttgatcatttttgtagagccagtctagtgatgacagattccctcaatgattgtttttctaggaaagactttatatctcctttattcctgaagctttttctagcaggatacaaattttcaggttgacagttttttttttctttaagcctattttgaaaatagaatcccagtctcttctgacttgtaagtcatctgccaggaagtctgctgttagtctgatggagtttcctttgtaggtgtccaaatgcttttctcttgctgagaccacacagtctgatgactctatgtcatggtgaggcccttcttgcaatgtatttttctgggtttcattgagcctcttactctggatgtctagatcacttgctggacaagagaagttggttttccaaactttttgctttcttttcttttctttctcgagaatacctacaattcctagatccagacattttattgtagtctcctacttctcaaaggctttgttcatctttaacattcttttttctttcttcaaaagacctgtctttatgttctgagattgtttattctccttgatctagtttattgttgaagctttcatctgtattttgtaaatccttcagtgaattttttattttcaaaagatttcatttatatccttaattgatattctgtttctttgtgttggtttttcacattttccatgaatctcattgagcttccttaaaaatcaatattgtgaattatttagcatttcagtaatgttggttaggatttattgctagagagttagtgtgatcctttgagggtatcgtaacaccctgttttttcaaacttccagaattattacactggttctttctcatctggaaaaacacatttctcagtttgaattaatttttgtttgaacgagactgttttcccttgaggatgtgactgtaatgtatgttgaatatggtcatttggctttgcttctgggtgcttttagtggcaaagactctatatgaatttcctggttttagatagcctttggtggctttctcaaacatcaggtgtgatagtggtatacttggcttgtgagcaggctcacagcctcctgtaagtcagggtagcagaggtctcaagaagtgtatcttgttcccaaattgtgtgcatttatgttaccagattgggttgtgcagttcatctccaggccaataagtagcatttgcaggtatgagtcagcttcagtggtaacagtggggtttacgcttgacctttgtttgccagggaaagctcagatattctgatgactggcagaggcaccagccctgacaagggtggcaggggagaggggagtcattgggccactggtaaaatgcactgaggtctcttgtggagaggggtgggatgggggggtgtgggccaggtgatgagctgtcttagcaccctggcctcagcaggcaggaatgtgatgtttccctctcacactcctattctggtgctcaggttgttcagttctcttagacactgctgtttatctccaagctgcaatgtagcctagaactacaggagatgcttgccccatggcttgacagtacacttctgtgctatctggaaatgggtgccatgcagactctgctccctccccatggcaggacccctgaaactctaggcagagagtgggacaggacccacctttctcatgaacctgggcccagaggccactgccagtggaactgcagttgcccctcacagcttcagatagcctgccctctggtttcttgtgccagcttcccatgggagcagcaattactgtgtctgcagcagtgggtggagggggaggagaagttcccttctctatgtctgggctcaagcacagaggccacttggccagtggtacaggaccttactcctcacttgcagtgctgagcagagtttgtgtctctgtgtctctgccaggagcaggcattcacttgcagccccaagcagagagctcttggggggcgctggaaaatgcatgctttggtttcctttgtcccagaggctgtccttttggtgcactgcacttttccttctcttaaaagtagcactccttgtgggatagattattgggaaccctgcagcaccccgggtctaactagcactgtgccactgctgcctgctgagtgggtgctggggaatgtcagcaagagctcccaggatgtggaagcacaagggctgaggttccctgggcaagataaagtcccctgatggatatgctctgataatgatgccttgccacagatgctcgagtctaggatggtgggaaggtgagcaacccagcgtgagcttgcagtctggtgtaacaccctcaagaaatccctacccataccacagtctaggtttgtgagagcagaggagctctcccatagatcgcatactagcactctgccacaggaatgaaggatcccaaacactctcgcttaccctttccgtgcaacaccaagtcccttggggctcccagccactcttttttggcctctcacttccttctttttctatgcctaaattttttcctgtgatttttgtgtactagtattctctctctgatattctgttagagctgtgattatgtgtttgtaattttggttcttttttgagaccgagtctctctctgtcgcccaggctggactgcagtggtgcgatcccggctcactgcaacctctgcctcccaggttcaagcaattctcctgcctcagcctcttgagtagctggggttacaggcacctaccactatgcctcccaatttttgtatttttagtagagacggggtttcacgatgttggccaggctggtcttgaactcctgacctcaactgatccacccacctcagccttccaaagcgctgggattacaggcgtaagccactgcgcccggctgtaattttggttcttttttctgaagagaactggaacttgatgtctttagtcagccatcttgaacctctctctctgattatgattattataattaaccttgcaacccttgataactggtttcctttacctccgaaacacacaataaagtacataaaattatttgcaagcttcttgtaaaagaaccattttttctatttaccatattgcatttttaaatttattttgacaaattcttacggttatttccatttttattcaatgagaagcattttcttgaatacgtatatttgtatttttatgtcagtatttgtcattaagtagtatatatttatagaacaataggaataatactttatacaaatgaagtcttgtctttctaatactaaggggcattacagttttcaaatatcctttgaagtagatatgtcttttaatataaaaggaaatatcaaaaaatagatggctgttctactgttcctgtattttcaggtattttccttaaccaatttcttttattttttaggtacctagtcgatagtcgctggttcaaacagtggaaaaaatatgttggctttgacagttgggacaaataccagatgggagatcaaaatgtgtatcctggacccattgataactctggacttctcaaaggtcattattttcttccttcagtcaagttgtaaatgtgttaaatttcattatataaatgtcagtgggttgaatttggaaaatgttagcgcaaataagttgataaagttttgcattacagattttacctaatgaactcattattctaataagttattaaaaattttattagttattattctgtatgacaagttttgtttttcatttatgatgtaataaggttttattgttgtttaaacccttaaatgaagaactgatttcttcatttaaagatttcattattaagtaatcattatttaatgattatttattactaaataataagactcattatttgttattaaataattaaacactgattattttgagaaatgctatgtcacatattgtttttcctagtggacacatgacattttttaaaatttgaggaataatcatatatgcttaagttcttaaatttttgcattagctttctacaaccctcactacttgccagtccttctatatacctcttattatgggtaaagggaacaaaacataagtaccagaacttccatttctaacagtggttctcaaaacactgtgtatcaggcaacggaaaacagtgatccttgagagatgcgaaacaaaataggtaagccctccaactgccttcagtttactgcattaaaagagatttccaagacacaacatgggaagatgaaacccatgcagacccttgctatctcccttagttgaggaaacagagtttgcagtctaggaaaaccaaggctacaagagtccaggaaaataccagaaagtagtgagtagctcagagagagagagacctagacccccccccatagggttgctcttaagtcttcaactattaaaccgcactttgcatataagaaaactgcccaaggtcagacaaggtaccactgaaaagaaggaacaatcatcgaggctaatataggattgggaatcgtttgtgttctcagcagccagagtggaaaaccacataatttagagtagacttctgagaacagttttacttatgtaatagggtgaaattaattttcctgctctgctaacctgaaagcatcaaactatttcgaagaaacttaactgcatttcagaataaaacttgagtatttataagaatacaaaaatatccagcatacaaaaatgtaaaatttataatggcttggatctgaccaaatattacctggcatgtgaagaagcaggaaaatatgatcaataatgacaagcaatgtcaatcttaaaaacaaatctcccccacaagacatggaaaaaattaataaagaacagatgagacaaatacaaaattaaaagttgctagattgaaacccagctctatgaataatcacattaaatgtaaacacctcaactaaaggtagtgagggtgagactagattaaaaagttaagaaccagctataactgcctacaagaaactcactttaaatgcaagaacacagatagattaagatatggaacaagataacaccaggctgtggtaagcaagactaacccccagtgatcctcactcttgtataatactctcccctttgagtgtaggtgaaacctgtaaataggatgaagatatcactcttgtgattatgttatgtggcaaaaagagactatcctggtgaacgtaatctaatcacacataccctttaaaaacagagagttttctctgtctggtggcaaaagaattcagagatgcatgaaagagggtcaatatgtcattgctggtttgaagttggaaggaatcatgtgagatgcaaggcaggcagcctctaggaacagagagtggcctcaggttgacagccagcaaggaaacgggaacctcaaactcacaaccatgagtaactgaattctgccaacaactgaatgggcttggaagcagattctccctcagaccttcagataagagcccagcaggggtgatatcttgacttcagccttgtaaagccctaagcacaaatccatttgggccctccttaactactgacccacagaactgtgaactaataaatcggtgatgtttaagccactatggtaattcattatgtaacagtggaaaactaataacacatgctaacactgttttttaaaaagccggagacattaagtttcagaataaagaacataatcagggatagaaaaggtcacttgataatgactaatgggatgggatagttcatcaagagaatatagtaatcctaaatacatacctacctaatggcataacttgaaaatatgtgaagaagagtgatgtcagcaggatgatagaatagaaagtcccagcccccaacacccaacagaaacactgaagtaacaatggaccagactctttatgagaaacccaagatccagttaagaatttgtagtactccagatgagcccaaaactgagaacaacaacattgaaatgagtaagaacaattttattttgcccacatcagcccctcctccaaggagtcttagcttagtctcaagagagattgtctcagatcaggacctctcccttgggggaaaagagggagatcacgtgcttaattttccagcccttcagtgtactacccaacaggccagttttctaaaaaaaaattttgatcaccttacatagagtgctgaaggaaccagcatagttctgatgcctgggggcagttaacaaaggaaagagggtaggtggttgctgcagctggaaggctctgagagattgagagaaggctaagaacctgaggcttctctcccaggaaggaaggagaggagtgggggcatcctgcactgcccatgcctttcagtgtgctgcttgaggggccagtttctgtcatgccttattgtaccagagagctgacatagttcaaataactgggggaagttaacaacaaaagaaaagggataggtggcttgctgcagctgccacaaccctgtaatattgggagaaggcatagaacctgagacttgtcttccaaggaagaggaaaaggagtggagtgtacccccagtgttccagtctttcagggtactgcttgaaggactgacttctgtcttaccttacccagtgtttggtgggggcagataggaacaaaggaagaggggcaagtggcttgctgcactcagcacagctctacaagatttgagaaggcagagaactcaaggaagagggagacaagtgggatgttcctctaatgttctggtctgcagtatgatgtaagataccagaaggaggaagagattatgggtttctgaaaaaaaaggaaatcaacaaatccttctaattaggaatctgcatgcacaagtacagaaaagacatatccacaaaaaaagtttgagatgttctcagaatctctagccaggcttttgggtggaagtgaagctatttgcctttcaaagccagttgataaagactgggagagaggtggctgtttcttcagttgcacaaacacctgtgcaaagctacaagaactcaatcagggaaacgtgacacaaaaaaacaaaatctccagaaactgaccctaaagaaatagagatgaattgcctgacagagaattcaaaataattgtcttataaagctcactgagttacacgaaaacatagacaacttaacaaaacaagaaaaataaaaattcacaaaattaaaatatcaacaaggagctaaaaattatgaagaaccaaacaaattttggaatacgataactgaaaaattcactagaggtcttcaacagcagacttggacaagtagatgaattggcaaacttgtagacggatcatttgaaattatctaatcagaggattaaaaataataaaaaagcataaaggaagtccaagtgacttctgggacaccatcaaatgaaccaatttgtgtgtatggaagttccagaaggaggaaagtgagaggggcagaaagcatatttaaagacatactggctgaggccaggtgtagtggctcacacctgtaatcccagcactgtgggaggccaaagtggacggatcacatgaacacaggagttcgagatcagcttgggcaacatggtgaaaccttgtctctagaataaatacaaaaaaaataatccagccagtcgcgatggctcacacctgtaatcccagcactttgggaggccgaggcaggaggatcacaaggtcaagagatcgagaccattctggccaacatggtgaaaccccgtctctattaaaaatacaaaaaattagctgggtgtggtggcgcgcacttgtagtcccatctactcaggaggctgaggcaggagaatcgcttgaacctggaaggcagcggttcagcaagctgagatcatgctactgcactctagcctggcgacagagcaagactccatctcaaaaaaataaaataacataatatgtgggtggtggcatacacctgtagtcccagtacttgggaggctgaggtgagatgattgcttcagcccaggagacagaggttgtatggagccgagattgtaccactgcactccagcatgggtgacagagtaagaccctgtcttgcaaaaaaaaaaaaaaaaaaaaaaagaatgagtgaaataatggctgaaacttcctgaaactgggaagggaaattggacatctacattcacgaagcccaaagagttgaacaacactgttaatcaacttgacctaattgaattttgtaaaacattccttgtacccattaagaatcacaccctatcccttctttgctgccaccccccactctagacaactactaatctcctttgtctgtatgtatttgcttattctggacatctcatataaatggaatcatacaatatgtgtgtttttttgtttattttattttttgagatggagtctcactctgttgcccaggctagaatctcagctcactgcaacctccgcatcccaggttcgagcgattatcctacctcagcctgccaagtagctgggattacagatgcgtgccaccacacctggctgatctttgcatttttgttgagatggggtttcaccacgttggccaggctggtctctgaactcctgacctcaggtgatccatccgcctcagtcccccaaagtactgggattacaggtgttagccactgtgcctggcccaatatgaattcttttatgtttgtcttcttttatttaggacagcacaatgttttcatgttttatccatgttgttgcatgaatcagtacttgatttctttttatagatgaatgatttctactgaatggtgcacatttactttatgcactcatcagttgatggacatttgagttgttttcacgttttggctcttctggatattgttgctatgaacattcatgtaaaagtttttgggtagataatgtgttttcctttctaatgggtagatacctagacatgaaattgttgggtctttttaaacttcgttgtttaactattttaggaactcttagactgtttttccaaagtcattgcatccttttacatcattgctggcagtgtatgaggattcattgcttcacattattaccaacacttgttcttgtctgtcctttttattatagccgtccaagtgggtgtgaagtggtatctcattgtgatttttgacgtgcatttccctagtgattgatgataagttctttttttgtgtgcttgttatatatcttttttagtgaaatacattcagatcctgtgcctatttttaatagaattgtttgtctttttattgttgtattttcagtttgttatttatttaggatgctagacccttatcagatgtatgatttgcaaaaattttttcttattctgtgggctttttatattcttgatggtgacctttgaagcacaaaagttttttaattttaagtccaatttgccttttttttctttgttgcttgtgcttttggtgtcagagagcattgctgaaaccaaggttgcaaagatttatgtaagatttatacttacattttcttttacgagttttatagttttggctgttacatttacagcattggtctactttaagttagttttgtatatggtgtgcagtagtgttctaacttcatccttttgcatgtggatattaagttgtccagtaagctttttaatagaaaaggataagctgatccaaaaattcatgtggaaattcaaatgacagaatggctgaaacaactttgaattttaaaataaaatcatagaagttaacactatttgatttcaatccttattttaaagctgtaataataaatatagttgatattgatataaagacaaatacatcagttgaccagattagagaatccagaaatagatctacacatatatagtcattcagctttagaaaaaggtaaaagaggaattcactggcaaaaggatagtcttttaaacaaatgcgccttgagtatttggatatctgtttgcaaaaaactgaattttgatgcatacatggcactgtatacagtattaatccaaaatggattatagacctgaatgtaaaaactaaaacttttaggaaaaagtctttgcgatgttgtattagccaaagttttcttggatatgattcaaaagcaaggttgctaaaagaaaaaatgtagttgtgtctcatcagtaacaaaagcttctttaaatgacactgttaagagaaagaaaagagaagccacagtgtgggagaagatatttacaatcatgtagcagataaaagacttgtttgtagaatatacagtttataaaactcattttgaagaaaacgtaaagcccaatggaaaaagtaggcaaaagatttgaacacataattcaccaaagaagatataggtttcaaaaagcacgtgcaaaaatgctcaacataattcatattagagaaatgaagattaaaaccacaatgagaaaactgatccataccaagtgttggcaagattgtagaggaagtagaactctcatacactgtttctatcgatgtcatatcataaaagcacttcagaaaatagtctggcagtttcttaacaagttagacatacgtttattgtagagcccagtcattccactcctaggtatttacccagaataaatgaaagcattttatccatatgaccgattgtacacaaatggtcatacagtgttatttgtaatagaaaaagttgtgaacaactcaaatgcccatcaacacctgaatggagaaacaaaatgtagcatatccatacaatgaaatcccactcagcaattaaaagaaattaagtattgatatgtaaaaacatggatagatctcaaaataattacatggcatgaacaaagccaaacaaaaaagaggacatactatttttatgtaagactctagaaattgcaaattcgtctatagtaacagaaagcaagtactgttttcatgtacaagtctagaaaatgcaaagtagactatagttgcaaaacacagaataagtaacattctcttaatccctcaggttttttctcgcttcttgatttttattgtttatatcttattgggaatactgtgttctcattattgaaatgctaccaagaacaattttgctttccgtatctgttaattaagactaacttaggacaagaaaaatctccattaagttggatataactcagtgagatatttctgttcctctttctgcattttaaaaattcacatggacagataacaagtctcagattaggactgtgatgtaggtatggttccagaaatttcttctagatctgtggcctgtcttatactaaatttttttagtctagctagaaatttgaaagtggactgtgaattagaatcacatctgaagaattacctccattttagttcttgggagaaatccagattgtgggccttctggaataatgaaatggttcacaagatgcccatttgtgatttctgtcatggttcctagcccgtgtgtcttggtgtcattgtaaaaggttgttgatttgcttctgaatttcctacaaaagctgatgctagaatgaatattgttaccatatgagggatctctgctactcaaaatatgtgggaaacactcttttgtcaagtctcttgactaacagttactccatagtattttttaaagaacctaataaaagaattatgtttttaaatattgctttttgatttatggtacaaactgaaagttttaaagcaatagtttattttgaaatatgtatggcaggcttgtccaacctgcagcccatgggctgcatgcggcccaggatggctttgaatacagccaaacacaaatttgtaaactttcttaaaacattatgagtttttttttatgatttttttaagctcatcaactattgttagtgttacaattcttccaatacggcccagagaaacccaaaaattggacacccctgatgtaagggagctgaattgctttagagcttaaaacttgttttaaatacttaaattagccttcatgagtttaatttgtaatgtgtccaaacaaagtatttagagttaggtattgagtttattttttcttttgcagatggtgatgcccagtcacttaaggaacaccttattgatgaattggattacatactgttgccaactgaaggttggaataaacttgtcagctggtacacattgatggaaggtcaagagccaatagcacgaaaggtacattttaataataactgactataaatattatttttcttgattagttcacattttattattaattcaatgaattgtgaagtttcatcacttatcttagagaaaaagccagcaaaataaccgtacactgtgttacaataatggcaagtaacatgttaagaaggtttacttatgctagccactattgtaagtatgtattattgattaatcctctatatatagagagaaaactctgtaaggtaagtagtaggaaatgaggataaaaagttaggatctagttattttagaaagtcatatcaggatacagactttggcaacctgaccctgttttctgtgctgcactgtttttgataaaacaattagaaaacaatgaagaaactaaaagttgaagcaatgttttttggaacataaaaattttttaaacttgaaaatgtagattttttttcatatcctttaacattttaaaattgtagtctagaaacattaagaataaccaatttcgtttttttagggaactaaaaagcaataagtaagggtgttgctgtagtagaataccaaatattcaaggtaaatgagtgaaccttacacatgtatttgatcatttattgtaggaggggtgggaggctgagaagggaccaaaatctcttggcataattttgtatctggtttgggtcccccgaccctccccccatcccccgccacatagaaacaattaaaaagttggattaggtaacataagggtaaaaaaacctctagtagacctaactatatttgaatttatttggaattgatgctacaaagttgccatgttaacaatttgtatttgtgtatccatggttttaggtatattagaagctaaccttggatcttattttctgaatagatcttgaatgtaccttttatttatttttgtttagttttattccttagtttcactcagccacttcaaaattagaatttctctgttgtaggaatgctagccttatagatctgtgaaatgatctagttgctttatctatagttgctggagaattgagtgttttgatcaaaggtagcctatttagctgtaaaactgtctagaattatttcattcctaggataaaggaaaatttgtgtccaaaatatctctaaaggtattacactgtattcctttaatcttaatgatacacttttttttcttataaatgtagcacattatacactagcggtcttcagtatgataaacagatcaactaccaatttcattgccattactctttgaaatagtcctcattgagagttcttgaaacctgtgtctaataacaaagtaaaatataatcaaaaatttcacacaagtagaagaaaaaacattgacaaatctcttgggagaccacatacttatttttaacaagatgaatgaaatatattcaacctgtaaaatagtttgcaaatgttcatgtgctatattacattgcgtggagttcttattacagatgcaatttcctacaacattaaatctgcagtaaaatttaattaatcacacttaaatttgggaatttcatttgcattttcactgtggcccacatgactgatgcaggtggaactcaaagaagtaaatagaccagcttatagtgtctgaagcccaactttcaatgttacccatctctgattgcattaaagaatctaggattggtggttcccctagctataatgcagaaaccaagttaaacatcttcctgtacctcaaagatctctaaaatgcgtcatttatagtgtcaacactcaaagaatggacgaaaagaaagcaaggatataagcagaaaatacgatggaatcaaaatccaagagaaacagcagacaatagaaacagacccataagaaacccaggtaattgagttagtagattttagaatagtgggcttattatgcttaaaaaaaaaaaaaaaggcagatgagaagtagggcaaaactattaaagaagaagcaaatagaattctaaaactaataatatggaaattttatggatttaatgtttgggaataaaattattagaccaaacagaactgaagagaaaatttgtaaactaaatgatttgtcaatagaaaatatagagtctaaagcttagagagacaaaagaatagaaaatacagaaaaaagctaaggcataaatggaatgcagtaagtaagtttaacatgcatacatatagttggaatcttggagaggaaagaaagagtgggtagaactaataccaaaggacgtaatagctgagaattttcccaaactgagaaaggtgtcatgctttaaagaaatgctatgaatcccaaactgaaataatacaaacaaaactgtacctagtacaaatgttgaaaagcaaaggcaaaaaaatttctaataatagccagagaaaaagacatgttatcttcaaaataaggataagacaaaataatgatttctcaagagaaaccatggaagccagaaaacaatggactttgatatgttaaaagaaaataactgccaatgtaggattctgtgactaagaaaataatccttcagggatgaaggtgaaaaaagccattttcaaatgaaaactaatagaatttgttacctgcagacgtgtattaaaggcactacaaaataatcttaagaatggaaggaaaattattccagatgaaagcttggagatgcaggaaaacagtgtagactgacaaaatgtaaatgttgtgagtaagtcttaagatggactgttgaaaacattaataataatttttatggagttgaaaatgtgtatagaattaactacacaatagtgttagcatgtaagttaagataatattctctactatgttccctggtgatccccagctcctcatatccatattcttgggcactcttcttccatgttgtactgaggttggtctgtgtggccaatagcatatagcagtactcatggtacatcgctttcgagattaggttataaaaaaacaccgcggcttacatcttgggtgcacacgcactctagctgtctctctttctcatttctcactcggggaattcaactgcatatggcgaggacactcaggcagcctatggagaggcccacatggtgaggaactgagatctctggccaatagagaggaacggaggcctgcaacaaccatgtgagtgaccttggaagtggatcctttagttctagtttagctttcagatgattgaaaccccagccataccttgagagcaacctcatgagaaactctacaccaaatcaacccagttaagctgctcccagattcttgaccctcagaaacattgtgagataatgtttgctgtgttaagctggtaaattttggggtaatttattatgcagcaatagataactaatactaatcatggtacctgtaaataggtgctgatatgaaaacttgaaatgtggcgtggctttggagctgacagtgaatagaggttgtcagaactttaagagtatcaatgaaagcttaaagggccttaaacaaaccgttagtagattactagactttgagatagctgccagtgagaacttgaagtgaggaaagtcttactggaaactggtagaaagtggtctttgttatacagtggtagagtaagtttagcaacatgttgcctgcagtaaactgaaaggttaaagatagtatttaatgaaattataggtctgccaaagtgttaaaagtactgcctagtttctttttgtgttggttatagtcagatgtgagagaagagaaatacactaaagaaaggattgttcaataaaacagagccaatatttactagttttgaagattcctagtccctccagatggcaaacggtgctaatactaagcagtgtttctgagcaaagataaaactcagagtattctcagaaaaaaagtgtgatctaatctggcagccaagggtgtgactgtaagttacctcagaaaaatcaaaggtcatgcctcacagtactattcagacaaaaggccctataaagtatttaagggttaacttagaggttgtcctgtcagtagtaatattaattaatattaagggtgtcttctcaatatgtggcttctaagaacaggagggcttcaagaagcttacgggcaaccccttagctttctcagcataaagccaaagtagagaggacttatcctacagaacatttgtggatatggcttttgtctaatggaatgaactccagtaagatccagtggagacctacattgttttcgaattacctcgcagaaccactgccattttggactgcagaagcagtattaaatgaaagacgcctttgacctcccaaactccaataagtaggaatcaggctgaaaatttacttaacttcaagcatgtgctaatgcatgaaaaaaggatgactcagagaacagaaccaaatgttagatagaataattttcaggcaagggtagaactgagttccagtcaaggaatttctagtatttgtccaggtagatttcataatcgttatggaccattgattcctttgtacgtcctatttcccctcttacaaaacaggaatatttaaaaggctatgttctgtgtgcttcattgttttattttgggtgtatggggggcagaaaacttgtctcttagttcacaggcctatacatcaagaggcactacagtagtcccccttatctatggttttgctttccgcgatttcagttacctgcaagcaaccatggtccaaaaatattaagtgggaaattctggaaataaacaattcgtgagttttaaattgtgcaccattctgagtaacatgatgccatcccactccatgtcctccccatggacactatacactaccttcccgtttgtcacttagtagccatcttggttatcaatctactgtcacagtgctttgttgaagggcattagtagcataatgcagcgttacaatgtacatcattcacttcacctcttctcatcaggtagacatttaatcatctcatatcattacaagaaaaagggtgagtacaatatgataagctaccttgagagaccacatacacataacctttattatagtatattgttctaattgttctattttattattagctattgttaatctcttagtgtgcgtaattaataaattaaacttcgtcataggtatgtatgtttgtaaaggaaaaaacatagtgaatatagggattagtgtgctatttgtagtttcaggcatccactaggggtctcggaatatatgtcttcaaaggcttatagaaaatttataatttgtcaattatagatgacaaatttctgaactccaggttgctaaaatgaattgagactagttggggcctttggaagaactgagtgtattttgtattttgggggaaggaactgtgaatcattgggggccagggggtagactgtggtagccagcctcaaagatgctccccagtgattgtgacctcttagaatccttagtctggtgtaatcctttcccacattgtacgacagttggtctatgcagtcagtagcatgtggcagaagtggtggtatgtcacttctgagattagtccttaatggatgcctgtacttctattgggagtgcacatacctccctcatcccctcccctcggatcactcactctgggcgaagccataactttgcccttaacttaccctatagagagactcacataatgaggaacagaggctgccaacagctacatgagtgagcttgtaattaagatttgaacaacatgattaaccaccataacctaattgacatgtacattgtacttagtcattgcagaatacacatttctattaagtggaatttttaagcaaaattgaccatattctgggttatcaaaattccagtaaacttcaaatgatagaaattgttcactgtattttctgtcattagtgggattaagctaaaatcagtaacaaagagataacctgattatcccccaactatctagaaatggaaaaatatacttttaagtaatccttgaggcaaagagaagaatgaaaattagacatattttaaactgaataataattaaaatacaacttaaaagattggctgaaattctcagaaggaattttatagcttcagtgcaaatattggaaaagaaagtgaaaatctattgtctcaacaagttaaggaaattgaacttaagaagaaacattataatgtagacattaacaaaatagaaaacaaacctacattaaatgaacaaaattcagtcattgtagagagcagtgaaattagaccagtaaagtaaagatgagtcctggcaggattgtttaagaataaaaagagagtaggcacaaataacctatattgcgaatgaaaaaggaaacatcatagcagagtctaaagacttttttgaaaagattatgttttgaacagttttatgtaaatttgaaaatttagatgaagtggataatttctagacaaacagaactttaaaatgtcaatacagtaagaaataggaaactcgaattcacctatgtgattaaagaaattgagtcattgaaaaccttcccacaaagaaagcttcaggccaagaaagctttaccagtgtattctaccaaatatttagggaagccataaaccaataccacacagattctttctgagaatagaagcagtactccccaacttattttataaggctagcataaacatgacataaaacctgaaggacattacaagaaagaaaaattacaggctggtctcactcatgaacatagatgcttaagtcctaaacacaatgttagcaagacaaatccagcattatgtaaaaaggacaaaaatgaccaaggtggatatttttcaaagaatacaattttaactttgaaaagcattcataattttagcagactaaaggagaaaaataatctcaatagagatacaaagaacatttgatgctcaacatccatgtatgatcttaaaaaaaaaaactcctagaaaactaggactagaaatcgcctgtaaatattgtacttattggtaaaatattaaaagttcttcccaagtcaagaataactgtgttagaaatcttagccagtatggtaatatagtaaaaagaactaaaagagtgaatcttgtaaaagaagatacaagactgtcagtgtttttagaaggcacgattctacaggtttaaaattccaaaaatatgtactggtaaacaattagaattaataggtaaatttaacaggttgcctgatataagggcagtatagggaaaccagttttttattggcaacaaataaagtttatttttatttgtacaaattagtggtgtacatgagaaaatctgttacatatatataataagtagtaatgaagtcagggtattttgggtgtccttcacccaaattcaatacatttttgttaagtatagtcaccctgctctgctaccaaacattgaatttattccattttactgtatgtttgtacttttaagccagttcccttcatccttccctgctcccttccttatccttcccagtgtctgttatctatctttccactctttacttcatgtgatcaaattttttagcttccacgtaaaagtaagaacagatgatatttgtcgttttgtccctggcttatttcacttaatataacgacctccggcttcatccatgttgctcaaaagacatgatttcattctttgtaatggcggaatagtactccattgtttatatatatatacaatatttatccattcatccattgatgagcacctaggttggttccatatcttgctattgtagatagtgctacaataaacatgtgagtgcaggtatccctttcatatactgacttcttttcctttgggtagatatgcggtagtaggattgctggattcaatggtaattctgtttttagatttttgagaatctccacactgttttctgtagtggctgtactagtttacattcccatcaacagtgtataagtgttcccttttctccgcatcttcgctaacatctgttgtcttttgtctttttaataataaccattatggcttggttaaggtgatatctcattgtggttttgatttgcatttctctgatgattagtgatgttgaacatttttatatacctgttggccattcatttgtcttttgagaaatgtctattcatgtcctttgcctacttttaaatgggattgatttttacctgttgagttgttgagtccttgtatattctggatattaatcctctgttggatgaatagcttataaatattttctacacttcaacaggttgtctcttaataaagttgaattttaaaataacatttacaggtcaaaatacttaggaataaacctagtaagaactgtgtttttctatactgaaaattgtgaaacattactgggtaaaattaaagaagacttaatgaattaatggatctagcctgaaggtctagaagctgaagatgtaggagaaggagtaggtcactaatgtttttctgtaaagggccagatagtaaatatttttagctttatgcgccctttagtttcttttgaaatgactaaactttgctgatttaggcataaaagcagccctagataattaataattgggtatgaaagtagccgtaaacataaatgaatgggggttgttgtgttccggtaaagcactatatacaaaaatagattgatgggtagatttagccatctaaacctaagtttagccaaacttagttcataagtttgcccatcactagatctaggcattggctttaatgtctaccagcatcacaaaaaaaggagcaactagatgtttgcatcctgttcagagtgagtgtatgtcaccatctatgcagtggtctaaagtaaaaattacaagaataggaaagatggagaacttctaggttaaaagacacttaagagacgaattagtctattggcaatatatggaccttatttggatcctgattcaaacaatacattaaaaatgagacagaaggaaaaatttgacttttgactggatatttgatattaattgattagttttaattttttaggtgtgatgatggtattgtggttatgtttgagtctttgtttctgaatattctgaagtatttgtggatggaaaatcacatacataggatttgtttcttacacattaagaactatgatttcatagttttgttgtatttatctacttctctgtcttcaccgttatctgttctcactcaggctccaggatctaggtctaatttatctgcaccaaatgtaggtactcaataaatgcttttaaaatgaatgaagctagctctacaaaagagtaagtcagtctgttagaggcctggtattatgaaattgtttatatagtactagatttttttagaaattacttatatttctcttcccatttcagggagggagcatacttggaatgaaggtaaagtttccatgaaacttttcatacacagacataaagggtagactatattaggtttatttaatatgtttaatggccttgtaaaaaataccctaaatattcacagcaaaaaatgaacaaatagaaattatttattttaatcctctgtaaacttatatgtagctcaaatacttagtaaagagactttgccttcattatggttataaattaatgaaaatatgtttacatatccataagtcttccattttggacaaggagccagatttcatcatgtactcactttttatttatggtaatataacagtgttataattcacttagagtaaacattataactatcatctataatactgaaacataactatcacttctgaatatcccccttccgatcttatttcaaatacatattttaatagttataataattaggtaaataaaactatactttttttataagcttgtttcttcctgttagtcttcatgaccatcattttcaatgcatacatttttaattaaggtaggaaggagattttatgtaaacaaatatgaaggagattatataagcaaataatctacatgtgaccattacacattgattcgtaaatgtgctaattatttttctttttatggtgctgttattttcaagctttaatagtacatatagtatgaccttttcatataaaaatagtttgacaacaaactcatatttttaaaaacaacaccttgttaatacactactttgggaattagtaaaataaatatcttataaatatagtagcagttttctgagtagtgatgatgaagattttagcaatgtaaaatgtaggaaagaagaaaaaaatgttgagaaaaattctgaatcccagtagtgtggactttgaaatattcttgatattttgttttcatagatctcacaataactctgacagttaagtcaccaggttctttccaggaaaatatctatagtattatgaaaatgtattttcatttttagaaaactatgcctatttagaaagtatatacctcaatataaatcataatgggggttttgttttttaaccatacttattccttttcctgctttgtgttggtcattccatttttctttttcttccataaaaatgaggcctgcagtttaccttagttttagttactaccagtgattagtagctactttaatgtagtttattttaggattttactcagctattgagccccagtatagaaattactgactgataagaatatttgattccttgtttctctacttaaatataactacaagtaatcttataaaattaaatgttactacatttgtaaccatgaagtaaatcagcctaagatgtttaaaacaaatctcagtagtttaacatattggttttacaaaacaaattacatttattagcagaaggagaggtacaggctgctacctgtttaaaaaaattgtaacaagtatgattaagaaaatatatatgacaaagtatcataaaaatgtgtgttggattagatagtaaatactagatgaactgcatttgaattttttcaatgcagtgaaagacaagtttgtaaagtcctcttttgaattgatgtaagcttgtgagtatatcccaacggtcatttggagcctcccttttgccatatttgtctaatggatcacatatcaggcctattactattttcagaaacagtattcatgactgaaatcctacagttaacctttagaagatcgaaaggaattatacttatttaaaaggtgaccttaatatatacatatttcctttttatgctttatggcttgcatgcttaacagctttcttttaattgctgcatagaattactaagtgtgtagttaaaggtcaaacaaagtaagtcactgtagggtgaaactaacatatcagttacctagccatagctggatattttggcaacagtgatttggagttatcattttaatagatatattttaacataacagtgataatatagccattaagttcaaattgtataaacaactttttaaaggttttctgcttgggatcactactaaaagctaagaagtatgtttgtatcttcaatcagaactctgtttatttgtattataatgtataaacagagaacgtacatatatatttgcacatagtcattttgggtaatctttctcattataaatactgaatattaattatttatggtgtactagtgtatcttcatagatcaatagaatgcctttccaaactgtcacttaatgttttaaaatcatgattatttctttcttttaaatatcaaaatttccaaaaagttttcttgcttttgaagttttaactatccaatatctttttttatatatattggcaggctttaatagtgactggtttttcactggagatctgcagttttctaaagtctctttaaatgtattgttattagagtgaaatatattgatataggtgacactgatttgttttgtttcattattttaggtggttgaacagggtatgtttgtaaagcactgcaaagtagaagtatatctcacagaattgaagctatgtgaaaatggaaacatgaataatgttgtaactcgaagatttagcaaagctgacacaataggtaatgcaagatcctgtcttgtttttaatccattgctattagatatttaattagaattatctttgtatatgctacttggatgataaccattttaaggatttatatatagacatttgatttccagctttgatacaatgtcttagagttaaattatttattgtttcttgtatgcttttgcatttattaaatgaattttaacatttgtgctgttttgcttttttataaaacatcaaataattattgtttttatttagcaactggtgtgtcatttgtaacatagacctttaaataaaaacttaattaaaacttggtaaggtagcatggaaaatgacaattggttatttccttttttctcttagtttattctttggtactataaatacagtcaagtagccaaggcagcaggcttagcgttattttgacacattgatttttcaaattaatgagtagcgtaagcagttgtaagtcaaatataagtggacttaattctctctatatattaaaatatatataaattgttttctttctatttaaaagacacatttttaattttaggtaaagaatagattgaataaaatgttttttaaaataaatgattatgaatttaataaaaattacatggtttttgtttcataaaactcaagaatttttaaagtatttaatttcaaatgaagttgtaaaacaagattaatggtaataccattgatcttagaaaatacaaatgaacagtgaagaaggacacataacttgtagaacccagcttggaaacagattagccaatttatgaattatagcgtggcataagatttccttgttggaaccagtcattaaagtaaatgaaagtatttctgaatttcattaactgcatttggctttctttcaccacttacccacttcacagctggaaaatccttttaacccgtattttttatgaaatagtagcattattcaagtactcagtgcttggttaatcctaatgtttgcaccaaataaaatacagcattatgttatgaatctttattctcccctcttcatttagctagaacatttataagttcgagattaagtttcaataagctgatagttggccggacgcagtggctcacacctgtaatcccagcactttgggaggctcaggcgggtggatcgcctgaagtgaggagttcgagaccagcctggccaacatggtgaaaccccatctctactaaaagtacaaaaattagccgggtgtagtgggtgtgcgcctgtagtcccagctacttgggaggctgaggcaaaaaaattgcttgaaccgggaggtggaggttgcagtgggccgaaaccgtacctctgtactctagcctggcaacagagtgagactttatctcaaaaaaaaaaaaaaaagcccatagagtcatctttctaaaatgaatgcttaaaagataaggaatttcatatgtaagttttattataattattattacagataaattgcttgacttttgaatttccacatttgtagaatatattcaggaaaataagatatttctacatattaaaaacaaagttttcaacatatgaaaattattttaatcatatgaatatgtacatgagaagagtctataaatttaataagggtagtctgttaaaattaattcagagagtcgtctctgaagtttatagccaattggaatataaatgagaagctacctcttaaaataatgttttctagttatttttaaagtttggtattttcttctctccctgcctcattttgataggaaaattaaatatgagaccatcagagatattattttagaacattattatactaggtattttgaaactcaggaaaatcagcaactgatttaatttctgaattcaaaacaagaattatgggttctcatgataagaactgtgtaagaatttgtcacgaagatatgtaatttataaaggatcactgcttcaaaaagtttacaatctagcatagattttaatcaacatatatactaatactttaaaatgctagataaattggatatgtactttaacattatatatgaacccaatttttgcatagctataattttttactgtattaaatcattgtttttcaaactggattgttgatattttggtggttcattaaacagttttgggagtaaagaaaattgaatgggagatattagaatacaaaatatcaacatatatgtttatttcctgggtcacaatttcttactatagctcttagtttaaaaaatttgaaagtctgtggtagaatgagtcttcttcttaagcaaaaaggtttgcaaaaattagtcaagtcaggaattttagacacttcatggttatggttatagtacaggttaacagttgttgaatatttactatgttttaagcactttacaggaattttcttgtttgaagttaaacaagcaggtatcttcctcttatagataatgaagctgagatttagaatctacttcaattcaccctggtaccaagtggtagagctagtactttaacttcataagcagagctcttaaactagagtctcatctctcaattgctgccttacacaatctgtgtatgctaaaggaatattcgttttggagatattaactgggctgattttgtttttctaaaggaagtgggttttgaaacacagaatttacataaggaacttaagatggatatgtatttttcccttatggtcttttaagaaatcttgattgaaaatgattaaaatagctatgtatgtgaaatacagctgtataaattttatgaacagatttaggaaatataagtgtctgttttctcttgttaccaaattaataaaatattctgttttcagctagtactacctacactgatatatagtaaaaatgatagcaggccataggccatatctaaatgatttacctatcagggccaaaatcttctgccttcaaatgttttctgccaaaattgatatatttgagcattgagcatgtttaagtaagagataaaataatagttttattttcctttaagattaactaccaaaaacataaaacttcttgaaaaatatgatttaatttctatgacctgtattaatattttttaatttctaatttttgtgagtaacctgtattatttttctacctctgtatgcttttcattaactggctagtacagttgaattaatatgtggaaaaataagcacacactgtcagtcctttgaccattctcaacttcagtgatctcaaccatcagccaagctcagccaccaattattacagttaaaccctaggctgttgttatctgtaactgcacttgccagatctcaattttagcatcctgcattctggccaccactttctctgctcccattttctcttgagcccactacatgagacatcgaaacctaccactctgttggtactactactgtcatagtctctcatgaccttgccattgacaaatccagtggtaatatagaaatcttccattttcctgacctgccagcaaagtacaacacagataaactacttttctatctagaagcactttctcttcacttggcttcctgggcacagtttctcactggctgcatcttgttggagtcctttgtaaaaccttcttcatattctttatctcaaaatatcagtgtctccatattctcccagccctcctttccttggtgatttcttttgttctcctggctttaaatattttccatgtgttgatatcttttaagttgataggtcctgccctgaagtctcccataattccagtttgaactatcccatatcttcatttgtatatctgacaggcttctcaagaagactatcagatataaaactaagctccctttcccaaaaaaccttaggctctgtcattcttccttatctccataattcccacttctgctcttccaattgcttaggccaaaaatcatttctgattcttttatttctcacccttcatgtaatctagcagcatatcttcttagcaattccttcagaatttattctcagtcagaccacttaacactgcttccattgctaccactttggttaggattgttgcagtaacctagtttcccacctttgaccttgaattagtccattctcgcactgctataaagaactactggagactaggtaatttatgaagaaaagaggtttaattgacttacagttccataggccgtacaggaagcatggctagaaggcctcaggaaacttaacagtcatggtggaaggcaaaggggaagcaaccacatcttaccgtggcatagcaagagagagagagcaaagggggaagtgctacacactttcaaacaaccagatcacatgagaactcactcactgtcatgggaacagcaagggggaaatctgcccccatgatccagtcatctcccaccaggtgcctcctcaaacactggggattacaatttggcatgagatttgggtggggacacagagccaaaccttatcagaccttctgcagtgttcttcactaccagcaaaagtgaacatttaaaatgtcagtcatatcatgccacttctcttcccaactcctcaatagctttctcttttgctcagattaaaatataaatactttgataggtcacagaagtgtatataatcctacagaagtacctttatagtctcatttctacctcacttattctacttcagccacattgatgtatcaggctattctaaaacatgccaagcacatttgcacctcaaggcttttgcgttactacccctatgcctgtaatgttcccccatatgtaaattagatcacaaaactcaatgaagaggaaatttccacatttgtttataacatgttatgtacacagatgcctgtattaatagaaaaaacatctagaagaaatatcagaatgtcaacagtggttatatctaggtagacattttatttatatttgtcagtatttttggtatttttgccaaaagcaaaaattatttctgccctcaggaaacatttattcatttttatagaaagattaaaacagctcccttccttggcttcttcctttatcctctttctaggtaatgttttgtttcttgatcttggtgcaatttacatgggtgtgtccactttggaaatttatcacaagatactgatgattagtgcatgtttctgtatacatgttcactttaataaaaagaacaaaaagaaaaaaatacaaccctgccaaagtagaaagcagtactgataaggcttggctatgtgttcccacccaaatctcatgtcaaattgtaatcccccatgtgttggaggaggtgcctgctgggaggtgtttagatcatagaggcagatttcccccttgctgttcttgtgatagtgaatgagttctcatgagatacggttgtttgtgtgtagcacttcccccttcgcactctctcctgctcctccatgataagatgtgcttgcttccccttcgccttccaccatgattgtaagtttcctgaggcctcctagccatgcttcttgtacagcccatggaactgtaagtcaattaaacctcttttcttcataagttacccagtctcaggtagttctctatagcagtgtgagaacagactaatacaagtactaacagtatatttattttatgtaattatttaaatattctgggtgatttgctttaagttttgagataacgctgttgatattttgaattagtgcctttttttcctactgatttaatgcccttatcaaaaccttactgactacaagactattacaaaacattagctgctaagtagatagtattattggactaaattatgtaggatagatgtgggttttcatatttcttcggagaacgtatattattaagtttaatattttataaattttttcaaaactacaactattctaaaatctaaaagtattctgtattcatatatcataaaatattttgattactattttcttgagttgattaggcaagttattgaccagaactagatgaaatttcagtaaattgatttagaaatcagaaaaagacgtgactttactttgaaaatactaaattttggtgaatacagacatcccttcaaacaaggcactttcttttttattgtgtccatatattctagtgagctgttcagtttaatataaattatttttaaattgcttatgtggtacttaaaaaattttgcacactaaaaaaaatctgtaacatctcttaatcatactttaatttctaattcctacatctcctcagaaaatatttgaattatagtatgttaaaatttaaagtttatcctgtgtagcataaattgtattttagtgttaggtgattgaactcttaccttttgagattttaaattccccaagtaatttgttggagtacaaataccattttttccataaaaacttggtcttaaaaacccttttgttggtttgtgttttatagatttattacatatttagtcttgattttctattagtattttaaagaatttttgtgctggtaacatttagctgtatgtggtatattttgaaatacatactatatttatatatctttcctccttaaatctagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattgtttattttaagcatactgtattatacatgaaggtttttggattcacaaactttaataattatcctggcaatatataatgggctgtactgtttctggcttcctctttctaaactcatctcttgtctttccttgctggttactgactctgacttttgattccctccttgagcttgggaataatctacttgttaaaaagaaatcatttttaattagaaaaaaatcccagctaatattataaggtgggtcagcaaactttctgtgaaagaccaaatagtaaacatatatggagcatctcttatttacacagttctttattacaaattacagttctctgcaggccataaagtagcatctaaaacattgccattgtagtacacaaaaacaagcatagatgatacatgaataaatgagtatggctatgttctaataaagctatttatataaatgtgcagcaggctaagtgaactctagtttgccagcccttgttgaaaggtgtcagctcccaatttggcttttttgtttgtttgtttgagacggagtctcactctgttgcccaggctggagtgcagtgatgcaatctcggctcactgcaacctctgcttcccaagttgaagtgattctcctgcctcagcctcttgagtagctgggactgcagacatgtgccaccacacccagctaatttttgtgtttatagtagagatggggtttcatcatgttggccaggatgggccagaatggtctcgatctcttgacctcttgatctgcccgcctcagcctcccaaagtgctgggattacaggtgtgcgccaccgtgcccggccggtatttttttaataaagtattgagaaatgaagaggtttagtcactgtcagcaagtcctactgattctatcttctaactgtgtcttgaagtaatctctgtgctccattctcagcccttatctttcatagtctctttacaaattcctgtatctccaggctcttgtatgtctgttcaatctttcttcctttgtttttttgttattagcagataaccataggacagtcttgtttttgcaagaatactcattctaaaatgtaaacttcactgtcttcctttcataaacttttcctggttccttaataattaagtccaggcactttaagccagcatgcaagttatggtttaaccttgtacctactcttccaccatctctagattatctttgttttgtggtttatactcaagcagtaccaaactgagctgcttatagttccctgaacacactatgctattccatattcttgtgctttctgatgtgttattccatctgcctgatgatgtaaacgtctttggagtccctgtattcatccagcaaaaagtccttttaaccatccatataataaaattaaccatcccataccatcatgtaggccagccgtatcagattattcatccttcaggttctagctcaactgtcacatcatctattcagccttccctatttctctcaatgtccattgaggtataggatgtttctactttggagaaaagaattgcttccttaacttccacaaagatgtatgtatatttgttttgtatcgttcattatatgctttagttatttgtattttaatctccccagactatgaggtccttgttttggttagactttgtaccctatttttattttcagaacctaacatgcccggtgctctgataaatggaagatttttttgttttgtttaaaaattactgttaacatcaataatatgattctgagttgtggaaaaattcagataaagtgagggaaattaatttttagtaaatgcccactatatgtcaagaattgtactaggctgtcaaaatacagtggttttcagatttattttagtcattatattcttaagagaaatcttacaaaatccaatatgtattacagttaaaagggaaatgaagctgatagaagcttgaagtgtggaccttggaaatccactgattagccaacaccgcccttttatgtagccagctctctctttctgtcttccagtagacataacctctctccttggttttcatccattaggccttgaggtagctccaaaagtacaatttgaaatctatagaattctttatttaaaccttttcagcaatcctctgaaatgagtgttactcttttcatcgtgtacattagaaaactgagactcagagaagttaaataatttgatgttcttgataggtatgtatttatcagatggcagatgagaaaataatttaataagattaagtatccttaaggacttgacctttaaaaacaggaatgtttcaaagaatagtcattaaatttttcagactttataataattcttcagccagagaagataagtgacataaaccctctcctggacctttttttttttaatacttagattgaaagtatccttactagaaaataaaacaaagacatattattgaagagtttgcctcccaaaatgtgaagcatttcttctctcctttttgtgtgggtttaattttaattttgaaatcttttcaaaaatatttttatttggagttaaagttttaactataacaaaattttatgcagaaaatgatgcacttgaataaaggactgaattttaatctttctgatggtcttcagcattagtatttgtggtttttaaaacatggaattttaagtataaatactgttaggaattaaggcattatggttaaataattatattaaatgcataactttgaaatcttctatagctaaaatctcttgttttaaaactgatttaagtcctcaaatgattgtaaagtttatatgtatatttatacatatagttaatatgtaactgttactcttgtataaattgcagtaaagcaaaacattctggagaagtgaaaaatcactctctaaattctactttgtaaatcttcataaatttataaaactatatcagaatgaaaatcagaaaattgagacagtgattacttgtctctagtaggtagggagaggaaggtgatcaggaagggatcagtatattaggtacatggtacatttattttttatatggtacaaatacactttttaatgtgtgaaataatagattttttaaagctaactttaatattttaattagcatctcttttaacaacaagatttcatgaatttttttaaaatcaacattttattgttacatatactctgaaacatgcttacattttacatagctaggctctaaatgccaatttataaatgacctggaaacatatagttcacaaaaatatattactaagtgcatgtagagtagtttatgaaattgcaactttaagaaaaagacttaatgaaacagtaaatgaaatgtattcaaatttataatgccttggatttatttcacgtcatattgtctgtattacagtttttcaatggaaattgtagattttaactttttattggtattatcgtatatttcctttgctaatttaattatttttgctaagtttttcttctttgcacagactaatccatagcaaaaactagaaagacttattagactggacgatataaggaaagattttcgggtgttttaaaataaagtatagctctccctaagcctatactttttatttattagaggtgatttctgtctgcctcatccatgctgtaacagagaacttcagtctgattctcataaatgggactctatcatttgtatatttaaagattctataatttccattgtgataatgtaaatacacactaatttcaaaaccccaaataaattctacataatctgtaatttggaattatctgtgtcgcccttcgtctgcatttgcataaaaataagttacccaagatcctatgtaagtatgtttaacaactgcaaacatttattgaccatctgttatttacagagttctctgttcaacctacaaatacaaatagaaaatatattctctaaattcaaggaatttatattctgtttacttggtttaagttttcttatacttaatggaaccaatagtttctttacagtttatcttctaggattccttctcactatcattactgatttcttgttatttgaggtcttttagtctcacctgcctagctttggaatcgaaatgcagattacctgttcaccttgtctactgttttcctttaaataatcacagagttactttagtttcttagtttatccagctatcttctaaagttattttaacttcagagttatggaaaaacacccttttattgtgtcatatttgcaggtattagtgatagaacagaaaaatgaagatggaacatggccaaggggtccttctactcctaagtaagtgctcccacttcttatggcttattgtatgattttgaagcccttgatgctagataatcaaatccacaatgatagaagaacctagatgtgtattgcagaaattcatgccttgtttatatttgagtattttgttcttagtatacaagctatctaaatttgctcttaattaatatgttactattttaaaagcctccaattcaaatatcttaaggcatagtataaatgtatggtataaatgagaaagttgcgttgtctgatacagtcaaatcattaaacatttgtttaatttcttgaagctttttcgtggtttttaaaagtatcttaaaatatttctttatcaaaatgaatctgatgtgaaagtaatatatttattcaaatgaaaagttttagaataaaaaagaacaaatagaggtagaggagtatatgaggtatttttgagggtaaatgaaagaagaattaggaatctttttatctgttttagaactaatagatctacactccattatcaaaacacaaggccagttgtgtttaaatatacagacttctcaaagctctaagaagtaatatggtacatgtccctccattactgtaatgtttctgtttctgcaaaaggacacttctttataatcaaacacattaatattttttcagcaaatattcacactaagtgggataaataaggactataaatagcattatatcagttcaggttaggttgccaccaaatgaactgtgaaaaaatttttaagtttttggagctttggaatttcacatgttctgataagggattgtgaacatatattttgaaattcttaaaataatgatatttttaaaaaactaataacaatttagtacattttaaccaagtgaataaaaaaatctgctactttatttgatttaaaactacaatgccctccgggtgcagtggcacatccctgtaatcccagcactttgggaggcgaagacaggcagatcaagaggtcaggagtttaagaccagcctggccaacatggtgaaaccccatctctactaaaaatacaaaaattagccaggagtgatgatgcatccctgtaatcccagctactcgggaggctgatgcatgagaatcacttgaacccaggaggcagaggttgcagtgagctgagatcgtgctgctgtacttccagcctggccaacagaatgcgactttctccaaaaaataaataaatataaataaataaaataaaactacaatgtaccttttataagtggttttctatccttttttatcttacgtgaaatttttttttcccatttaaaaatatcatgagaaggcacctaaatatgttaattacatggaggtgatttttattcttaccctacttagttggatgcagtacaagggtagaacttagtataaaagtagaacttttaagaagatgttaatattaaaagcatgtgggttgaattatggagatttcataactgatgaaggtttagataggaatattttttgtgaacatttacttttagtcttcaaagcagaaccactgttgtttcctaaatgtttagattgctatgtacttgctatatctttaagttatttttgaaattacaaaattgtttgtggattaatattaaaaaaaacccatgagttctaaagattgagaaatcttttctacttaaaatgactgatttttgcccaaaagatgactaattttatattttcttttattccctaatagcacaatatcatttttatttattccaacaactttagtacttggctttgtgtgaaagaaaacagaattccctatgtaatacccaacacaccatactcatgcaataaatattggtgaatacaggtgctgtactagagatgacaaaagtacaattaagagtcctatttttcactggatctactagttgaataaggatgccatatactaaagcatagaaaagttaaatatccattccctataaaatctaagaaatactatgcagtaatatgtcataaattgccaaataataatttactgtaatacagaaaaagatctgcacctatgtatgaaaagattctcagaaaactaagaataaagggaaattctaacttgatacatcctgtgcacctcaagtctatagcaaaagttacatttcattgagaaattttgagcacaatttaagtaagaggagaagataagaaagaagaaataaagttcactattcgtatatgatatagtcatttgtataaaatccaaaacagcaaactactagaactgagaaaattcagcaaggttgtctaatataagattaatttataaaaagcagttgttttttctataccgagagatcagcaatcttttttaaatgttttcagctttgtgggccatatggtctctgtcataactataactgctgatgtagtatgaaagcagccttagacatcatgtcaagacatggcaatgcctgtgttccaataaagctttctttgtaagtagatggcaagcttggatttggcctgtgagccataaatttctaacccctgccatttatcatgagaaacccacttagaaaatagtctaacaaaaattaacttaattaaaaacgcataaaaccttcatgggaaaaaaaaaatctaagtttattagaaaataaaagattgttatgtgatatatggcttaacctagtaatgcctgttttctttaaagcacatcagtgtctcctgttcaaaattttttttttcctagaaacttgacaaattcattttaaagttagcatagaccaatacaggtccagaattagctgagtcagttttgacagaaagaggaaggaaggaacactagacctacaaggtaaatgagagttactgtaaaattatactaataaaaacaacataatgctagcaaaagaaaggcaaatagattggtataaactagtaatctcagaaagattcatgtatatttgacaacttggtatatgatgtggcacaactaggtagtgaggttgcttaaagaagatgattatttagatttagtaggagtactggctatttggaaaaaaaagctagatccctactttcaactttatatgcaaaggctaactcttgaaggattaaagacctaaataagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtatggtggtggacacctgtagtcccagctactcgggaggctgaggcaggagaatcacttgaacccaggaggcggaggtttccgtgagccaagatcgtgccactgcactccagcctcggtgacacagtgagactctatctgaaaataaataaataaataaatgtgaatagtagaaattttggagaataactacatcatagggatcatagaacataatgttcaaatttagtagatctgattacatcagaattaaagatttctgttaaaagaactatacacagagttaaaagtcagatgtcagctttggaacttttaaaacctaaagggaataatacctgtaatatattaagaactcctaaaagttaacagaaacaaagaacaatagcttttaaaaaaataggtaaaagatactaacagacaatttaaataaagggtagctaagtgctaacaggtagatgagaagatagacaaactcactagtaatcagaaaaaaatgaaagtaaatgagatacaatttttcacccatcaaaatgacaaatatttaaaagttttctgatgccaagtattgggtatggtgtagatatctgtgtacttacgatgtgagtgtaaactaatattgtcattctgtaaaccagtcaataattaaatcagaagtgtttaatccctctgacccagcactcagaggaatttttaaacagatctttgaggatataatctttgtagctgcatagtttgtagtagtggggatttggagatagcctagctaaatatccatcactggtaaatagagcaaataagaaaaatgaaatgggagtaacaatggtgagatctttaaaactagatgaaactttaaaacatacagttgagagaaagaaacaatgagattcataaatatttaagaaaatagaaaaagcacagtagaaggaaatcggagtagagataataggaggaaagaggaaacaagtttgaggaaatatcacttgctaaatttatttatattatatttctatagatgaagcaaggatgatacagattcttttttctggatgaagcctggcttgaaaaaaaaacaaatggggctgggcacagtggctcatgcctgtaatcctagcactttgggaggccgaggcaggcagatcatttgaggtcaggatttcaaaaccagcctgatcaacatggtgaaaccccatctctactaaaaatacaaaaattaggcatggtaacaggcgcctgtaaccccagctattcaggaggctgaggcaaggagaattgcttgaacccaggaggcagaggttgcagtgagccaagatcacaccactacaccccagcctgggtgatagagtgagactccatctcaaaaaaaaaaaaaaaaatagaatgcctctgtgttcattgaaaagcacattttaggctgagcaaggtggctcacacctgtaatcctagcattttgggaggccagaataggagtatcacttgagcccaggagttcaagacgactctgtgcaacataacaagaccccgtctctacaaaaaaaaaaaaacaaaaattagccagttatggtggcatgcacctgtagtctcagctactccagaagctggggtgggaagattgcatgagcccaggagttcaaggctgcaaagagctgtgatcacacaactgcactctagcctgtgcaaaagagtgagactctgtctccaaaaaggaaaaaaaaaaaaaaaaacagaaaagcatgttataagcacatgatgttagcttaggcaaatttaactccagcacagaacacgtaattttaagtccttaggaaggacttcaagatattaagatacagaacagtttatactcctcaaaattctcacatttgccagaagacaacccctggccttcaagatggcatgaaaatgctagttctgatatatatcactaacctggaatttgtccataatgttgcatagcacataaccagttcctagctagggtgtcaaacaccaaagaaagataattaaagctgtaatatggtgatagaaagaagaatcactggtagaatttattaaaacagtttcctgggccccatcctcagaatttcttattatgtctgggtgtggctcatttctaataagcttgcaggtcacaccaatgctgttggtctaaggatgacactcagaaattttgtaggtgatgtttattgacatttactaggtgaaccacatagtggcatccagggttcccaccccagaccagcaaaatataaatatagttagccaaggaatttgcattttaagtacttcatatgaacaagaaaatagaagaatattaccacaagtaggcacacgtgaaaccacatgttagtattttgtctgttctatactgctgaaaatagaggaacctacttagtgctctgatgtcctattgtattggccccattttgattagttttgaaactgtgtcttcagctgaagcataaatttttgggctccttgagaagaaatgctaaatattcaaaaaatgttaagggtaaaatttaatttaaaacatgtagtcatttagttacaaaaaaaatatgtgtatatgcttttaatcagcacctaaaacaactcaaagtctgtattagagatctaagaacctacccaaaaaatactcactcaaaagtcttctgttcaagcacagtggctcactcctatgatcccagcactttgggaggccaaggtgaacggatcacttgaggccaggagtttgagaccagcctggccaacatggtgaaaccccgtctccactaaaaatacaaaaattagccaggggtggtggcggcgcctgtagtcccagctactcgggaggctgaggccggagaatcacttgaatgctaaaggtgaaggttgcagtgagctgagatcgcgccagtgcactccactttgggtagcagagcaagactctgtctcaaaaagaaaaaaaaaaaaaaagttttctaactgaatttttctactagatatcaacaaagaatttgaaatttttatttttatgttcatgctgcatttttaacactacttgttttatcaggatttgcatttcttatctagtttttaagtttgatttcttaaacagcctcttaaaaacatgatcttttctaatgataccttagaaaaagttttcccccctagttttaaaaattctgtaaaatttcatttctttttttttaaggatgttagcattgggtggataatctagttgttctattgcagacgtgtagctagtaaaatcttggatttctaaaaaatgattttacagtggagtcattatagaaacctgggggttcctaaagagaaaatttgatttaaatttattcattttcattgattagtcaaaaagtattgtcaaaagatatgtgcttaagtattgggtggaaaaaaaataagagtcattgatgattttgaagaggtgatttttcttggactggaaaacatccagagaaaaatgtactatcgtccagaataggacatgagtggcagaaagaaaaatcaaatggaaaaccatgctaatagctcttactcatacactgtccctctgccatttgtggtgttctgattaagggaattccaaattgatgactgaaacactataaacttaatttcatgacacaatagtattttcacagcactgtcttcttgagtgctctgcttggagagaggaagaactttataaataaaaccattgcatactacttttttggttgagacagatagtaagcacttaggtgattctgcaatattctgtttttattttttttacactatcttaaacgtctttagaaatttttagagagtattcaatccctgtttgcatttataactgcgaagcagctaaatggatttggaaatgatgcatagactcatttggttaaaaattattaaaatacatgttggctgtagccattctttattccttgtcattcagccagttcatacatttcagtaacaccaatcttcaatttgaaatgcaatctgtgaaccataaatctagagtgatactccaaaatctataatttgttgttgttgttgttttaagacaggacctcactctcattacccaggctggaatgcagtggagcagtcacagctcactgtagcctcaaattcccaggctcaggtgatcctcccacctcagcctcccaagtagctgggactacaggcacaccaccacacctggctaatttttgggtttttttgttcttttgtttgtttgttttgttttgtttttataaagatggggtttcaccatgttgcccaggctggtctcctgggctcaagcagtctgcccacttcagcctcccaaagtgttgggattacaagtgtgagccaccatgcccagctgttatctttttaaaagacattttgaatccttaaatttccttttatgcctttttttatgttgttattctcattaagaaacagatgtagaatggtgttttctgagactttaaagttggaggtaatgaaatagccaaacaaaaatgcttaggttacaattaaagggaactgcagtatggagtactgagaactgcaggtatggagtcatattcctataaatgggaatataagcatatataaattatctaaccaaaaatgtagagacaacataccaaaaccttaaagagcatcctgaggtaatgaagaaggacagttggcatcaaatagaataatcatgaaggctcaggaaaacttgtgctgattaaaacaaaaaatcccttattttttagggatacatacatactgttgtgttttcaggtgaaattatgggtgtctagaatttgcttcaaactactccagcaaaagagggggtcggagggaagctgaagggattatagaaaaagtaagaatggtagaatgttaatttttgaataccatccttttgtagtggccatactaatcttctctgtatcgttccaattttggtatatgtgctgctgaagcgagcactagaatgttatttttaaagctaagtttctgatattaggtacatgagggttaatgtatgtttcaaaatttctgtaataaagtttaaaaatgggttgcaagttttggtgcttagattcataattggctgaaaaaattattgtaatttcatttatttaaaatggaacattttgtgttatcaaatattatatgtaaaagtaagcagtcaaaataaggaaaaatagagctatgaaaaacaatttatatatagtataaatctacttaaactctcttttgtgtatctttaagtacctaacaccctacctggcatataggaagcatacagtaaatgctgttgaactgaactaatctgtatcttacaacagtaaaagtgtttaattttttaggagatttagaattttctttttctttcagaacttgtcttagaatgttgattagaaatggagagtgtaatgttggtcttgttttagttactaagctaatttttgttttatgatgttaggttgtatgaagttacgttgttttacaatgttgggtttgaaaatataaaaatctttaaataactgttttgctgtctcaacgttcagacttaacttctctgtattttggttgcttaatatggtggtagatttccatgagtgttaaatgtttagttgacttactaaaagcaagttatgtttttctattgaagtaagaggctcaacttagccttgaattgcatgtttttagttgaaacatattgggcatagggaaattcagatactacaaacttccatttgtcaggagtaaggctgaattttctgtcttcatgaaaccacttcagctaaatggaagtcttacctttttctgtctgagggcacgatatgttacacctagcccaaactggccaaaattagtttaattctaggtaagtggtttgatgtctagttaatgtatgatattcttagcacttttttttctcctttttctagaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttagctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttgccacccattcaggatttaacaaagttcttatttgtctttcttttaacctagtttatttgacctgtctttagtatttctttttgataaccatcttctaaagaaattctctgaatttgaatgcatgatacgaccttttatgccaaggactttgcctctctgaccagtcctttgtctgtctagctcggttcctctttagggttgccacatttagttttgcaaattgtgcacagctctaggaggcatcattcatatcatatgtagtctatgtgataggccctccttggcacggtgcagtgcagcttcactaactgtttgcagcagctctactcagaccttaaatgcattgacattcactaaatttctgtcagaagacctcttttatcataccatagtaggtgttcaaaattaggtgattctatgctaatcctctcccccagctcaaactgacacaaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagttgca

SEQ ID NO: 2849 - DNA, 149381 bp, Homo sapiens; identical to SEQ ID NO: 2847
  source 1..149381: mol_type = genomic DNA

SEQ ID NO: 2850 - DNA, 6263 bp, Homo sapiens
  source 1..6263: mol_type = genomic DNA
gcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtacgggccggggcgttatggcatggcggggtgtgggggggcgcagagggaagactgctccagacccgagaggacactctccacaaaggcgcgtggggcccggcggggcctgggagaactgggctggagggacagcatccctggaccgcggggaatacgccgccggattccgtagccaatcagcggtctcggcctttctgccctcgaggggggcggacccggctaaagccctgctgtggtgggagaagtgcagagattaagggtcaaggagttgttcgtcctccatccccgactactgctttctgaacctcgacaccatgtcggaggtcggaggtgggggagggaatggatcgtaagtcacccatatagtctgcttcatttgcagcccagagaggcagggattcgaggatggagggctgtcttttgggctgttattcttgcatctacactaccatttggctagggtcttaagtgacccgaggcacatcctactttactagccgggtatggggtcccatgttacgttagagccgagataggagttatcactggcttttcagtaaagatgtgttctgcagggaggggtcgggagtatagaaagggtcaaagccatgggctgcttatctttcattcatttgtttacccaatagatactaagtatttactttgtaccaaacacgatgccaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtatggaatggggcaaagcaataagggaaaattagtgtggcagggttcagtacagcagcctgggttcccatttccccccatattcaaatgctgacactctcttctcctcccaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggtgaggacttgccacacacatggccttcatgcccatgttcctctgtgctttcctgccatcctctgccttttctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcagctagctgagcagaggagtaagtgggcaacaggtgggacagccatggctgagtccgtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatga

SEQ ID NO: 2851 - DNA, 6263 bp, Homo sapiens; identical to SEQ ID NO: 2850
  source 1..6263: mol_type = genomic DNA

SEQ ID NO: 2852 - DNA, 149882 bp, Homo sapiens
  source 1..149882: mol_type = genomic DNA
gcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaaggtgaggcgagtccgccagccggcgggccccacttctccttccgacgggctgtcctctcccgctgcggccgggcgccccggcctcgccgccgccgccttcccgggcttcctccccggtcacccccggcccctgcccatcgcctcgggggcgtcgcgcccagagcccagctgcgtgtgggaagcagagtgtagtttgcgggcttcaatccacttccttctgccgattgttttcccgtagcagacggtgccaggtattgagagcgaccctcacattcctacagtgctctgtgtggcatcttaatgaaactttattctctccccttaaatgagaaagaatagctagttgtcatcctttctgaaccgattttgtctttcaaaggtagtagtgtaccaggcctgctattttgcaaaacggtctccaccaaaatcgaattacctgcctcgcggggcaggcgtgttgaccaggtggactctagaagtaggtggtttgcttggtttcttttccttttaaggtttccctttcttcttcttcttttctgtttttttttttttttttttttttttcaatatagaaactgtccctaagagaggaaacctttctggccatgttattccaggaatcttttgtcccctaagtttgaccttgttctttcgttcaccctttactcttgcatcagtcacacattcaaatggtcactcactaaagaaaacaattaaaaaactgtttgtgaaactttatatctttaaagtgaatagagatcattctgctattttagattttgctttcagaatcttaagtgcactatcatggcttgcaccatgttctgaagagtagttggccatgatttaacttctttttttaatttttaatttgcgtgaaaagcattttgggcaaaagagtaaaccgtgccttagttgtgttggtattacggggacagttagggtttactgtgatcaaccaccagagttatgtttggtttatctgggtgagtaatgaatgccccaccctgttgtagatttggtgtagattgcaatattctacctgtgcttgactttagaataagacctgttctaaaatgggctgtctacatacagcctgctaaatttttgctttgagattatttttagaattttatgatactgctttaaagtaatcgaagatactcaagtttggaaagcaaggatagtgcattgttattttaggcacgttgggaaagttgtttttgagacttgtatgttagttgatattattggtaaagttagaaggatattgcacactgcactttatttacagtgaaataattcaagatttaataatgagaatttaaaagagtttccttcctaatcctccctattctattttgaataccttcaagttcaatttttaaagacttaaggcttaggaaagagcacatggtcatgtgaacgctaagcaatatttaatatgtatggtaccatttgtttataattgtcttcagtgttgaatattaaagtctgtttcaaagtgagaaataccaatttttcacttcctaagtttgaacaatgggaagaactttgtaagtttaggatttttttattttcatttgattttgactaaactgtattaaataactatgcaggctctattgtatggttcagaggttatgcataaaattgtagaatcaagaatcaagttaacgaaagtgatcttggctgtcgagtccaatttcctactttaatgaatcccctccacacacaaagggagtagtagttaattcaaaatattatcattatgatgctacttttagtatggctgtgttttagatcatttcattgttattggggattttttttagagaaacttttatacttccataatatttagattgttttacagaagaaacacttaaatgtgtttgctttccgtattaatacacgattactttgttactcatattagaactatttaaaaatatttatatggatacaagtaaaccatctacctcgataagttgacagatttaaatccgtcaagctagtaaccaggaagcggacttaaagctggtaactaggaagtgaacttcacacttagaagaaacaaaagtgaaagtctgtttttactcagacactttatgggttatctaaaaggagaggtgtgtagtgtatattgcatagccaacattttagccagttttcttctcaccttaaaaaactgtgtgtacatatgtgtttttaaattttaagtatttactatttaaaatttaagtatttactatttagctatattattttcaagatttttaaaacttttattttgcagatggatgtaagtttttttgttgtttgcagcaccacactacacaaaactttcatgattttttggttcgcctatagaattcattagtctttgtcacaatgtagtatgatgaggcaagaggctgcctttcccttttgatgtgttctttgcttgattgctggagtttggccaacccagggacttatgagatgtagtaaaactgcagaaagctgcttttctgaggtttaggtatttcaggtgaggtgcagttggcagcagatgagttaaattctgtgataattttggttttggacatatatcttcagcctttgtgcttcatgtttaccaaagtgtaggagccttagatctcagaaatttgatacatagattcaagttccaaatgaggatactccacggcgcccccccccccccccccaatctatctaacccgatgaaccaagctaggattctttagggcagttattattgggaggagttttgctcccagggaccaaattaatttacagagtgaaatgaacaggatactatttaattaaatgtatccttctgagttgaataaaatatattgtttcactctagggcttagaacagttctttacacatagtaggactcagcaaatatgtgatgaatgaaataagtgactggtttccaaaaggagtgtagtactttgtttcctaactgaatcttggaatttaaaaattattgagaaacaatgaggctgggcatggtggctcatgctttaatcccagcactttgggaggctgaggtgggaggatcacttgaagccaggagttcaaaaccagcctgggcaacaaaatgacacctgccaggagtggtgtctcaagcctgtaatcccagtactttgggaaggtgaggcaggcggatcacgaggtcaggagttcgagaccagcctgaccaacatggtgaaacccagtctctactactaaaaatacaaaaattagccaggcgtggtggcacatgcctgtaatcccagctactcaggagactgaggcaggagaatcgcttgaactcgggaggcggaggttgcagtgagccgagatcgcgccattgcactccagcctgggcgacagagcaagactccatgtcaaaaaaacaaaaaaccaaaacaaaacaatgaaagcttgaaaaactgtgcgtgctcatgctaggagaataggcagtggtactgaaagacaggatgtgggatagatctcaaccacctttttgtcaccttgggcaagtcattaagtgcttctgaaggttctttcaaagcagtaatattagtatgttaacagtagtatgttaaggctttaaactttagcaacttctttagattagattgtttaatggtcctaagcaagtgttctgtatagggagaataaaaaagaaacagtatagaatggaagcagaggaatctaacagatctacagtcaactttcactgaattcctccaaagatgagggttaggtgggaaggttgtcatagattagccaagttcaagagttaaaacttgaaaaacaatgcagactggattcagggtaaatttcttacttaaaataacatgtattttccaatttaggattatctaaggttataaaactataccatgcagcatttgatagttaacattacttaaatcactttaaatgttacttaaaggaggcattctttattaggaatcagttgattatcttattattagtataagacttgatttgggcagagaggtttccagctgtttattccttttcttattctttccttttcacacctacttttgacttgtagactcacattgtatccagtcttttaaatgaattcacatcatttctaataaatattctgttgattttcttcaatattatatgtatacagtccatatcctttacaaatacttaatattctgacctctttcttgtcattatttttaccacttattactttaagatgacagaatgctactacaatttatgttagtttctattatatattgtttccttataatatggaaattttcttacattcctaagttttataaatgtttcaaaactagatttagatgttgactgtcatgtctttttctttgcagtgaatgatattttatgtcagtaacataagaaccatttgtacatacgatatatgaatatttactatataatccgtgtaaggcgctgtgctgagccttcttacaaacttttttcatttaatctttccaaccaccttatgaagtgagtgctatttttctcctttcttattgaagctgaagaaacagtattggagaactaaagcaacatttcatctctagtatgtattaagggttggataaactcaaaagtcatgtgatacacaagcccctgctcttaaccacaatgttgtatcgttttggctgtccttgaattcctgataaaaccccatttggtcatgttgctttactattttaaatatgtttctatatttaatataataaatttaaacctagaatttggtatacaattggccttctgtatccacaggttctgaatccatagattcaaccagctgtggattgaaaatattctggaaaaaaaaagcattgttgcatctgtactgaacatgtacagtctcattttggtcattattccctaacaatacagtataacaactatttatgtagcatttacattgtgttaggtattataagtaatctagaaatgatttaaagtatgctggaggatgtgtggatgtgtaagttacatgcaagtattataccattttatataagggactttgacattcgcagattttggcctctgggggtcctggaaccagttctccttggattctttaatgagattgcttacaaggtttggtgtgcccatgagggctattaagataaggttagctcataaaatgattagaaggctttctgtgttttcctgtgcttttggaattgtttagtgtaggattatgttgagtcattcaaaattggtggtgtatgatcttttttgatttgaaaaattagatagcgttcaactgaggtacttgttactttgaagatttggtgaacatgactgtatcagggctgagctgctcatttagagcaaattttaggtaaagtttccaaattttgcttattgtcttttaaattttctatcttttctagggtcaaattttaaatttttttagttctagaaaattctaaatttcatttaggtttctgtatttattggtctaaagttttgtcctaaatctgtgtgtgtgtgtgtgtatgtgtgtgtgtgtgtgtgtgtatgtatgtacatatatatatatgtatgtagacatgccattttttttatccctgcttgttttgtcgtcagtagtgtttgccagatgctgatcttatttcctgcttttttttttgagacggggttttgctctctcacccaagctggagtgcaatggtgcaatctcagctcactgcaacttctgcctcccaggttcaagcaattctcctgcctcagccttctgagtagctgggactacaggtgtacaccaccacgcccagctactttttgtaattttactagagagagggtttcatcgtgttggccaggctggtcttaaactcctgaccccgagtgatcagcctgccttgggctcccgaagtactgggcagtttctctttgtatttctaatggattcaatccaaacttgtgtttttgtcttttagaatttaaccatgcacatgtggtgataactgataaatttaatctttttattgtcatctgattatccatttattagtcttgttttctccattcagttttgatggatagaccaaattttcattgtatcaccacccccacccttgtctttaacgttttcttttcaattttggctcttttaattttaaacaaatatatttttataatataaaattttgataatataaaacattaatagcttttttcggtaacataaaaaattaacttttttctccacccatttgccccaaattaggtaagacattttagcatgttttttcttatggtattcctagttttgttgggataatatagaattgtaattctaggtgatgaattttcttagtgttgcagatgcattattagtagctagttttttttaattaactatttaattttaactgtgttttttggtctgttgtataatgctttttgatggtttgatgccactctgctttttttttttttccagataagttaactctctgtgttaccttgtaagattttactctttgtttttaagagttcagaaatttcacttgcgtgtgtttatgtatgtatctttttaatggtcctgcctaggatttttcgtctgaaatctgtgttctcaggaatttttcttccactcttttcctcatcttcatttaaaactacattatttggattttatacgtcacttatctttcttcctggcttcaaatgtttcttctctcccattttgtcctgtatgctgtggtaactttttagtttgattatctagattattatttttgtaatgccagttctgtatttactacccttatatgtggtcagatagtttacaaagagtttgtttttaataatatatatttttagtttggttctgaagtacacataattgaattaattttgccaattttctcatgatcagctcttcctgcaaatatattttcatttatttgttaaattgcttattttaaataataaacacacacgaaccccctatttaaaacaaaagctggaacttcgataataacctatatcccttatcctatccctttactttcatttgagtgtatcatcttgaatcctctgttcatcttcctgttgatttattgcatctatatcaatggctgaaggtattttttttaatgttagttgttttaacttaaaaattttaagaacttttccctgctacaatatctagaaggtagtcgtctgtatttttaaccaagagttttaaagttatatttgcaacattttatactctttttcatctgtgcttgagttttgtatatggtgcgaggtagggatacagttttattttcatcatatacagattgaatctctcatatccaaaatgcttgggaccagaagtgttttggattttggacttttttttttttcccttcagattttggaatatttgtattttgcttacctgggttgggtaaatatccgaaatttgaaaatctgaaatctgaaataagccagtgagcatttcctttcaacatcttgttggttctcagaaaatatggagttttcaaattgtggagcatttcttatttctggcttggagttttgggatgtgcaacctgtaaatgattttaaaaagttcttttgttatccttgctttattgaaaagttaatgctctcttctactgaattgataggccatctttgtcatatatgcaaaagtttaatgcaaaatttttttccctttccttgactttcatcattcattttgtgaatatcatcctgtgttcattgttgttgctttaaaataatctctcatactggaaaagaaagttctttgcctttgttcctttttttcagaagtaacacttgacttttccttagaaattttagaatgatcataccaagctctctcaaatcctctgtctttttgattaatttgattgaatctgtagatccatttgggattattaagatctttatgatacaggatgagcaggatatactatttttattaggtcgtgtttaatatctcttgtatggtttataatttaacacaaaactattgtacatcttttgtttcaggtagttgataatttctgataactgttatatggcagtgcttttaaaaatttgttattggtgtatgcaaatgcagtggtcttttgtatgttaattttatacctagccaccttgctaaatgtttctaataccttttccagagacaattttgtactttctgtgtaaaagatcatatcattaagggaggagaccacgcctcatattgtcttatgcccaatttctgccctcaaagaaagaaaaagtaaaaactaaaaggcagaaatgaaatccacaagcagacagcccagggccacaccctgggcctggtagttaaagatcgacccctgacctaatcagttatgttatctatagattacagacattgcacagacactgtgaaaatcccgatactgttttgttcagatctaattaccggtgcatgcagcccccagtcacataccccctgcttgctcatttgatcatgaccctctcacacgcaccctcttagagttgtgagcccttaaaagggacaggaattgctcaccccgggagctcggctcttgagacaggagtcttgctgatgcccccagccgaataaaccccttcctcctttaactcggttctgaggagttttgtctgcggctcgtcctgctacatcatgattaaaaagttttatgtataatttcagtttttgtgcctgtactttcattttttttcctgtactagcaaatacttccaataaatattgattagaagtgataacaatgagtatttttttgttcttgctgatctaaaaaggcagttacctacttttgtacctcatgcatttctgaaatatttacatgtgttagttgtgcagatttacaaagtaggttctgtttaactaaaagatattgtagtattttcagtcgtgatgcttgcaggtattttttctttgggtactggtgacctttgtttaagctttcaccctaggtatcctgggtgtggtggtggaggggtgctggtagtttgtcagtctcttctctgtcatcctaggaactgtgaagtcaggcagggcactttttttttgtattagtggccctcactaatttccttctccaggggccactccacaattgatttctgccctgatgtgcttagagtaaggtgtctacagggtctttcttcccctgacactggcataattttactctctaatgtcatagaattgctttaagcactgacctgcagcagtggcctgcctttttcctacaatataatcactgatttttgttatgtttgaaggaccaaatttggcttgtgaaagtgagtttaggaatgtcactatataatgtgagcaagtagatgatgtgaaagttgaatttataaaaggatgaggccttgcatttattttggcagactttaattaatttccaaggacatcatccttgtcatgacatcttgttttatgtatgtagtaagtaatttttcagtttttctcttttttgccccttgattaactctgcttcagtacagaccatctgctttatttttagtttttggttctctgaactgctggatattttaaatgcccagcaatattttccttagtcttgttactataggtttagatcagtttcgtataatatggtttttatggactgtcttaattatctgtagtgcttgctaaaagtgcagacttctgtgcctcaccctagacgtattgtttcaagatgttgagggttgggctaaagcctgcttaataagaatcgcagattattcttctgcacttaatgtttgaggatcactggttgaagttaattagtattcttaaaggtaaaagtgccttgagcactgtgtaaattgactgcaggggtcctttagggattgaattatcacaatacaccaaatttaatatggaagcagggtctttgaacggacattgtttttttttgtttcaggtgtttctctccatcagtgcagcaacatgtttccttgtagaggagctgtctcctccctcaggcttttctggccaacatctctatggaaacccaaagcttcaggtggctaggtgggatacttgcccctcttactcctggaggcacaaataagttgaatcgatggattaaggagttggaaagtgattgtacatgctaaagttgtaatcttcctgtttctttctggctgtttttttttttttttttttttttttttttttttggtatgtgcgtgtgtatttgtgtatgaataattcctataggatttttttgtgggggctaaccatagcatatgaaaacttatgtacaacttaaatatattaagattagtattctttgtacaattttagacatgaaatagaatatcttattgtcctggaaatttcctttgttcctcattcatactgtccctcttttctacaccaccccccacccccacactactgctatcttgacttttttcaagttaatgttatcgtggtatgatttacactgaaagtgtgtaatttgatgaatttggccatacagaacatttctgtcactccacaaaatttgtcctgtatcacctttctcattaattatcaacaccgtcattatttcaggcaactgttgatctgatttttattactgtagatcagttttggctgttctgggtcttcacatcgatttgtttataccaaattttttttttttctcgcatctgactgcttttgctcagcaaaaagcttttgagattcacccatgttttattgcatgtatcaatatgtttctttttactatggagtaatattatataaatattctcacatctgtgtattcatgtaccttttgatgtacttttttttttttttccagttttttgacccatatataatgttatgtgtacatttgtaagcaggtctttgagacgtatttctatttctcttgggcaaatacataggtgtagaattgttatagtactaaattgttatccaaattgattgtatcattgtacattctcattagcaatataggagaatttcaggtggtctacatttttgccaacacctggcatttttaatcttttatgttttagccatttggtgaatatgtggtgtacctcattgtggtagtaattgtatatttccctaatgactaatgattttggatgtctttcaagtgcttgttggccagtttgaggatgattttttttaacattgcttctcatacattatccagttttaacactcctacacgataggaatcacagtagctgcattcttccaagtcttaaaatggcaaaaatgtcagagatgtagctaaaggtagaacactccaggaccaagtgctaatatgttcacaaaacaaattgagattgcacaattttttttgtttgcttgtttaaactaacacctgataaaaaggtacattgctgaaaaatgggaactcatttcttcatcatgcctcaaagtaaatattaaatttatctctttaacaattaattgcacacatacatgagaaatctttatgatacatattttattacaccgtgtacaaaaataatttcacattttagttgggttggaagtttgaaaagaacatagtgcagttgcaggggtgggatgaactgtggtgaggtaagtaaattggacagaaattgggcagaaagatacttcctttttttttttttttaacagttttttatctgtctgaagacagggaagaagaggaatctgaattggaaaacccccactatatctgttgggtttttgttgttgctgttcagtctggaaatgggtggtgtgtggtgagaggtcattaggtcatcagggcagaattgtttgcagagctgggagctacatcctcacggaagtgggatagatgtgctggggaggggtgtgcagagaggagccaggaatgatgtaccattagtggccagggcttgttatggtaacaccaatgttgaaaccaactgtgcattcacatatacaaaagttttgtgtcttaattcatgccagaatacatgcataatcaaatgtctcagttaaggtggagctacagaaacactgggctgaatgaagttctggggttttctttgtcttcgtgtgaggcctctgggctgggtctgggtgtctgatcaagaatgccctgaagttttcccatggggctttggagaacggctttggagctgggcagagctgaggatgagcacagaagaaaggaaacgagaaatggtccactacctgaggtttaaaatcctcaatttttggagggaagaagtgacacaagattttatcggtgccacttcaccagcaagaaacctctaaggccagcagtgcctctgcccaggctttgcttacactcactgggctcgctctgcctgctcggcccagcagggtgctctcagctgatccccagcccagatcccacgaccactgccactccgtgctcagcccatggcgggactgggtataccgcatgtggcttccacagctggactccagcattcagatgaggggaacgtggtggaacccagaaactcggagacggcagcaaccgtggagccccaagggggtgtcatagcttctgcctggggagtcccgaggtctgagccaccagggaatgccacagccctctcttgttcctgccgctcacagctccctgaatgggggtgtgttagagcttgtttattcctgctgcgcatggctttgtgaatgggggtgtattatggttctagttcgaggggtcctgatgtttgggcccccagaggggtcgcggctcatcactcccatattccagcaattgggagtgtgtaacagctcttttcatgcccactgcccacagctccaggagccagccaggtgcgtgttacagccgttctttgttcccaccgtttggcgagttctgggtttttgtccagtgaccaagaataatgaggtacgtggacaccagagagtgaggaaggcagagaagaatgttattgagcaacagaaaagctcttgacaatgagaggggacgtgaagtggatagccctctgtgtgagggggccccaaaagctggtagccatctttgcagttgagtccagggtttttttaggtttggaatgaggagatgtgggctggaggtagccttggaaaaggcaacattcaattggtttaaaagcattattcggaaagaaccaattgggaaagagtaggcaaaaagaaaagttttcactccagctgtggactctatctatatctagaacaggcagcttggtaggctttaaactgtctttggtttgaaggtcaggtttcaccagggacctgtccctgcctgcctaggagttggtctactgtggcgcctgcctaggaattggtctactgtggcgcctgcctaggaatttgtctactgtccctgcctgcctgggaatttgtctactgtggctatcagaaacagctctgcgcaggcctcctggggtcagtggacactctctttaccaattttggtagcatcatgcagatttgcagaactggcttctaggcttcttcccaagtgaggcaggaattgaagtcacttagaacagtggaacttacagaactgacagtgtttccattcttgctgggtggcgccaggaggagagcaccagtgtacctgagcatgtcgaactgtagcagagtagctgaaagcagcatataagatgaccctggtcagctctgtggtttctatggtgtaaagtgggtaggggtttcaggcctttggggttacagagatcagagccactccctcaggtcatggggtcctgtgctaggaggtgtggtcctagggctgtgtgaacattggtggggtttgccattactttatttttgtccatcttggtgttggcttaggcaaaccttagggtctgcgtttttttgttgttgttgttatttttgagacaaaggtctcaccgtgtcacccaggctggagtgcagtggtgcaatctggctcactgcaacctctgcctcctgggttcaagtgattgtcatgcctcagcatcccacatagctgggactacaggtacacgccaccaggcctggctaatttttatgacggggttttgccatgttggccaggctggtcttgaactcctgacctcaagtgatcttcctgtctcggcctcctagggtctgcagttttgttgttgttgttgttttggggcagagcttcgttcttgttgcccaggctggagtgcagtggtgtgatctcagctcacggcagcccccacctcccaggttcaagcgattctcctgccccaacctcctgagtagctgggactacaggtgcctgccaccacacccgtctaatttttgtatttttactagagatggggttttccatgttgtccaggcgagtcttgaactcctgacctcaggtgatccacctgcctcagcctcccaaagtgctgggattacaggcgtgagccaccgcaccccgccgggtctgccgcttttgaatgaaagtaaatgctcttccaagcatttcttgcatgagcagaagagtgtgtagaattctctcggtttgctgtctaaagcaagagggctgactgaccactttagggccacggcctccatccccgccacttcccctcccttcccctcccttcccactccttcttttcctgagtgctgatgttgttctgccttaagcttctaagcaggggcatcttttatggtcggggggagggaggtgtgggaggcaggcaggggatgttgcaggagagctactgataacccagggcctctgtcttttccttattgaccatttttatgtcttctttttaacatgttaagattatttcccaatttcttagttgggttatcttcttgctgttgagttgtaggaattctttatattttggttgtcttttatcatgtatatgtaattacaaatactttctcccaatgtgtggcttgtatttgcattttcttaacagtttctttgaagttgaagtattttaatattgattgtttaatttacttttatggttagtactttaaccattttctttttctttttcttttctttttttttttttttttttgtgacggaatttcactcttattgcccaggctggagtgcaatggcatgatctcactcactgcagcctccgcctccctgggttcaagcgattcttctgcctcagcctcctgagtagctgggattacaggcatgcaccaccacgctcagctaatttttgtatttttagtagagacagggtttcaccatgttggccagcctggtctcgaactcgcgacctcaggtgatccgcccgcctcggtctcccaaagtgctgggattacaggcgtgagccaccacgcccggctgctttaaccattttcttgaaacttagtttgtaaattttttctccctgtgttttgttctagaagttttgccattttaggtttacgatccatttggaattcatttctgtgtgtgttctgaggtgtcactaagtcaaggttcatttattgcatgtggaatctagtcccagcacctacttttgaaaaagctgtcctttcatcattgaattatattggtacctttatggaaaattaattgatcatgtatgagtgggtttatttttgaactcagttcctttctatccttatgtggtgccgttctttcttgattactgtggctttgaaatgtgccttgaagtgggtgaatgtaaattcttcaactttgttcttgttagaaatttgttttggctattctagaattttttgtatttccatatacaattctgaggtactttgaacagttggacaaagagccttctggggtttctgagtaggattgtgttggatgtatggattctttctgactgtttggacatctttacagtattttagcctttcaatccaagaacacatatatttctccatttatttaggttttgttttttaacggtttaaaggtctttgcatatcttttgttacagttgacttttttgatgctattgtaagtggtattttttatttttatttttattttttttgagacgcagtctcactttcactgcaaccgccgcctcccaggttcaagcgattctcctgcctcagcctccctagtagctgggactacaggtgtgtgccaccacacccggctaattttttgtatttttagtagagatggagtttcactgtgttatagccaggatagtcttgatctctggacagcatgatccaccagcctcggcctcccaaagtgctgggattacagttgtgagccactgcaccctgccagtggtttttagtttttattccaattgttttttgctggtatatagaatgtggttgatttttctgtatgaagcttgtatctgcgactttgcgaaattcacttattctaataaatgtatttaccacttttattcattttaaaaattgtgctttttggggtattctctaaaatgtttaatagaagtggtaatgacagacatctttgtcttgttcccgattttgtatggaaagcagtcttttactactaagtatggttttagttgttgcacttcttattttgttaaaaatgtgttattgttaatttatacttctagatatactacagcttaaccattctacagttaaactatttgtttatatatctttttatatatttatggtccactgtgattcttttctgtgaaattgacatttgtttctcttgcctgttttttcttttgggctatttatctttttctttatgatttgaggtagttctttatggtttagatactacttttgtttttctatttacaatagtccacgtttactctcatggaatgtgttccaagacccccagtggatgcctgaaactgtggctagtattgaaccatttatagagtatattttgaaagagactacattcacataacatactgtatatgttttcaaaatatttgaaatagtataccatatatagtatggttcagtactatatagaatatagtatatatagttttttcttatctatatatacctgtgataaagtttaatttataaattaggcactatataactatatagtacatatagtttttttcctatatatagtatctacctgtgataaagtttaatttataaattaggtaatttataaattagtagagactaacaacaataactagtaatgaaatagaacaactatgataatataatgttgtgtgaatgtagtctttttcaaaatatccgataactgagatggctgctgactactaagtgggtagtatacacagtgtggatatgttggacaaagggaagattcatgttgtgggtggcatggagtgagatttcattatgcacagcactcagtcagaatagtgcacaatttaaaacatcgtttctggaacttttcatatttttggactacgcttgatcattggtaactgaaacttcaaaaagtgaaacgagataaggggaaactactgtatatgttttgcaaatattttctgttttcacgatgtctttttattctctttatgtactttcatgagtagacatttttatttttaatttagtttcatgtataattagcttcctttaatatttgaacttccatgtcctgtttcacaaagatagtctcatttattgccctctaagtgttttcttaatttgtcttcatgcagggtttaagtttcattccacttgggtttgatttttgcatgttgtttgagtagatgtcagaatttttcccctctggagaaccagcgactttattgaacagttcctccttcccattaatactctgcctgacaacagtatgtatactttttaaattcttcagttgggaccattgtaaagaaaaacaggtgtcaggaactttcgcccttgaattaaaaaatatatttttgagacagagtcttgctctcttgcccaggctggagtgcagtggcataatcatagcctgcttcagcctcaaactcctggacccacactatcctccctcctcagcctcccaagtagctgggactacaggtgtgtaccatccacccagctactttttagttttttttttttttttttttttttttgtagagatggggtctcgctctgtttcccaggctggtcttgaattcctggtgttaagcaaacctttcactttggccttccaaagcattggcattacaggcatgagccactgtgctcagccaaattaaaatatttttattatggttttactgaaacttgtttaaatataaactaggcatacatttattatgttctgttgggtagctcttatgtaataagatgaaaaaccaactactaacttaaaggtaaccaaaactacaaaactggagaaattcagaataaaaaggttagcttaatttgacagatggcagtgttttgcagaagctaatttggcatttgtggcttcaactaaggaaatcggtatatgtatttcaggatattgtaatatgttaagcttttggaagtaaattttatttctgttgtcaactatactgcatttctgacttgatacctaattaataaccattattgtagagtgagtggtatttttggtctttttattgtaaaactgtaacagatatgctctcaagtgtgtttttttttttaatttttttttcttaagctatagctcagtaaatgccgatatttccatgttgaactgaacaggttgtgtgatttaatgtagagcaggatacacttgctgtgaataagaggtaacaattatagcttacctataagttagcgccaaataaatattcatcagaacttgtgagtactttgccttgtgtacatatttgagtgcctgggcaatcaagagagtgacatactatgcagcgtgataactgcttttgtagacattgtgaaatagtattcttatactgaagtaataattgtattctaaatattgctttattgctagtatgtgtttctgcttatctgtgggaattttccaaggtttgtctttgattttctgatttctttgcaagctttacctttgagagattatatattttccgagtcatatatgttcattactatcaagtatgtgtattgaaaataagtgtaatgttacatcttcacataaattctagttttaggttttcaattgcatgtgtacatttctgcttagtcatcactcagtatcatgaccgttcatttatgtattctttgttttaagcagactgagaaatagataacatacaaaaagcttttaaattggtagtggctagagccagaggtgcacagataatattgaaagttaaataaagtatttgtaggtagaactaagaggatctaggaagactaggaaagatcttataaaggaggtaatagctgaaataaactgttgaagatttgtaggcaggtcgaagtgttattccaagtaaagagaagtctatgagcaagggacaaatcttcaatgatttagtgccttctgttatctacacatggttttatttggctgagtgtgatataataataaatatttggtctttttcccttgttcctggcatggagcccctaaagcctttggaatttactctctagtctgtgctaatcagatgagtggcgtgggtctgggtgtttggggaggagaggctgtgtagcttccacttcagggtgggtactctttaccactgtagttagagggtgagaactttcaaccccagtccagcatccggggagggaagaggggctgcagattgagcccaatcaccaatggccaatgatttaatcaattatactttaatgaaatctccagtgccgtgtgtgtgtgtgtgtgtgtgtgtgtgtgtatgtttttttttttttttttttttttccttgagacagagtctcactctgttgcccaggctggtgtgtaggagtgaagtggcacaatcttggttcactgcaacctccgtctccctggttcaagcaattcttctgtcagcctcctgagtaggctggactacaggtgcatgccaccgcgcctggctaatttttgtatttttagtagagatggagtttcaccatattggtcaggctggtcttgatctcctgacctcaggtgatccacccgcgaaaggctcccaaagtgctgggattacaggcatgaacaattgtgcccgaccccttatatccttttaataagtgttcagtaaatagtagttctatgataatgctcagcgtatatggttaactttttcccctaattctttttttttttgagatagagtctcgctctgtcgcctaggctggagtgccgtggcgtgatcacggctcactgcaagctccgcctcccaggttcacaccattctcctacctcagcctccccagtagctgggactacaggtgcccgccaccacgtccggctaattttttgtatttttagtagagatggggtttcaccgtgttagccaggatggtctcaatctcctgaccttgtgatccgtctgcctccgcctccgcctccgcctcccaaagtgcttggattacaggcatgagccaccgcgcctggccctttttttctcttaaaactgtagaattatattattaatacactgttagtatacagaaattgttttcaaggaatttgtttcagggtccagtgaggacaaagaaaggacaaaaagtagaacaaaggagatttggtgtaaagaagtattgactaggaacagatgattggctgctagagggtaaagagaactctaaagtaagaaatgaatttgggagaggcccttcagaagccccaagactctgagagattgggttcttgttggagaggttgtgaatggagcccactggatggcagagcagtttatagaagtgctgtagcttgggacattcctgccagtagctcttttgaagtggtgtagagtatgtgctttatcgtatctagatgaatggagtttccaagagaccataggacatattatataagtaattagcatgaccaaaaactgtatttgctttaaagaattgtgacaaatataactgctaggaattatatagtattccagtttcagagttctacttagagcacgtttattttgttttattagtataagggagtttatttttggattataagctaattaggcaaacaagtacagaaactagagatgcataaagatttaattggacaagagagctataataggaatctgattattagcatcaacaagttaaatacatattttatttaaactgcagacatagtgatttaaggatatgatttgattcataaaagttttgtttacctacttgttttccagaatataggcactctaatttaaaaacagactgtgttccaaaagattttgcaagttgggtttttggaactgaaaatacatgttcccatagaaaccatgtttcctggtggtgtgttcttatttagaaatgtaactctgtgtgaacttagcttatagtgctgagtaacagtattttttgggagaaatacatttagagtttctactcatgatgtatttattttatctactaattaatagggatggggaatactcttttacattgtaattaaaaaaattttttttaagacagagatttgctcttgttgcgcaggttggagtacaatggtgcaatctcagctcactgcaacctccgccttctgggttcaagctattctcctgcctcagcctcccgattacagggattacaggcatgcgccaccacgcctggctaattttgtatttttggtagagatggggtttcaccatgttggtcaggatggtctcgaactcctgacctcaggtgatctgcctgcctcggcctcgcaaagtgttgggattacaggcgtgagccactgcaccctttttttttgagatggagtcgctgttgcccaggctggagtgcagtggcgtgatctcgactcactgcaacctccacctcccgggttcaagcaattctcctgcctcagcctcctgagtagctgggactacaggcgcctgccaccatgcctggctaatttttgtatttttagtagagactgggtttcaccatattggccaggctggtctcgaactcctgaccttgtgatccacccatcttggcctcccaaagtgctgggattacaggcgtgagccactgcacctggcccagatggggaatactcttaagggtcataaacatgatgcagatatggttgaaaggttgggtgacaggtaggaaaaaggactctgtggcaagggaggatggaaaccatcatttatctaggactaactatatccattgttctttgctagctatttctcataaagtatctcatttcttttttctggattgcatgaatgcttaatgttttagctctggaattctataaaaagtaggaagagacttaaaatttagaattcttggcatttttaagctttaatggaaagggtataccttcagatttatgtgcccatagaggtatatgagtaatttattttaatgctaaagtgctgttaatccaaaaagattgagaaaaacttcaatctgtgacagtaggatatgcagcatacctgaaccatttgttacccgccaaaaacttgaaaaccaggattagttgcctggtgagtaataaacaactcttcaagagaatgcaggttttggtcagtaggagttttactacttgtcacaaataaggagaatacttggagtattctttagggcattgttgcctctagggaaagtgacagggaggttttatggggtgatggagaggggagagggtgtgacatcacatgtagaggaggggtcccagtggtgcaaatgcagtgagtcactatgtcagcaggtaggtcacgtgttatggtaatgaagctgtagttcccccccagggtgctgactttagcatgataatgaggaaagttcacttgggttcatctgcatgttgcgagggtctgtcaggagctggctccaactgactaggtgagagctcattcctcacagggtttgggaaaaaacaggtggcaaggtaggaggttgtaaacaggccagttacttaagttgattaaattcctatagtcccgggggaccctccttgtctgcttacacattcatgggactgtcatatagattatttgcaatagggaatttcagtaatattatattttatacaaaccttcaagtgagattgacaggaccagaactgggaaattctagatggaatgtaggagtgtagaaagtttgcttagtaagtgggcctgacttatgtcatttagaagaattcttcaatttagaagaattagaaaatgtgcttattagttggcctgatatatgtatgcttctcgttcctgtatgagagggaaaaaaaaaaaaaggcttctctttacctttctaagttctttggctggactagaaattaaattgacaagaggcagattaacaggagaaaacccattttaattacataggtacttacaggagtcccacaaaataagagacttgaagaagggtcacatgattgaagcttatgtagcatccagagctacaaaaagtgataggggtttggggcttctgggaggggtggcaacacaagttatgagagggtgggggaggaaatgtatggtgaataaagggtgtcttgtgtagataaaaagtcactcaagtaataaaagttgttgcaaccctcttgctgatacagatactttttctaatgtagatttcctttaaaaatggattttttttcacaaaaggacagtttttcaaggttactcttgtgtccgcagtttctcaaaataactacctcaaaatatgccaaagaagtatatttttgggtggcatattctagtcgcctgcagtcttatttggaggtggtgtgtcctgagccccagcattcccatctccaataattagttagtgcctcttttctgtgggataagcttgtcttgtgatatggcttgttccagctcacatctgcaggctctgctgtattcatttattcagtcaatgttgattgcttgccatgtgccaggcattatatgtatgtaccaggagtacagtgatgaacgaattatggtctcattgataactttgaaatgattaacatttggtgcctagcagtgctttagtgcacgtgcttctgaagtttaagagttcttgtcgtctttggatttaccttgtgattaaccatagtgtattattataatttgtggtgagtctcacagaaggcacctacatgtgcagagacctttgcattatgaaggagaatggtgttctgtagaccctgaatgaaagagagggaagaggaatgccagggggaaagcaaagcaagttagtgctggggacagaggtagggactctagcatgcagaggtcctttaagctgtgaggactatactataggaaaattcctcagacaagtcatagaatattacagttgagggaaatgaaagatccggcttacacattaacaagaaaaacatgactcaggagattttttcttcttctttgctttctggctatttagagactggtttggacttacaaacatgaaggatgtgttatgtacttgaaattcttggacagtgagtattagaggtttcttatggtaagagaacatgagctagagcagtgtagtgttagcaggtagatgcagaggtttttgcaaaatcaggtgtgtgtgtgattactcactttaaagacagtataatgaattaatcttgtcattgacaggtaactttgaaatgcctacatttggtgcttagcagtgcgtgtgattctgaagtttaagaatgtctttggagtttctatcagttttttttttttcctctgttcttagaaaatttggaaggtttttttagaggtcattctaagagttgcgccccccgccttacacctatccccaaggatggaaacctttgactttcttttcctgaaccaagtttcatttatatttggaaatttagctgaaggagccaaggactgacttaatgagtcacccaccgcttaacacaaactgtttttctcctttgttgtcagtggtgctttagttttcttttaccattttataagtattttacatcaacataatagtggatttttgcactgagttttcattttttattgaatctttaatctccaatgttagatatcctagagttgagaaaatatggcaaggacatggaatttgaacgaccaagtttcaaccctgtctctgcacttactaatgtcttgaagtctgtgttagctatgaaatgagagtaactttctagagggtgtgtgggtatgtctgtattaaatgagagtatatattggaaacattggaaacagtctggtatagggaagtttaaaccttcactctgaaagttcgattaattgagtgctgaaataaactgacagtaaacagattagcaagagaaagtgcatacaaatttattgacatggaagcatgggtgggagctacaaaaaaaatatgaggctctaaaaagggccagatgattgaagcctgaatcccctcttcataaagggagaagtggaggatgcaggcaattttagaggaagagtaaatgatttcaaggggagatgagtgtgcctgaagagcagacaatgacctggaacaaaattcttccgggctctgggagagatggtggcaattttttgggaaggtgaggggcagaactgtactgcaaacaaaagttgtctttgttatatagataaagtctctgaggtaagaaatagcccttagaagaatagtcaaaagaataggtgaaaagtctgtctgggtatggtatgcccaggtgcatggcaatttttagttttctttcctgctataggagttaatcttctctggtttatatagattccagggaattatccaagacaatttcgttccttctggatgaacgtccctcagtcagataagggaacttcagagaaaacctctccctgtgctttggaagggaaaacggggaggcaggagaatgttggagagagaccttgcttctgagtcctttcaattgcttttgttcagagcactcagcaagccagaatgccatactttggggcattgttttcgtaacctcaacattgatatacagcaagagtataataaattcatattttcttgccttgtcttgggccagtgatccctttttttgcatcctcaaaaagttatactgatgttaaatatgccctctttactgaaacagattttaaaaatacccagcattaagtggggtcacctgagaagggaaagaatttctatgaaactctcaggtttttaatttatattgaaattaccaatatttccttatatctgaagtgcatagtactgtattttgcacatagtagacacttaaggatgttattgtgcagtaaaaataacaggaaggaatctgaagacttgtaggtaatcttgacttctttgcttattaatttttgtggtgtttgcaagtaactgaatctctttggacgttgcatcttgcccctttggtttagcagtgggaagaggttgaacccacctccctgtacttaactagagaaaaaaaatccatacaaggagcatctcagagcccagaagaggagctctagatatggaagtggattggatgggaaccaccttggatttggaattgctggtcagggagaggaccatatttaggacatttccagttgaggatcagggcgtatcacaggtcagaagtttcataaatgggaaggtacaaaccttgaaaaacagactagggtcttaatcacaacagaaatggcaacaaaacccccacataattgcaggaaatgaaggttcagggtttcaaatacaggaaaaacacaactggaagatgccagtaacaaagggaaaaaaactttgcaaatgaggtggcttctctaacttaaacttaggatttttctcattgctcacctcttcccatttctctctacctaggtttagctaagaaaattctttcactttttttgttttcttttccacctggccttctccccgatcaccagttcttttcattgtttcattttcagtcaagatttatgaaaacatgaaccatactagagatacacctgatttttttctaggatatttgtctgaatttatagtaaaagataaaacagcaaaataacagtttcaaagaccttgctcttctccataatatactcagtattcttattgcactttatcaaaccaccataacaaaccacctcaaaacccagtggcataccaaaatattgtcactcacactcacagatttgctggttggctgggttgacttttttcacatgtgcctcattcttcttaggcaagtgggctaccaagtcatgttcttcttaagcaggttgcagaagttcaactgggctagcccagcgatgcaggtagtttcatgtctgcttgcatgctggctgctaacatgccattggtcaaatcccatcatccatgacaaaaggaaatacatcatgtgtgaggaagtaaaagtggcaaagagtatgaatacagggatgggagaattgggaggctagcataggcagtgtaatcttttctgggatttatattcgtgtttgtattttactttgtggttattaatttgtgtatatactattttgtattctgctttagcgtaatgtgattttgtaaggaaaacttctgtatagattatatatttttcacttaaatagttgtatgtgtaactgagactctgcttctaagttgatctgcatcaaaatcatttgaagtgcttattaaaatgccgatccctagaccttaacccagaccctctggaatcaatctctggggatgaggcctggacatcttcattattagcaaactcatggagtcatccttctgtacattaaagtttgagaactactttcttaatggaaggacatgcatttgtattagtctgttctcacgctgctataaggacatacctgagactgagtgatatggttagcctttgtgtccccaaccacatctcatcttgaattgtagttcccataatccccatgtgtcatgggagggaccaggtggaaataattgaatcatgggggcagtttcccccatcctgttctcatgatagtgaataagtgtcacaagatctgatgattttataaagagcagttcccctgaagatgctctcttgcctgccaccatgtaagatgtgcctttgcccctccttcaccttcagccgtgattgtgaggccttcccagccatgtggaaccatgattctgttaaatctctttcctttataaattacccagtgtattagtctgttctcatgctgctaataaagacatacctgggactgggtaatttataaagaaaaagatatttaatagactcacagttccacattgtcagaggcctgacaatcatggcagaagggaaaggagaagcaacggtgcatcttacatggtggcaggcaagagagcatgtgcaggggaactttccttcacaaaaccatcagatctcataacccttaactcactatcacaagaacagcatgggaaaaacccgcccccatgattcaattaccttctaccaggtccctcccatgacacatgaggattatgggagctacaactcaatgtgaaatttgggtggggacacagccatttttaaatttttataattaatggccatcaacatttgtacaaatgactgatttccttgggtactaagtaatttttctctgagccatgattgaataattttcagttgaggaaaataatactttatatatgaaatcagatttggagtgctggtagcagtgacattacagacttataaaaattataaaggattttatattaactaaatgaagacattgaattgaataaagataatttctgtaaaacttttatgcctttaattcgtaatgttgggtattgcatggcttattcatgattccattgctatttattagtaattttctaaatgaaagtagtataaaccaaaaagtatcttaagacaagtctcaatcaatttagaaagtttattttgccagggttaagtacgtgcctgtgacacagcctcaggatgtcctgacaacatgtgtctaaggtggttggggtacagcttgcttttatacattttaaggatacataatatatcagtcaattcatgtaagattcacattggttcaatctggaagggagggacaactcaaggtctggtcacagggtggcttccaggtcatcggtagatttgaatatattctgattggcaattggttgagttattatcaatagaaaggaatgtctgggttaagataaggagttgtggagacctaggttttatcatgcaaatgaagcctccaagttgcaggctttagagagagtagactgataatgtttcttaccagacttaaggtctgtgtttatgttaatgctggagaggtatactgaggcatgtctaccccccacttccagtcatggcctgaaccagtctttcaggttaaattttagagtgccttgaagcttcagattttgtttttggtttacggtataaaaactgataggtttaaagataattttatttttctcaattcggctctgtaaatttggcagtttattcatccattttgatacttcctggcattttatatgactttgtttgtgtactttattatgtattttatttttaggtagcttggttatctcagctctgtaaaaccatttttatggaagtgaaattctttggtggcatggcagacactgccaatgcctatccaatgaacattcttttctttttgatagcagaaccctgatttcattttcacagcagcctttgcccacccaaaaaattcatttcccaatctcctttgcagctatgagtggccatgcaactgtgttgtgctttgtgaggcttttgtaagtggaagtttgtaggtggggcttgttaaagaagtctcattcatttgggagacaccttttgtcctttgcccttctctttatcctacctagaacttggacaggatgatggaggaggagaccatgcagtgacaaacattctgatgcatgttccactttaaagacttgatgttgggtgtccctactaggtctggactgcccattgtgtcttctaagttagaaaagaaagacactccagagtattgaagctgctgtttagttgggaatctgttacatgtagctgaatatagtttctatctaatacatatgatttctgtaaaagatacttgggctgcaatatctcttaaacctttcatgtaatttgtttaggactttttagacttctgaaaatacatattttatacataaattgtcaagcatgttttgaaatgcacattttacaatttgatgtcaacaaagctgaatgcagaacattttaaaactttttattttgaaatttcaaatttaaagttgcaagacttagtacacagaacttccataactttttttctccccaaaccatttgatagtaagttgcaggcatcatgcccctttagcacttaaattcttcaggatatatttcctaataaaaaagatactctcttactatactggagttatcaaattcaagaatttaatattaatgaaatgtcattactaagctgtgcatatttatatttctccggttgtctcaatatcctgcataacatttggtatgggatgcagtcagttccccctttggctcacatgcttctttagtctcctttagggtggagacttcacctgcttttcatggcatagacatttttgaagatgatagaataattatttttcacagtgtccttcagtttgggtttgtgtgatgcttcctcaagattagatttcggttgtgcattttcggcagggctatctcacagattatagagtgtcaggaggcacgcactgccattttatcctattattggtaatactaactttgatctcttggttaaggcagtgactgtcagggtttacactgttgttacagtaggtagctagtcagacatgagcagggcagaagggggcctcccccccaggaatgtcaggcaaccattaggcggtggtcaggctgttattaaccatctctctgaaataataattggtcgcagccggtgccagggaaaggcagtctcccaatagatagaaacacctgaaactggtgattagcaacttcctgataagattccaggatttgagtgaatgggctcaagcatatatgcactaagaggcaaaacggtggagtttaactgacatatgacctttgtttaggaacacccaactggtaagggaaaaacgccttaagtgagcacatgcacaatttcagtaaacacactgtgcgtgcagcccctccccagtgctggcaggccactgcacctgtggacagccatcctgtaggaggaatcaggggagaagaaatgcaaaccctggaagcatgccagtgtataaaaccccaagtcaaaggtcagctgttcacttgatctttcaagttgcccgcttggcccccttccaagtgtactttacttcctttcattcctgctctaaagctttttaataaactttcactcctgctctaaaaacttgccttgatgtctctctctgccctatgcgccttggtcaaattccttctgaggaagcaggaagtgagcttgctgtagacctgtacgggttcgccactgttaacacaataaagttattctttctccctttataatttgtggaagagaatttaaaatgatgtaaatattctgttcctgatcaaactttcattcagtagttttatcatccattgaagattcctgactgaattattgctgagataaatgtgaaacatctttttaaaaaagatttcaatagatcctattctattgactaggtttgcttttcctatcatatccattgtgattttttatttcatggtactgttctatagtgttgggaacttcaagaaatacagagatgtaaggaggaagttggtttttatttaagggccatcaggggagagtttgatagtgaaatcctatctctctacctcttttcccttccagtacaatgcagtcaattttataggccaatagcatataaagaactgaagcaaatgggggcaaatgatctattcaatttagaatcttttatgacagattggacagtgaaatgatcttctttttaaagtagatctgaagatctccgtggtataattacccaccgagttatgtcttgccgaaagcatgtcttttccaaaggtgtttctctccttgtgcttaccatcatggataaggccccttttcttgttaggtggcataaatgaggggatgaagaaaaggacagaaactgctaattcagtaagacttattggggagtaatgtagagaagttaccttttcgaaacgtgagaatgaaataagggttctccacagcatgattcattctttctaaaagaatgaagttgtttggcctttctcaagttctttttccttttttactctagtttactttattctgttttttgtttgttttggaaaaccaaaggtgatttgttttcttttcctagtatattttcagagttgagaatataatgattttgggtttttcctccctctagcaccagcagacgtttttgaatcaactgagagaaattacggggattaatgacacccagatactacagcaagccttgaaggtatggcctctgttttatgatatacagtttgtggtatatgctcatctctagtgcgtattatatttgatagttgattttttttttggggtataccatgtggtagttttagagatacaggaatggactttgtaaagtaaaatcctcagttaacacactgcggttttgaggatgttagctttcagcagtctgatgtccatgataccttagagtgacagataacctctttctatatatgaaatgctttttgtgcaagatagtgggatgtgaatcctaattctaatggatggttttacttacgagctgtgattttagagtttaaatgagggttcaaggtggggtgtattagaggatgaggtgtaagagaagggaaaagtagaaaattaatagaagtctgaaaacttacatttttcttctcctgagaagcagagatataaatttgcacccattcagctaattacaccctaagttaaacattcaatttcaaactcttcagtataggcaacaactaaaatgtatcattttggtcatatcttagttggaccttcagtttcacatcgacatccaaatgagtcatatcatatggatactcacattgaaaaagagtgaatgaaagctatttaagaaccagaactgtacagtattttaagcttatttgcatattactactataggctaaaaacaatatagcatttttgccactgcagtcatatacacagctccaatcctttggaacttgatttcaagcctagagttctttatttgtttttagaaataatctattagatgattataataaaagtcattataacaataagtagtaccgattaaacatttagtactaccaggcagtattttaagtactgtatgtgggctagctcatcctaataataaataactctatgagataagtattagtttcatcccctttatgaaaagatgagcaacagagaggttaaagtaacttgcccaggatcacacagcctgtatgtggagaagcttggaatagaaaccaaggcagcctgatcccaggtgccacacttaatttatgcttcttttactagaagctttgcttcaccttattcccccatcaggaaaatcatgaaatagtagtgtttagagcattaatgcggggtgtatgaagccactgtaagtatttggagaggaagcagaagtgctatacctcaatttttatgattatgacgtttagataattgctagtccctttttattctgataaatatcattactaaattccatgtttgttttcagaaactgcctttttcattatgtattactgagtgtgagaccatagcctatcaccttgccagggtaaatttggggaatttgcttttttttttttttttaaacttagaaaatatgtagctcgaatgaagtcttatccacatttcctttgatagaggttgtgtgagcataggtatttttaattttccaaaatttttgtttcagttaccagtagctaggggaaaagagtgtatttaaaccttaattgttgcccattataaatactgacgagaagtctacttttgagcactgtaatgtcattgattaatttcagtacttttaatttgagaacatatttttagctctaaaaagtaaatgaacttcaatttgtgtaaattcctgctgtgttgttttaaattattatatgaggtaatatatgaaaaacacttagcacatttcttggcatatagtaagtgctcaataaatgttagccatcattattgcgctttattttattgttagattacttatttaacaatagtgtatcttacattttggatgagtcacttaggaatcgtctaatgatcatgacagatagcatttttgaaagtggtggtgcctttgaaactgcatccttactccttttgtcactgactgctacaactggaattggggtaggtcttggggactttattctgccagctgctcagtccttaaattttggaatcatcctgatcctacttctgtcatgtcccacatttaataagatagcaataatattggatgctgtcttctgccctttctctcctctagtctattcttaatacatggagtaaactttttaaaatgtaagtcatactatgtcattcctttccaaaacactccactggcttcttattacacccgtgtgcatgtctaagttcttagggaacctacagagccttccatgttttggttttctgttacaaagatagcttcgttgtgaatatctgggtttcctatgttgttttggttaactgttttagagctaacgttttacttgctgtcagttgtgcagagaatataaagatgtaactgggcaagtctcttctcattttgctgttttaaattaaaattcttattctggcatctgctttcttctaaataaactttagaataattttattcagctatacttttgatgagaactatgcaaaatgtatctatttaatttgagcaggattgtcatcttgacagtattgagtatttctgtctagagttctgtgtgtctttccataattccatattatcaagcccttcagtacattttgccattttcttcccatgagtccttgacattttgcttaagtttgcccctaagtatgtatccagcacccagattaaaaggaatatcttttattgtccttgtttgtagaagtactaattttaatacccattttgcactctttcgtatggcaagttccagaagaccttttttagtttatttgttcaaaagtataagtttgtgattcacttttattaagcagataggaaagtaatgaagactaagaaattagagatggatttttacattgtatcagtagttttaattagtaagaaaggtattactattgatatagtatactttatgtatgatgcatttacactataaaattagaatcacatatagattaattgcaaatttaaagcaattttgttctagagagttatggagaatattgtataactttttttgatggataaaattatttcaaaacacttgatactcctttcttgatatttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaagtaagttttctttcttttcttattattttaatagaaacatactgaaaaacttttcttggtgtaatatattaatgttgcttaaggagaggtaaagaaccaaaaaagaactctattaaccttggttctttttaatgtagttgaaaggaacatacattatctttttcagattataaggaaaagattttatgtaagttatatagtttttcatagagcatttcatatagaatttattgttttgaaatatggaatagctgcagatatattcataaaaggaagaactagaatttttagtgggcacagttattttgcagattttaagtgctggtagaggctttagtatttcttttgaggttaaagtattatttctaattactgataggtttaccatttaataaaatttcccttccctttccccctgcttccaaataaagctttggcaaagaagtttattattgtgtaatgaaattgcctttcatccaaaagaaaaaaagaaaagaaaacttggaaaaagtgttttggagatacaaatacgtacatgtggaagattctatgtgggacttaagtttttcttcataatatgaatactttatacttatgtagcgcacagtttttcaaactatgttcagttaccttcatatctcattatagtttaataattgtactacataaaaatagttacttttatgccttatggatttgcaaagtttgattattaacatatatttggagagaatttcttattttgtttatagacattctcaaagttaggaagcaaccagaaaagagttcgtttacatagatgtttattaatgtttattgataaaatattttaatttttagttttcaggataatcttagcatttttgctacatagatgatcttgtgtcagagaaaactagaatactcctgtctcacttagttaataggtgatgggagaatgtttgtagcatatataagatagacctgtttacttaacgtctaagttcaaggcaagctgtgactgggcccccatccacatttctagcctcattttccactgttttcctcctgtcattcaacactgtgataatacagaatggcttgaagttctcatgtactcagtggtatttaatttctctgtctttacatttgctgttccttctgtttgaatgcactctggccttttcctccctagcctaatttgttctggtcttgaaagatttagctaaagagctgcttgctggagaatgtttttcctggcctctagctaggaccaagtgtttctccagcatccagggcatgcttctgtcttaatgaatactctgttattttgaaattatttgcttgaacattattggtgctcaaaaaatgttcactgagttatgtttgataatatgtgcagtaaagctctttcaaaaccaatgaaagggaatgaagttgagaagcttgttgcaaaaagttgaaagagaagtggtataaaggtcagaaaaatgagtacttaataatattttggatatttcaaagttccaagactcgaggggaaaaagaaactagatgggtgataaaagggaaaaggataattttgactaaaatgctcctggtttaagtgaagcaagcaggaaattgactaaacagagatcattgttgttagttgtgaactcttaatatagatggtatacttggtgacatgacatggtatatttatagaaaaggggaaaattaggattatgtgtgtcctgcacaaaagaagatatttgctgtgcaaagtgagaaaatactgcataaggcaaatggttacacctgtttacgattttagatagggaatagtgaaaatattatggaggacaaaaaaaaattttgaataggttcccttagggagaaggcagcctaatttcaggaggcacgtgtctcatttgctgataattaaaactttttttgtgtgtttgtggatctcttgaaaaatattcacgaggtaattttattttccacttgaaataatgtagagaaatgaagtttctgatgtcatctcaaccgattgtcatattgagtaaattgcttgctgttgtggtttctttatccataaaacacataatacgtaatatgtatcaagtgctttccctctaatcagggtgccaattgagatagtgtgtccataaagttggttagaggttattgacagcaaacagttgtaggaatttaatgtggcaattgtactatgatagtatcaaaccagaaaaaaattaactgttggcgtaacagtaatacttttccattaaacattcctgccagtagtgtcataatgcagtgttactggtttaaaactgagaaagtggggagatgtcatgcatttcagcaggtattaaaaaaatactctttaagtgactgtgcagttactgttgagaagaaatgaagtcgtgtatttttaattcttggaagatgtggtaaaacatgagggaaggaaagacaaaataattacaaatggatatacattcaaatgcaggcctctatttaaaaaaatctacctaactgctgtaggaatgtagaagaatagatcagagtgtgagttttcaagggattgttgtagatataaaaaccctttttgagcactttctccattttgtgtgaaatacattgttatttaaaggttgaccacagtttcacttaattctttcaaatatggcagggatttttattttcagtttttttccattcttctttttgaggtataaaatctcttaaaaccagggctaaagcagaaacaaagtcatgctaactttaagtgatacacttggttgcagtgctgacaaaacgtctgtcttctgaaatcgaaatctctaataccaaatacatatacctctttgttgatattagctggaatatcactgtttacaatggactgtttcttttagaaggaataaattttttttttgctgactagaaaaatttagtttttaaactaatatcacatggaagttatatttggggcatatggagaaatttttgtttatgcatacctggtgtgtcagaggctaaactatattatgtcactggatttgaaaaacaatttgtgagccttcctttaatattgaagaagtaaatatattttcaatagttagtaggacaattatatgcctttttggtgtactttttacctttcacttttgagagaaaaaggagacatatcaaagaaatcttgtgctctgcataaaaaagaatttagaagtcgtacacctcatgtctttacttgattacattccatactgtaattctgttgaattctggaaaaaagcccaaatcatttgtactataattagcaaacgtactaggtaacattttttattatttggacctctgttcagatcagatcaaatattatagattgtcaaatgagtgcctgttgtccctggcttaaattgagaataaaattgttttggagttttgctgtcaaaaacacaaatgaaaatgagaccaggacacgatacccggtattgagcattataggtgtgattaatagtcagaggagagattctgccaagtttttgtgtcacggcaaactctgtcatagacatgaccatacagctcttttgcccaatttgaagtctaatagtaatactttttattttgtgaccattaaattctttcgaacatttttaaaacaggaaaaaaacagtatatgctctccagaacaagatgtgctacaattgagcgatcaaaagataagagggatttgggtaggtaattttaacacagaaagtaatgccacatattgactcaagttttagagaaattggtataagacttgaaatgagtgacaggtggtaagactcttcaaaaatttataagccgttttttttttctttttttctaaaacaccttgaatttgaaaagatggcatagaaagggagaaaaaccttgaggttctatcctagaattctagttatggctatcttgcttggccacagtaatagtgatttaaactgtgataaatagatccaattctagtgcttttattcttaggataattctcttatgctaaacagtttaggatattgttaattgaacactgatacttttcccattgcccaagtaacttcagtttttccctagaaatttctaatatgtaaaacgatttttgatgactcacagaaagtcaagatgaagcctaaaaactgagatgctaaatggtgtgaaaattagttccaactgatgggtgcaattaggagcttcagattgattagatgcattttattagatatgaactgtagaatgacttgtataacttgatgaattttctttagttttgggttagaatgatagccatggtctttgtacttttgttgactaacatgggagattaattttactttttttcacaataaaaattgaaaaacatagtagaattaatgacaaaactctggaatgactcccttactacttactcattttccttgcttaccactgctgccactgtgattttagcagctattattaaaaacagaactagaccatttaaagctgagctgttcaatatagttgccactagtcacacatggcaattaaaatgaaataatattgaaattcagtttctcagttgcactttaaatgtttaattctggtggctaccagatcagtgcacataatgctacatttccattatcacagaaagttctaatttacaacactcttttaagagaatctgagtttaacagtgagaatattgaaagaataggaacatctgaaggaagctgaaagcaagggaaaatgggagagtggagtgggaaacaatttatattgtttatgtcttctggcttttaagattcttgcaacatgataccttactatgctgtctgccctttcacttgaaaaaattttgaatatataaaagatatgttctcatcttctaattagtgccattatgaagatgactcaccagtttttatctctattctgtatttctttaacaaatatttattgtctaatatgtagcaagtacttttatagaccattaagaaagcatgcagagcctcagtttacatagaggaaagacagtacacagtaaacaaacagtatcagatagtaataagtcgttcatgaagaacagtagacctggatatagacaaagaagtgatgggggtgtgcttgtgggctgggcataggataatatgtgattttaggtagtgtggaagagctcatatttgaggaacagtagacctggacatagacaaacaagtgatgggggtgtgcttgtgggctgggcataggataatatgtgattttaggtagtgtggaagagctcgtatttgtacagatacctgagcgaagtgtgagcatgaacttttggctctctgaaggttgtgcgtcccagaccagggcctgatggggcagtgtgctggccctcgagatgaatagtgaggacacagccttgttgaagctgaatgagcgagggtaggaatggcagtattctcgtttctgatctcttgctgcacatcctgatgttcatatttgcctttctttcttaagggtatttccattcttctggtggtccagggtattttttttttctttttttttccttttaatagctcttctgtcaatctcccaaaacaaccatttggtttgcagatctgtcagtttttgtatgtagacttttcccttcagttactcctgccctgctacatattcttattgcaacgcttctcaaactcttcactacccagtttttttctgtcttgcactcccttgcttagaaatctttgctgacagtaaatataaacttggcttattttttttaaaaaaagtatttcctcttggtttagcctgtgtagataaggaaaaacaatggaagaactctttttttcttctgaattcaaaatatttacatatataatagttcagctagattatgggccaactaggcttttgtgaacttacttagaaacctgaggttcaagtaagattcacttacataattcacgttcctatttaatataatattttcatgggaaagtgaattatgagttataaacaatgcatatattttgtttgaagtctagttcattgataagttgatgactagcatatattttggagttagcagagaaatgtttggtagttggtgtataagttttactcatggtattcctttgtaagtgaaagatttagtaggatgagtatcacgttttgatatatatttctcactttacaggaaaaatgttttaatttggactctcataaaaatgtagattactgcttagatgcatttgtaacatgattttatacagtggcacccagctaactgttcccatgtgtgtgctgttgaattgtattcacgctaatactagagggagagttggttaaaaataatgtttttagtgttttaccaaggtcttgccttgacacagatatgagaatattaataatgctctggcattgagatggaagttttacaaaggctaattttctgtaactgacttttaccagttagaagttgtttatagccaaagttattctgtttcttttgtaagcatgtgagaatatctgagcgctagtttttattataaattgataattcgttacatgttttacacaaatcattattccactaagtccagaaaaagaataaattgggtttaaccagtctgttgaaataacattttattttcttttactggtcttaaaatcatgtgaatttggtatgtgaggtatctttcaggattgcatttgatatgtgaggcatctttcaggattgtatgtgtggaccgtatgtgagggatctttcaggattcagctatctttcaggattgtcatattgttctaaaataccctgtgaaaagaagcagttttatggattaataggaagatcatggaagaaaattgttacaattacaatgaaattaaaataataagtaaacctcctccattgcttaaaggaaaaagtcccagcttttcagttaaggattgttagtctctggtctcaaccaacttttccagcattaaggactactattcctctataccagggattggaggctcaaattcccagctggggtacaggtgtgcctatatgctgaaccctccgctattggagatgcctggagtggctggagccatttaatatggtcgttctagccacaagcagctttattcttttacacccatgtgaggtacaagatatgcgaggatgcaagggcaaggaaggtaatgtgaatgtgtgtggctggccaagttgggggcgggggcaaaatgaagagtgaatattctatctaaagagagctgctactactacttttattacactctggctttgtcacaatgattattgccatgcaggaatcgtgtaaccaggtcttctggtttttttttttcctcccagagcgtgagggaagtaatacctattattgtacacatacaatctcctaatctttatcttttgccagttatttcaaaaaattttgaatgacattgtaaaaaccaaagaaaaccattttcaattatgatttgtttcataaaaaacatgtctaagaacatggagtagatggtgattcttgttatttttgctctcaggacccctttacactcataaaaattattgagaacctcagagcttttgggtacataaaatttactattttagaaattaaaacggagaaaagcttaggctattagttcatattaaaatgtcagtctattatgtttgaataacatattttatgaaaaacacatttgctgaaacaaaatggttagaagattacgttgctttacattgttgcaagtcttgaatgtctgccatattagaggagaactagagtctccaatgtgcttctgaaggtttgcattctattgcaataagttgttttggttgaagtttgtgaagaaaatctggctttacccagataataatttagaaaagggaggagtattttaactgataatcagataataatggatattctttttaatgctatacccaaacttaacagatggtaatttcttaaagattagttgcaatgtggaattcgaaatcacatcagttattctatggtggtatcaacaaccttttcatgttatgttgcattaaaatccattagtgtttcttgctttttggatggatcttttacccatgcatgagtttgtaacactgtgcattggtaatttgaaaagatttctttttaaatgcttgaagaatgtctactataagaaaaagttgaatttgttaatatcaccactcatatacaagcctttaagtattgagaagatatcaagctcacagtggtagaaacaagtttttcaaagtttagatttttgcttgaaaattccatattaatcattgtcaacagatacatttgttttccttaaagcaacaggctcacttttttttttccagacaacatctgccaaatactgaagtctgaataattctagtttgtagtttgttagtttttcttttaaataaaaattgcattccatgggaaaaatcagtttagcttgtaactcattttacactagttgttagcaacagcatactctggatatatcgcagaagtactttatgtgtacttcttatgttagaattaaacataaatcaaggtttgaggtttaataaaattaggtttaatcttttcgccaagaacataattctaaaagaaactggcttggcttctgtttaaaacagtgagtgtgtatatttgtgactaatacaatgaattatgcaacttggtgctgctgccttgatttgtgctaagatgcagcagttttattcaatatcgttttgcatcattggtgcaaatgtggctacagtacaaaaggcaaataatatctgagtagtattatttttttatttaaggactttcctcccttttttcaaaggggccctggggaccccaaggatcaatggaccatatttgaagaactgctagtaaggcagaaagaccactggatttaagagttagaagacttaaattttgaagcctgtgcaccattctcgcgtcttatgatgtgcttcatttctcagaatttcagtgatttcatttataaaatatatttggggaaaaaacatcttgttttttgcttttttgttgcttgaattacaattgatgaattaggaaaagctgtaagtgtaagttgttgctatttttaaattagtttcggctatagcccatttgttttacttgtcagtcatgatacagtaaacattctagaaattttcaaataaggaatttaatacaggggattaggttctttaaaaaatcactggaaggactggaggaaagctctagctcagacttctgaaatgactcccacatcattgcaggactgaccagtcagggaagcgaccagtcagggaagcggctacttctgtcacaattaggaaagcggcctcttggactactgagttcaagaacatacttctatagctgcagcccaggaaacaggaagccaggattaggtactgcctctgagctatgcctggaaattggaatgcaaagtctagttgccgcttatattccatctcttgacattcttaaagctggaaattggagcctggaatactgtggaacaacttaaatcttttcaatcaagctagagaaaacagccaaaggcaacaggataatggttgccacccccccccccccccgcccccgctgcactctgccttccatgtctcgtgttagtgcattctaatggatgaggcctaagtttcatccaaaaccctaactgccagtgaataaggaagatagtttttctgtttttttttatgtttagtttctataattgaagaaagtaaacttaagagaacgagttaatggaatctgaccgctaattaatcacacacctaaaccctgtttttctgcttctctgtgattttcaaattttttccacttttcattatcctttctctacttagacctaagttctagccattttaataaccaagatagctttcatttttatgaggcattccatacctttttaatcctcactgcttcatcagtgtttatgaatgttcagttctgggttacactcatcttcagctgtggtctgggtggacttggattttgtaaccagacttgtaaaacctttggcctgctgttgcctgtaaagtgattcaccatttcaattactatgctatataaatctttcacattttacttgcctgtatttttggggggccctacttaatacacttttgtgaggttttattatactctctaaagacattaaaaaaaacaccaccacttccttccatgatcaggtattctttctcatattttaaatcttcttacaagctactatttggagaacgtgtggataaaaatagaagtagactctggaaaatatcaatatacattactttttttcattaaatatataatatgcttttctagtatttatgtaaaaccttatagccatatggtaaaataaagccaccttatcctccccatcctctatcctgtttgttttttttttcctcttctaaaattgtatgattacaaagaaaatatttttaacatgtctaaaatacaccaacctgggcaagacgcaaaaccttgtatctacaaaaaattaaaaagaaaattagccaagtggtgcatgcctgtagtcctagctactctggaggttggggcgggaggatcactggagctcaggagtttgagattgcagtgagctgtgatcatgccactgccctctagcctgggtgacacagtgagacactgtctctaaaaaataaaatttaaaataagcaaataactaaaatgaaggcaaaacgtgtccaaaatacaaataagcataatcccaaccatgcaaagataataacagatagtttctctttctgatcatattattttgtaacctgttaccacttccctacttagcaatataccatggtttctatcactgttgaaatgataatgggagtatttatcattggcatcatctgggttagggaaattgaccaatatatattgggaaattggattaaaagtcatttttattgaaggcggtattagttgtaaccttttttggaaaaagaattaatacttaatagcatcaaggctattttttattagaagagggcttgtttcattcacttgtatatttcatttttgtgaaatgagaatcttgttttaaattaaaaggactgcatatttattaagcaattcagattgtatagaagtatttaaatagaaagtgaaagattcttatacttcttcctcctataactcctttcctcagagttaaccactgttaatagtttggcacattctttcagaatttaaaaaatgtatgtgtaaatgtacatctctggttagtttctgaaacatcagtttttaagagttcactgttaattattgtaatttgataatgtctagatggtagtagtatggacagaatttaatacgtatgtaatcgggttaacttcagaaagcagaaatgtcaatgtttaattgtattgatttcaatttttgttgataaaccattctcagcagtctttctgcttattagcttttaataagagacctcatagtaaatacagagattcttctacagtgaaatatatttctgcttactgctttaggtatattttatcaaaaaaatcattgagttactgagtatgaccagttaaaaatatgtttgcatttatttttagataggcttttagaaatacaaaattagttggtactgactggtttaaagagtatattggatataaaatctccataataaaaatcctttcattttgttttacttttaattttgagaaagatagttttgcttttcagatgtgattgatctcactggagatgataaagatgatcttcagagagcaattgccttgagtttggccgaatcaaacagggcattcagggagactggaataactgatgaggaacaagccattagcaggtaaaaacataatttgtataaagcagatataagtacttttaaaaatagaaatcattaattgggttaaattaattttaagaggtaataagatatactttgttactctaaactagtaatatgcttgtgtatttttaaattttatgtaaccaaaatcttcatatttagttttgattgcaattgggtttagatttttaagattttgggatggtgttatgagggattacatttaggtgcatattttaatatttctttcattttttttcttcccctaatcttttttggatgcactgtccaatttgcaacaatttatagcaagggtcagcatcctttttctgtaaagggctaatagtaaatatttttggctttgttggctatagggtttctgttatagctattcagctctggtgtcataacgcaaaagcagctatagctgataaataatataatgagcttggctgtatcctaataaatcttgatttacaaaggcagccagttggttttgtcctctcggctgtggtttgctgacttctgatctatagcatgataatatgtttatatatattgttcaaataaatgggcagggctccaagatgtgtgctagaatgcagtttttcatttaataaccaaaactttgtagtttgaaacagtttgattcatctaaggactaaaaaatacatttggttttcataatacctctaaaaatggagatataataatttaataagccataaagttgtaactaactgtaatcctctaaacaactatttgaaggcagtggtaactctatgttactgaagaagaaatttacttgcaagaggttaaatgtgctttttccaaaggcacacagctcagatgcatcttaagacttaaatgttcttttcctttaacatagtcctttggtaacagaatgtaccaaatttctcaggtaatttttcttggcacaatatcaataggagatttctttccaaataatcagagattactatatggtaggaaatgtttcaaaatgctatgtttagcaaaggcatataattttttatcttagtgcgactttttaatgtctttaaatgttactttggaaactactttgtaagacattatattatgtaaagacttaattaaactctattgtccccctcattagttgtggctaatatttattgccaggaactttaaatgaaaaccaaaaaatacgtagttaggcttattttctgaagcatttgagaaattatatgaattgggctttttctttttaaaacgtgtattgcaatgcataattgtcttgaataattatgaaacaacaatacttaaactttgagaaatattttaaatacaaaacacatgagttggatttcatatgtaaggggcatggttttatgtgaaaagggttataaaaagaatgtatacttgatacaaatattatttttaaaattatatttttgtttatatgaatttatatgagtatatgaatataaaatatatgtgagcttatatacccaattagtatcagtcgttctattatgtgttttctaattaaaacaacaggtactaattatataataaaagtaaggtaatataaaaagggatgaaggctgttcctaatttgatattcagttcaatgtatatgttatattattgttttggatagttgtttttatccaaaatggcaaaagaaaatctcttcagataatgctgttttttcattctaggtcttttacattttaatataatttaaaaatagtaaatatttggtagatattattattgtagatgacatagagattcggcataatgtaacatgccataaagctatgctccctagaagtaaaagagtcatattaattatgtgtaaattcaataacccgcaatgagcaaatgggtgttcaatgcaaaatatgcatttaataaacttatatgtaaatcatattgtattaggaaaagaggatgtggagagttctagctaaacattatcagagatatatttgctcatatgggtttattaaggtatagaactctaaattcaaaagagaaaatgatgcattttaaaggaagacatttatatattatgcttaaaagtaaattaactccttcttcattactgaagttgatatagggaaaatctttgcaaataaaattccagaatcatttgcttattatattttagtagacataatttaatgtgaagttacacattaggatactacattgtgtgtaatttgatgagataaagcctgtctttttacgtcttagaatcctgtgtttaggcatttatacgtttcatgctaaaattttttaagtagaacgtttttaaagtatttctttatacactttttagtgtcagaattgggtgtatttattatctcttgattatcactgccaggacacaagtggagtatggacagttgaaatttgttaataaactacattgtgactggtttgtgtctatggcatatttcttgtgaaaatggcttgcctcatgaaataactttgaagtgcctcattagaagatagtgctaagttttctagctaaaattgttacaaagagcacgcaccttcaacaatttcaagaagtagtagactacagattctttttttcctcattacttctgtgtttcaactagttatttcttgttatcttcagcctggagttgccattggggaaagaaagaaggatcatgtccaggaatagtcagggtggaattctgaattattaaaataggtctgtataactcctacattttttatccttatcattactgaggaagcagctgtgaaggggaactgtctaaagatggtgtgtgaaacaggagtggatgagggaggcagagttagaaatcttttaaaattgatctttgaggaggatttcggtgctcaataattccagatacttgtggatgctaaggagcatggaagggccatcgaataaccatcaaaccatttaaggtgtgttatgtcagattatagatgatctggaaaagtaagaaatatgacacagattagtttcctgggctacaaggttgtggctgcaggtgactgatgaacagcagcagtgtaacttgaaaaagtatcagcaacagtgaggtaccactgatatccccaggaagagggatcaactggtcgatgtagtcaggctgtccgtgtggcaggagccacaccccatgcaatgtgggctctcctacggccagatacacaggtcaacttttggtaggaatcacatgtctgacaagtagtggtagcttctgtgttagaaacgtagagttccttaatttgtactctgtatacgattgtggatgtgattccattttgggtattgtgattgtggcagtggtggtgatctgggttgtgcaagtttgatcaaaagctttattctgttcatctcattgaagaacacattagagcactcatccatcacaatggctaaaattaaaaagactgatgggaagtgatgtcagcaagatcgccaactagagttgcttggctatcatttccctcacaaaaaaggaaccaaaacaacgaataagtttattttgtctggagtgactgaggaaatgccctggagagtaccaagagaacagcaaagtccctgtggagcatagagtcaagaatagctccacagggaggagaccaaagtatcctgcctctgccatactgtctcccctgcgaggattgaatcaaagccagggggttcctcttcttataggaagaaggtaagcggagaatcatcagtcctcatcaccaccacaggtgccagcagtcactgctacaagagagttccccagtcctcacaggtcccaagtccagcatgaacagttgctgaaagtgcatgtggctacattcccccacagcaggaacctctttgacaccctgcacccctgcaatccaagcagctaagggatgacacaactgtgaaaccaagcccacatctggagtgcttcctgacctggaggccagtagccaccctgtatcccagaggcattgccctcattccacaaagttcacacaagtgcctctagcactaataccttggctacttggagcctaggctcaaaggcacaactggggccctgatacctaaacccacaaggctccctattacccagggaagcaggtgggcctgcatggccgggcagccccatgcggccaccaggctagtgtacatctgtccctggctctagctggcctggaggtggccccaccccaagggagagagtagtatacagccagtgggcctgtgtgaacttgctcccagcttgaatagctggcccagaggttgtctgcctgtaccactggaggattgtgcacagctgccgggccacaatttcctgcctttagtccaatagctggtttggaggcactctttccgcagctcaaccctacatcaccagagtcatgcacagcctccagacctgtgtgcatccacccctggcctgatagccagcccagcagtaaccctgctgccattcaggagagacagtcgtacaacctttctggcctgctgcatcagcatgtgcctgaccagcaaccagcttggtgccaactccagaaaaaccatgccaccacagtcatgggcttctgcatactaagtcactgagataatcacggacatcgcaggtgaggattccagctgaataatctgtttggacaccacaatactgagtccaccctgaaccaaagccaccacacgccatttccaatcagcaccctaggacccatcaacaggaaaaaacctcttcctatgaaagctgctcgttaaaattggaaaaagcaattgtccattacatgcacaggtaccaacatagagacagaagaatcatgaaaaagcaaggaaacgtgtcacccccaaacctggcaccacaatgcatctttagtaatggaatccaaagaaaagaatatttatgaaatgcatgaaaaataattcaaaataatgacattaaagaaacttttgagttgtaagagaatacaacaatttaacgaaattaataaattcattagctgagtgagaaattgaacaaagatagatattatggaaaggaacaaaacaggaatcttggagcttgaggaattaagtgaatgaaattaaaaaaaatacaattgagagccacagtaacagactagaacatgcagaataatacatttctgaacttgaagacagatcgtttgaaataacccattcagaagaagaaaaaaaaaaaagaataacaaagtatgaagaaagcccataggacttatcagacaccattaagcaaacctatattcatattatgggagtgccagagaaagaataagtgaagagaggcatagaccacccatttggttaaatagattgcctgtgtccttctgcacttcttggaaggaagtcttggaagttatggacatctaggaatgaaaagatccccaataaaattcagcccctcaaaatcctctcaaaggtacacaattctaaaagctgtaagacaaaaacattacgtcacatatatgggaattcccattagactgtcagtacatttctcagcagagactgcacaagacaggagagagtgggatgacatattcacagtgctgggaaaaaataaaaataaaatataaaaataaaaactgtcagcagagaatatatccggcagtgctatccttaagaaatgaaaaagaagggccgggcgcagtggctgatgcctgtaatctcagcactttgggaggccaaagcaggcagatcacgaggtcaggagatcgagaccatcttggttaacatggtgaaaccccgtctgtactaaaaaaaaaaaaaaaaaatacaaaaaattagccaggcatggtggtgggtgccggtagtctcagctacttgggaggctgaggcaggagaatggcgtgaacccaggaggcggagcttgcagtgagccgagatcgcgccactgcactccagcctgggcgacagagcgagactccgtctcaaaaaaaataaagaaaagaaaaagaaatagagacgtttccagacaagcaaaggtgatggaattcatcaccactggactggtcctacaaaaacacttagaggaaataataggaaatgaaagaatgattaataccatgaaaatatgtgaaaatacaaaactcatcaatataggtaaatccataatcatattcagaataccccagtgctgtaatggtgctgtgtaattccttccgtcctctaatatgaaggtttaaagttaaaaatgtcagaaatatcaacagctacaattagtggctaaggaacacatgaaagataaagatgtggctgggcgtggtggctcacgcctgtaatgccagcactttcggaggctgaggctggcggatcatctgaggtcaggagtttgagaccagcctgatgaacgtggagaaaccccgtctccactaaaaatacaaaattagctgagcatggtggtgcatgcctgtaatccaagctactcgggtggctgagacaggagaattgcttgaacccgggaggtggaggttgtggtgagccgagatcacgccattggactccagcttgggcaacaagagcgaaactctgtttcaaaaaaaaaaagataaagatgtaaattacagcaatcaaaacactaatcatggtggggtaggggagtgaggggaaaaagtctagattatttttgtgtgaccaaagttaagttgttattagcttaaaatagtctgttgtaactgtaagactcttcatgttagctccatggtaaccacaagaaaaattatagtagatagacaaacaagaaaggaaacaaagcttagcattatagaaaaccaccaaaccacagaagtaaacaagagggaaagaatcaaacgaggaatcttcataatattgagaaaacaaactagcatgagtaaattattacttatcagtagtaaccttgaatgtaagtggattaaattccccaattaaaaaatatagagcagctggatggattgaaaaaaaaaaagacccaactgtatgttgcctacaagagacacacctcatcattaaatataaacatagactgaaagtgaaggaatggacaaagatatcccatgcaaattcaaaccaaaaatgagcagaagcagccatacttgtactagatacaatagactttaagtcaaaaactgtaaaaagagacaaagtcattatgtaataataaaataatcaattcaccaagaagcaaaactgtaaatatataagcaccgaacaccagaacatccaaatatataaagcaaatattattagatttaaagggggaaatagactccagtacaacaatagtagggacttcagcatcccacttttaacagtagacaaatgatttagaaacatgagacttaaactacaccatggacatttacagaacatgaacagccgcagaatacacattcttttcaactgtgcatggaatattctccagtaaagatcgtatgttagagatggtatcaagtattttaccagatcacaactatataaagctagaaatcaacaacaagaaaaacgttagaaaccaacaaatacatggaagttaatatgcaccttaataaccaatgggtcagtgaagaaattaaaagggtaattagaaagttccctgggacaaaggagcgtggaaacacatacaaaaacctgtgggacacagtgaaacctgttctagaagttcatggcaataaatgcctgcatcagaaatgaggaaagatttctaataaacagattaactgtgcaactcagagaaacctgaaaagcaagaacaaattaaacccaaaattggtaggatggaaataataaagcttagagcagaagtaaacaaatagagactaaaagagcaattcaaaagatcagtgaaatttttttgagaagataaacagaatcaacaaacctttagctagactaagaaaaaaggaaaaaaaaaaagactcgaataaataaaaccagacatgaaaaatgaaacattacaaatgtatcacagaattggaggatcacaagagactattatgaacaactgtataccaacaaattctagaatataggaaaaatggataaattcttgaacacacacaacctaccaagattaaattgagaagaaatggaaaaaataagcagaccacaacgagtgggagaattgaataactgctaaagcctgacataaagatccctagtttctgatggctacattgctgaagtgtgtcaaacatttaaggaacaactaatattaattctcaaactattccagaaaattaaagaggagggaatacttccaaactcattttatgaggccagcattaccctgattcaaaaactagacaaggacacaacaaaaagaaacaggccaatatccctgatcaacctagatgcagaaattctcaacaagattctagcacgtccgattcaacggcatattaaaaacatcatccactatgatcgagattcatcccagagatggagggatggttcaacatacacaaatcaataaatgcgatacatcacagtaacaaagagaacggaaaccatataatttcagtagatacagaaaaaagcacattacaaagtttaacatcccttcatgataaaaactctcaaaatagatatagaaagtatgtacctcaacacggtaaagaccatagttgagaaacccacagctagtagtatactgaatgcagaaaaaaatgaaagcttttccactaagatcaagaacctaacaaagatgcccacttccaccaatcctattcaacatagtactggaagtcttagagcagttaggcaggggaaagaaataaaagacatcaaaattggaaaggagaaagtaaaattgtctctgtttccagatgatatgatcttaaatatagaaagccctaaagagttcaccaaaaaactgctacaactcataagtgaattcagtaaaagtgtaggacacaaaattaacacacaaaaatcagcacttctatatgctaacggtgagttatttgaaaaaataagaaaacaatttcatttacaagagctacaaaaaatctagatacctaagaataaacttaaccaaagagataaaagatctctacactgaaagctataaaacattgaggaaagaaatataagacacaaacaaatggaagtagatcgtatgttcatggattagaagaattaatgttaaaatggccatactacctgaagtcatctccagacttactgcagtccatgtaaaaattccagtgacccttcagagaattagaaaagacaatcccaaaaattcatgtggaaccacaagagagcccaaatagccaaagcaagcctgaacaaaaggaacaaaaggtagaggcatcactacttgacttccaaatgtactgctagaatatagtaaccaaaacaatgatattggtgtaaaaaacagacacatagaccagtggaacaaaatagagagcccagaaatggacacacctacagccaactgatttttgacaaaaactgttaactggagtaaatctaagaaatgtacaagaacttccaggaagaaaatgattaaatatcattaagacacattaaagaatacataaatattttgaaacattcgctgtttcatgaattggaagaccattgttaaactggtcggttcttcttaaattgatttatgggtttagtttgatcccaattaaaaataccgttagttttgtttttgcttttttaggaaatcaaatgagatgtttcattacccgccgccccctttttttttctttgtagttgatctatacagcttaaagtgtatgcatgtttctcagtgagtgtaatacttcccaaaaaggggcttaggtgagctatgaagtgggatattttcagtattactgctataggcaatttaacaacacaaaaacaataaaataataacaccccctcaccccccccccaagtaaaaccaccgtgtaataaaatttaatggaaacatgatgatctaccatatgtaaatgctttaaacatttagcgtagtgtgtggaaggaaaagacgcagcaaaacattttgtcgtctttttatattgcttactaccaaggtcatgaccaattttgagaagataaagcaaggtgataggtcagactcgtttttggtatgtggcttgcgagtttacccttcaaacattttgttataggctatctctgaaatttgccttttttttttctcctctaccagctggtaatacctggattttagccactgcatgtcttatacttaagagcttgggtagtatcattggaaaggccaggggaggaacccttatgcaggattttgctttataaaaagtttggatttatggtgccagtactagattatagaaggggatcaggtggagcaatagagcagtattggagctagagattggcttttgcaatcagtcagtcaatcaataaccaagaagtagcagcatttaatatcttcatcatccatttactttaaaaacgtgtttatcactcatttataatgtttgctctagaggtaaagcaaattcttgtttctacttttcagacactgattggagacactggttgatatttttggcacagtgttaagtgtgtttattaagttctttaggaaccaagaggagatggtaggaggagacctactgaggcatgctgtaaaattctggtgataaaatatgtttaaattaagagggtcaggaaatcatggcattcccctttcacctacatgctttttttttgcaccacaattctaccatgtggtatggttaaggtgtattgtgataaacccatttctttaaaacccatacttttgttaacagtgaatgacaatatctaccatatgactgaattgagctacttgggaaatggctattatttttaaatcttaggtgactttgaggagcaatcatcaattacatgtatctcttgaactttaatcaaagttgttacactttgtgcctcatttgatctctgcaaagaaagttatataggagtgctgggaagatgttgtcttggttcgtatccctaactttcttgcccttccaacttcctttttggaatggtgtgacaaatggttcaggctttacttgctcctagaaagtacatttgaggccacacattcttgcaagtcctgtgtggggagagagaaggcaaaggaactaaaaagcttacattatctcagtatatcaatgtgatgtttacattaaatattttgtatgtaaacatgccaatcaagtggtgtatattttttggtagagcagaagacgggcgtaaaggaattgactatacttaaaacatttcaaaagaccttcctggggtttagtaatcttagcccagatctggaatgtgaaaaatgtacttagggtgtattgtgcagaaatcagatgtcctcaagttttctgtagctgatgtatgtatgaaccatttcctgcttattgtgatatgtgtgatctgctctgttgacattattaagaaggatttgtttcttgttataattagtagttaaatataacgacagatgttcatatgctatagattcaggattacgtctggttcttttagacttttgagcagtttatattttagaatatgctgtagaatcctctttttacatattgtctgtctgcactggtactagtcaattgctgggtacctcttctatctcttatataggatcactggtactatttgttttatggtatcgtttttatctgcctttcccagaacttattccatgttttagtctatttatttctgactaccaagatacaaataagtttgctgtatctcaacgtctaaatatacatatatattacaaaaggaacaaaattttcaaatgagaatactgccatttataaaagtcaataaaaagttaaatatcccctctatatagggcagtcttttgtattacagttactttttatatactgtgcattaacctttcttttttgagcataaaccagtcttgaacaaattcagtttgttcaggttattattattctgctgaactgcaaaatttaactgttagaaggtctttaggacctcctgggtctccaataggagagtcaagttgactgtctttctatctctcccttgtattcttgaaaacttgctttctggtaacagtagaatgttctagatattctttggttttcctctgccccagttcatctaactaaatgtctttcaaggagttctatgtcttttcgtgaaacaagcctagagtctggggttgcctgtgggagttggtttttgggcagagagtagtgctggccagtcgggtcactcttaagtgtgacagaagtagaaactgtttacttttcactatatgagtttacattttaacatatcatgttgttaccagtttttcaaaaatgtgtgttttattgattcccaaagactgacttctgtattcacatggatattttagatttccttgtatctaatgtcttgtggtaaatattgctgttaaggataaaataataatattttgacattaatctgataggataaaatctttaggataaaaatggtgtgaaatgaatgagattttcttgataaaccaaaaagttgaaaaaaactaatctttactcaggttctggtaattaacacaaagtggttaagatacctgaatgttatttatgctgatttagaataataagtaacaagtttctttttttttttttttttggctgaagccaagtagcaagtaacacatttcttgagcaggcaaaatgcttggttagatcctatgtgggaaccagggttttccagttatgattatacttatgttgttgcatgctcaggagcaagaaacatcattaaagtagcattacttttgccatgtttagatatacttaagatattcataggtgagtttattttggaaaggttaactatcttttgttattctaatatgtattctaatatttatttcattaaattttcccaaaggcaaacttttgggcaaggcagtgaacatacaggttttcttttcctttacttggctctcatagaggcatagatctcaagaattgaaaggaatcataaagtttaactcactgaactttttttttgtagaagaagaactaagtggtcggtgataaaagtgcaacttgttcagtttttaatgttttcttgattcagagtaattgttataaaaagtggtcatcatgttatattgtaaatatgtactttaattgttatttctcagaaaattcatctagatggtatattcctggtactaatatctaatttgttgaaatgtgatttattgtactttctattatataaaactgccattttatgtttgaaatttcatttttcttaggaaaaaagactatacttctctatgtattagcattgacactgctaaaacgtgtatttgagtaaagttagtattaaatattatttcttcaaatacattattgaaatcttatgtaatgaaaatgcttttagaatgtgtgatatgcctgggatatataccattatataatgctgcatttttttccaccattgattaagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcaggtaaggatttttctttattcagttcttatttgatgtgtgtgatagcaatggaaagtgagttggttgtgtttaagttgtgtactttaaagataagtacagataagtttttaatatactattttgtctaataaactagcttggggattgaagtatcctcccatccctctttgtttttcatttctagtatgtattttttaacagtagatcactacttatgcctttcacttatttggaatcaatttatcctttccttctgcttttaggaattgttggggtggaaagagttttgtatatatttccctgcaaatttatggaagcattgtaaccaagtttgaaactagaactggctttctgtgggtcagatcagatttatttgtatatactagacagtgttatttatagaattatagacacttagtatttttaataagcattttgtttgaggttggtatagatttgcaaatctgagtttgcatgtgaaatgatgtgatgaataaatattgataaatcaagaataacacattgtctttttttactaagaaatcccttaatgatacatttcttgatctgcttattctaaaataagagacatatgtatgtgtagatatccctcttttcaatttggaacagttttcttttacgtgtttaacaactgttatcaaaattctttatcattctcggttgacattgataatgttatccatcagattgcaaaactttaaaacaatttatgaataatatgtccttaatttttattactccttaggaaagttaactaatgttttgtgttcgtttttgtgtgacagttgaattatagcttattatttcatgttcgtgatgaatgctttttccttcattggacatgcatgctattttttgtattcaaaatatatcttcattttgtaactttccaaacctgtgtgtatgacagcttaaactttcatatgatattaaggcaactaacaggttatttggttcattttctacaagttaattgtttttgctaacttgtaattttaacttttttttatatacttcagtgctaaaattttcaccgttttctccctttttgcttctggtgcataatatcatataatttgattttctttgtttttctggatttacctcactttttaatatgctgtggtgcatcctaataagtaatatgctatgttattggctttcccaggacatgaagatgctaaggaatacctggattaacataaatctatagtagtatctttgcttctagccttgattatacgttgtttacttacatgccaaaaagcaatatctaaaatattgataccttagagattcttagatcatcttaataggctatctcactttacttgcgctatctattaagaaggtttgtgcatatgataatttagacataattttaaaatattaagtatagttttaaggctctgaactgagtgctcatgaacatgttttgctgcctgtgtttggtcaagtagatgctatctcagcactattatggcaaatacatgagggtcattgattagaagcttttcttagaaaggtataagaagaaagaaagtatttgtaaataatattgttagaatagttgctttttatttctctatcctgtatgtgtagggaagttctgtttgaaatgataaatgctgatatagggataatgaccttttgttttagtaggataaaacttctttcagcagctcagtttaatcttgatacagttacaatctgtttctaccctaagtttgctaatcttagcttttctagcttttctttttagcttagatttttttttttaagaaggagggaatgggctagaaaaaaattatcttttaaaaaaatgcctagcttatttaaaaactagtaattgtactagttttaaaattttatctaagtttagtggctgcttaactcctaacataggcaagtataagagggcttgagttatttattttttcttttggtgaaatctaaacatctaggagaagtaacctataagcttaaaaattcaggttataatggcctaataagataatggcttttgagggagtagaaaacactaagcatcagattgtggaaaatgatgagtgggcagaaaaatttggctagagatcacctgaagttttattttttatggtaattttaaaatctatcaaactattttaagtagcttttaacttttatctttggtagagtcttcttaaaaattttctaccattattgcttaactctaagctataaactgagatataatacttggccatcataaattgactttttacttgtgaatgaaaagttgggccaaaaatctaccatagtgttggaggttttgttgttttccacagtgagttggaacttactcaaattgtgatgtaaatgtactgtaaagttttgattacaaaattttctcggggatggaatttacttagtaggactaatttgaaacatctgggaattctttttcttgtaaatatattgaccagttatagaagtttgctagtaatatcaccctttaacttcaaagtatatagctggggtaggctacaacagttatagatagctttgcatacttattattttagatactgagaccaatattttggtagaaagggggaacagaatgtaagaaagggaatataaacaaagagaagattgtacagataatggcttaaataatcttttggctgctggcaacattagcctgtctttaggttagacatcaaccccacagctagtcaggattatttttgtcctattcacttggtacttttatgtagaaagtactgattgcagctgttccccactagggtgtcactgaatgagttagctatttggaggtgtatgttcttctctgtagctctgggacatgtcgttgaagtggtatgggtgctcatgatgatccttagccccttagcacctttccatttggatgccgagaagtaaggtgctcatacttctcagtttgcttgtcatagtcccttttactcctattgtagatctgttggcacctgtcacttagtcctaaagccctgctgtgtatgatggtaaagtatgtggttaccttactcataaatcatataactgcaggttgactaaaatacaggcaccctgagggcagagagcacatttagggtactctatattatatatataatacagggtctggcacattggaatagcccatcaagtaattattgcatgaatggatgaatgaaccaaaagggagcatgtatggagtatctaaagtagtacgtgaggatattttaaaaaatgatgcatattgtcagaacatttcaggatataatttaaaatgcttattcatactccttgctcttctctctttaattttcatcaaagaaaaaatcatgtggcactaaaatgcttaaacctgtctgcttcctagtcctgccccttgaaagagacctgtatctaatccatttcttctctatcttcatttttctaaatgacatgccttcccactgagatagatgaggaatttgctctttcagttcacctgcctagaattgccttttgtttcatctctcaacatggttataatacaaattaaaaatagtaggtagtcagtattttcattttttataactttgtaaatgttacagtgattcactaggtcctcccatctatagtactttgttatcctggagttgtcaattgctacctttttcccctattttctatatactttaatattttctaaatgcttcaacatgtttgttatggtcttaataatatattctgtatgcccacacatatttgcttcatttttttgtttgtttgtttttggagttctgtcccatagaccatttctctgtttcaaatttggggtgaattctgattctttgtggtttaagcatgatcactcgctttctaaaagtaagtctagagaaatgggattggtcgatgtgggtatcagtttacatgtttttacttaatcttgctgtttgtagctctcaatcatctctcctttgtactgtgacatacaatttgactgatttttctgaacctgagtcatttaagatctccaaagactaaatttcctatacacccacagaggggaggcaattgtctgaatgtgctgggtctggaaagcacatgggggtttaattgttctgtacatagacttgtggtttcaataatgccatctatttttcaatccctgcctcaccatgaaacttatgtgataccatgctaatttttttttaatcctccgaggagaatttatcacgcttctcagtcttctccactgtaggcagtttatgtttcatttcctctgcactcttgccatcacttctttctttttcacaaattatttgaactcttatcccccattatgtctttgttattagcaagaatctaaccaaacttcattttcgtaagtgcttttcaaaattcacatattagctttggactgaatgaaaggatggttattttcaggtgcattaatcaaaaacactcttcaggcagtaaaagttaccctttcttacctcttttgaaggaatacattggacagtcctcatatgactttggtgaaggatatagggtctttgggacttgaaaaacttaatttttatgatttgttgtgataatcaatggtgatgagtttcactgagtaatggtagatgaggttgttttagaccatctgccttgtgatgttttgctggattccaaaacagaaataaaaccaaccttttgagggcatcacagagtactaaagcagtgaggaattttgagtaaagaaggatagtcatagagtgagcttgttatttttgatggattttgtcctttaggcatctccagaactgactgctgcgtagttgaggaactaagaaaatttttgcacaaagtttgagccctagtaaaacatcttagactgtgagttggaattctaaatggttagaatgtagcattaactgagaactgaaagttaagacaggcttcctagtttctgaattatatagttttaagttatctcagaatttattggattaaggcgacctgagactgtgactctagtctccctgcctgccagagcaaatgtaaattctctcttagaagatagtattatctggaacctttcctcaatttttcatacacaatgtctagtactcaggtcagtcataccagaaaataagatgtgtgtgaaaactaacacaaaaaaatggacaatagaaaacagcacagggaaactggaatacttgtctgccataataataattaatatgttcaaggaattaaaagcaagattgcgagtctgaagaaaactaaaaactgtaaagaacaaaatgtaaatttcagaatggaaaaatataaatgaaactaagaagtcagtggataaatttagcagcattattagacacaactgaagagataattagccaactggtaaattaatctggagaatatttttcagactaaagctatgacataaagatgggagcatcaaagagatactttggatatggtgagtagtactaacagtgtatttgtagttccagagggagagtaaaaggaaatagggcaaaagcatgtttgaagagattactcacaatattccaaacttgagaaagatcaagccatagattcaggaagcaataggaatcaaatagtataaacataaagaatactgcaccaaagtacatcataataaaacaaataactatagacaaagagaaatcctaaaagttgcaaggtggaaaaagatacacgtataaaggagcaaaaacaagactaatagctgactttgatacctttaaacatcaagtcacacataagcagaaataatgtctttaaagtgctagaaataaataactggccatcttgaattttatacctagcagaagtctttaaaaatgaagaaaaactagctgaaataattcttcaccagcacacccacaccaaaggaagttctaagtatccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttggtttcactttctgctgtttcagttacctgctgttaattgtggctgaaaatattacagtactgagagagagaaggagagggagagagggagaacacattcatataacttttattacagtatgttttctttacaattgacctattttattattcgttattgttgctaatctcatactgtgcccaatttataaatttagccattataggcatgcaaggaaaaaaaacataatatatatggagttcagtaatatctgtggtttccggtattcagaggagattttggaatgtatcctttttggataagagggtgctactctgtaccccattttcccattatttaatgcctctgttcttcctctaccactccactgcaaacatgactttgcagttgccaaatccaaaggttatttctctgtccttaatttattggaagaatgtggcaacctttcatgatattgctaatcttgtcctccttgaaatgtgccagctattttttgatgtacagcagaatcttttgtggaactttgtatctttattgagagtcccctgacacagctattttttaaagctccgcagtttattagaatacacaagtatgtttgaaagcccttgttttctccactcgtttttcttctgtgatttcccttagtattcctttctctttttcaaaactctttttcttttttcctgtgatttttaaatggtgctttctccccaaggttctgatcttggccaactgttaatgtattcatatcccttctggtttattacttctactcttactgttttaaaaagcagtcacaagactgtaatccctacaagggcagagactaccttcttagtgtctggcatatagtagatgctccataaatatttgttaaatgaatgaatagatgatttattttatgtgcttatattgttgaataaatctttctagatcacaagataaaatttttttttacagtttctgttaccagctttatggttttacctttcatatttaggttgttaattgatctatgtaatctggctctatttctttatatgtagttttctcaatacccaactgttgatcaaaaccttgtttcctcattgatttgtggtgccacctttaccttctgtcaagttggctgactcaccttttctaagatttgaaacattatcacttcctgtatagtaattttcaaactttataaactgtgacccaagaaaggaatatactgtatattataaaacattttacacatacacaagtgtgtaaaatatctacaatgaaaattttgcaagaaaatactctgatgtatttactgagtatgatacattgtgatattttccattgtattttatctcattttaaagaaatgttcagtatgatgatagtaaatggttgcaaactacagtttaaaaaacatactccaggaagcctttccatgggcatcctgcatatgctccattagattcttgtgtaattattatcactgcatcttgaagtcacgacatttctattacatgtctgtctcctttctaaattgtgtacttccttgagcattgagataatatgtaatttctttgtgtctctattacctaggatctgatgagtaaatttatttgtactccatttttctagtattaatgatacatctagataattcatggtaaacatagcaggtctaaaaagttttggacttgacatttgcatactctttattttgaggaaactgcttaagtgcatataaaaagagctattaataatgagtagtatatttaaaaagttgtccaaatataatcttgtgcactatcaagtatcaagaatggtatgtcaaataaaagaaacttgactttttctcagaagtatgtcctccttgtgccagttgcaatgattctgagtataagtagtacacagttgtaaaaaataaacctccaagactagtcatttttacattctgctaatggaattttccctcaggttatgttaaattgttgttctttttcagtcattatttaatcttttggaatttagaagattagttctgaattacaagcctccatcaaatgctcaagatttaccccgaaaccaaaaggtaaaattcaaaagatttttttaagcagtatatatactctatatgttctcttatatgtgattgatttttgggcatttacttggctcatcaaatctgaaactgtcaatttgaatgtcaattcattaatcttagttaccatagcaagttcttatcctttgttaatatattataaatacgacttttttcctttacctgtcacagtaatatgccaatttttggtgtcgctttagtaatttttttgggggggactgtcaaatttcagtaaactttataggctatagtttacaatttaaggtctttcctcagttgtctcctaaaaaattttgtggaaatcgaaatttcttttcaattgatcgtcttgtgcagccctttaaaaaatgcgttttgcattcatgtctttgcagtacaaatctgtatctttcattttggaagtgactgtcatagatgggtaatataaagtgacaacacacacaccagggccagattgcgtgggttctagctagggacctagagctggttacttgatttctctctgttccatttactatctgtaaatcatatataataatagtaattatttcatagagttgctgtgagcattaaatgaggtaaaacatgtaaggggcttaaaagtgcttggtacatagtaagtactaggtgtcagctattgtcagttaaacaataaaaaaaattaaaaaaaaaaaaagacttattttaaaaagaaccagtttgcacacagaatttatacctaatggaaaaaattacttatggagatgatatagttgcgtgtagggctttagtggttgatcttgtcataaacaatctgtagtcctaaagtggacttattgccaaggcaagggagttagttttaggtttcagtaaactgctgaacttttttgacctatttttagtaggagtgatgaaatattaaattatgttttcgttttagcgtttaatttttaaaaccactttttctttttctgtaaacacgtgaaacatttataatgcatgctagtgggaagataacttgatttataaccagcttttcaggttataatctctgggctgtagagtgtcaggctgataaacaacccattttcaaaagggagtcaggatcgtctgacaaactcttatgtctccagaaaaattaaggaaaaccctttcaatcattatggtttttacatggaactttctgaactattgcctctgtcattgcaatttgttaatatcacagttcttctctcttctcatatctcaaagtatatgtataatttgtgtgaaatggttgagaattatcatttctagttaggtatgcatgtatgtatatgcatcttgaccatttatggtcctggattttaatgttttacagagctttaatttcttttgttcttcacagagttgaatgaggccatgttagtttgtattcttatttaaaaaacagttgctatatttatgcttatatatcagaacgagttgtgaatactagagaaatgtgtaattccagtcttcagcacctttctagagaagtttgtttcttgcaatgggttagcctctccaggtgtccctttagcttaaggaaataaaagaatttctcacttccattctgagacaattacttagaatactgtgcaattttatatgattattccacaaatgtgactctaatttagtatagtgacagcagtacacactataccttgacatctttgaagcaaatggatttatagatagttatcagccactgaatggtcctatattcacttgagatggtgacagcaggtttttaaaaaaggcgtgagtgtaacttgtcacttatttaataatgaatttaccgccaactcgtgacatgtctacagctacattcaatttgaacactttgtcttaagttgcagaatacatttgggattactttgatcacatcacagagatgccatttgtatgcacttttaaacaggatattttttgctagcaaaatttgccacaaatattacatacatattgagtgagatttgaaagaaatctagtatttgaaattagtatgtattttaagtagacttggcaattgcttgtagaaattgaaactaattttagacactcaggtttctttgaactgttggtaatttcagtgtctaggagaattgtgaggtccctggaaatataataatagatccttgatgtaatcatcccctctcccctcacacagatatacatttggtttaaaatgtttcagactgatggcaaagcatattaaatgttgagaaaacaaagatgcacatgtataatatttagtggaaatcatcatgtaaatagctaaagccttattaattggaaggttatattatttaaagtcttgatttaggacaaatatttcaaaataaagaaatttatcactttccactacttaaagtgaatgtcatcagaaggaaatgggtttagttgagtaccatactgtattcctggagcaaatacctgaaggaattttgaattttacaaataaaaggggcattctgagatttctgccattagtcatgaagaagtaacaggagctggatttataagtctcagtgcatcttagaggattcaaagcatacaaaataccttttctgatgaaaatggtagaaatcaaggtagaaatcaacaacagaaagatatacagaaaatccccagatagttggaaatgaagtaattcacctctaaatatcccaagggacaaaaaaacaaatcaaatgagtaatgtcagaatattgtaagctgaatgaaaattaaaacatgacatatcaaaatttgaggatgaagctaaaacagtgattagtggaagatatcttataagagacatcttaccagacatcttattagaaaagaagaatggttttcaattaatgatagcagcttgcatatcaagacattagagaataaagggcacgttaatctcaaagcagaagtaaggaaataataaaggtaatagcagaaatctgtgaaccaaatatcagaaaaacaatacagaaaattatggaaccaaaaactgcttcttgagaagattggtgaaattgatgaacttctaggtagactaagcaagaaagaagagggaagacatatattacaaatataaggagtgaaaaagggaaacatcactacatactctgtagacactaaagggagaatagtggaatattataaacagcagacaagtatcttgaaagtcacaagctatcaaagctcactagtgaagaaatagataacctgtggtagccctacattatattaaaggaactggaacctgtccaccaaaaaattcagcagctaaatagttttacttgtaaattatattaagcatttaaagaacaaatgataacaattccctataaatttgtacagatacttaaaaagtaaaacttcccaactcattttgtgagctaagcattaccctgaaatgaaaagtaggaaaatacatttcaagaaaagcaaaccacacaccaatatttctcatgaatttggaagcaaagaattgtagcaaatttttgaaaaattaaatcctgcaattatatataaaggataatacctcatagagaagtggggcttatccaggaatacaaaattggtttagctttcaaaaataaatcagtatacttcaccatatcaacagactaaagaaggaaaaccatattatcatctctgtggatgaagaaaaatgatttgaccaaagctaaaatctcatttatggtaaaaatcttctagaaactaggaagcaatttacttttcaaatatgcttctcagcagaattccactaatttccaaaaattattacttccaattttgttactgggaatgtctcaaaaaactgcattgacttaggtgcggtgataaagaaactgatctcaggaaattaagggtacttttgaaagtaattttgtggattaaagctcatagtctttatacttttaaaacctatgtctgagggcatatttggaaccagttttattccctcttacctatttctcaggactcttttttggaatctattctagaagcaattctttctatgtgggttatactattttgggcagcaactatgtaaagatacacccccatcccagacccctagaattttacagtgttgagaatgccaactgtgtaaatttggaagaaaattttcatgtttaatatctaaattttttccgttaaaattgttattataagaactaaatattataagaatggcttgcctggtttgttgtcatgaaacatttcactaagttatgtgaattatgttattttttaaaatttccttcttgttttaaaatacattgttagtgattggtaatgtgggttgttttaatttctttctggagattttgctttaatgagccagtaagaattgaatgctttgtgtagtaaaaagttggggaaaagatatagaaattcttgtctttgagaatcttatagtcttattgagaaacaaaagtaagatttcagaggaatattaggagggtgatatattagtctcctattaggatctggtctaattattaaattaataaaattaaataaatttaaatattgtgattgaattatattaaatataatgttcgataactttagatataaaataaatgagtataaaataattttataagtaatttttattaaatataaaaacaaatattaaatttctaataatcgggtgaggttctaatattagtctaataattaagattgtcacaccacagtgacagtcggtgattcattgctcagtgaaaggcatttatttcagtagatgtggaatttgaaggtatcgttgacttgaaggagtctggaaaggcttcatggaggagtggagatttttgctaaatgggtttattgagatcaagcacttagaacagtgcctggcatgtagtgaacactcattgaatgttggctgttattattgctctgagcagcagcagctgggccttgctgaatgggaagtattatgagaagcagtcttgaatgaggaagatattcttggctgagtaatgacatgatttgctgtgaatatgtggcattcatgctgaaattgtgagcctatcctaggtcttctgcctttttgtgctggacttctttgagtctcttagatggcaccaacactctactttcttcaattatgatagagtgctaattcatccctaaactatattggctagtttaatttttggttactgttaaaatgaatatttattagtaaaaattttcttaatcttcagttaaggtgtttttgtttttgtttttttccttcaataggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggtagttctgttgcactgacttgttcattaaccatttgtatttaatctgaacaatattaagcacctttcccaagaatatgagactatttgagatgcatgattctgctttattaaaaataacctggaaccatttaaaacatttgggagacttttaagagaaaagtgatcttgaaggtgttaaaataaagttttaatttatattatgattgaaatgaaaacgatggatacaattaagattatttacaaatacataattaaacatgttcacaaatgtgtgataacagaggatcattatagtacacatgcttttgatattcctgtgtttgctggcagggagtacttttccttaattacccagaaatggtttttgaaagatgttatctttgttattgttgcttttgtcttttattctttatatagtgtattgtggtagatttttatccattaccttaaaagaatattggtaattttcttataaaaaatacaaaatatctataaacaaaccagtattttcacatataattggaaaaatcagagaaattaaagaaggaaaacagaggaaaaaatacagtggcaaagaatagtaagtgttcaaaaagatagcggcaatgtgtaatggcagaagtttcaaaaagccactaagcttgcagcgttgttttttaaagtacatacttggatgtgtctctgttttgtgatgtatggagagggcgtttggaagaggaaggtctgagattctctcaccatcttccttgtgctttttgtttctgctttacatttaccttgtatggcaaatgtgaatgaacaaaaagggcactcacatcagagtttcttttatatgttgttgcatttttaaaaaaaattctaacaatgctccagtgccttttaggcttagtatctactcagctttgtttcttactcgctctgtcatggtaacactaacacaaatcaaaagaaagagaaataattttacagttgattccaaaccatcattttcgggcattcagcattccttctggttctaaatgtgttttacttttttttttcttctttagtatgcatagtatcttttccagtgattctgagtatacaattaaattttttaaaagattacttctgttctctgacttatctttccttctggatggctttttccttgtcttttttctggtttcttttttttttttctttcttttctagagattcatgttgattttggggtatcttttcacatttaaagatgaggcagcatagactttgtctggagccatgtatgtacataggtgggcttttcagtttgagttagagttgaaatggatacaactggcggttaaggccacaatataaatgcttttgcttcagattagcagtgtagactaacttttgaaattagtgattctttttctttagaggccttttaaagtagatgtgcatcaattaaggttgataagtttgattctcttctgttccctaaacacttgaatttgaagtctacaggagtaatttagtgaatctgtaaatgtaagcatcatgatttttttaaaagtgaatttatattttcattgtatcttcttcctaaatatttcaaatacatcatcttttgaagtacacaggagtcttttgagacaccctttggtatgtgatactgttagttttttctttttcttttccgtgtttgtttttttttgagacacagttttgttttgtcacctaggctagagtacagtggtatgacaatggctcactgcagcatcagcctcctgggctcaacccttccccagacctcagtctcccaagtagctgagaccacaggcacatgccaccgcgcctggcaaataattttattttatttttatagagacaggatctccctatgttgccaagcctggtctcgaactcctgggctcaagctatcctcctggtttggcctcccaaagtgctaggattatagacatgagccaccacacttggccccaattgatactgtcaattttaatcatacctttaattgttttattttataattgtcaattttagattgatttctaagaaagatagggattaacttctgaaaaatattgtgttagctaggaaaccttattttttgttggatgtaatgtttaagtgaattaaagttatacaaaagtatgaaaagttgttttaaggtgttacaatagttcctaaggacagtcgtaacaaattacaacaaatggagtggttaaaaacaaaaggttattctctaatagttctagagggcagaggtccagagtaaaggtgttggcagggccacacttcctccattggctctgagggagaatcctttgcttccaccgtactctggtggctgttggtgttccttgccttgaggcagcatagctccaatctctgtcttcctcttcatgtggctttccctcatgtgtctgtctgtcttctggttttctgtttcttacaagaacactcaccattggatttagccccagccctaatccaggctgatctcatctcaagatccttaccttaattatattgacaaagaccattattctaaatagtgtcacattttgaggatctaggtggacatatatttttgcaggctactattcaacccgccacagatgttatgaatgtttacagctggatttttgcgttgcgtttagtcctatttaactctacagctttggagcagtttacttaagcttcccagactttagtttcaacatttttttgaggttaatataaagttggcctacatgctctttaagaaactgctggctgaaaaaatatatgatagtaagtttgttttgtatttggggctattttggtaagtaaggacaaattgcttactactgattcatctgcctgtaagcagcctcagtagagttgatttattgtttttcccttatgttctatttattattttctgtgttccaactcacgttattgaaagaattatggtagttgataacacaactgccacaacctattcctgtttttccgtgttgggagagcaaagaccaaaggcatggtgaaaggtgataaatgggctggttctgaatgatagtaaaggtagatatggcttaaaaagttgtgtgtgtaagttgaattaagaaaagtgaattgtggaaagagactagtcttccttctaagagagaagccagtcataattctttataaaacgaagaactgtttgctaagatgatttcttcattttataaagattcattacagagctctttgggtggggagtaatgattattttttaaaaatctcatttgtaagtttggtttttgattgtgtgtgtgtgtgtgtgtgtgtgtgtattttaaagtgaaacccaataattgattatcatataatgcttgttttttcaaatatcttatatcctggttaaattataaaagtttcttgcatttcgtgtgaaacatttcacttgttatctttgtaaggagttggtaattatatatttcaacaactggctctaggtttgatgttacaacatctagtattttttttttagtaggctcaaatatcaacaggcttttttcttttcacagcaagatgtgagtgagtttacacacaaattattagattggttagaagatgccttccaaatgaaagctgaagaggagacgtaagttaccgtgaagtttagcaatggggttttaggaattcattagatagcatgtattaaatgtcaacagagaaataagaaatcaagacagacttatgggaatcccagtattttctgtattattgacaagctgtttagaatttgcaggcacaaataatagtgtaaccaaaaaaatctaaaaagtgatccctggaagagctagtcttacatgcccagttccttttcttagattcaataatcacttttcatgacgaggaatgaatttgcggtggagaaagatgtcaggaatgtgaattgtgacaaaatccttttacgtagaagcatgaagacagggatatgaagtagcagtgcatgtgagcaagtggctctgttttatctgttcactcagggccccgaggtcacctaggtttctgggatcttgctggcagtgaaaattatactgtgtctctaagtttctgcccagaggtgacacacatcacttctgcaaacattttgttgggcagagctatgtggcctaacttcaaagtgagtaggaatatctcacactaattaggatggcggctacgaaaaaaaacgaaacaccccccccaacccctactgacccaagaaaataacgagggttggcaaggatgtggagaaattgaaacccttgtgcagtgttggtgaggatatgaaatggtacagccactgtggaaaacagtatggggatttcttaaaagattaaaaatataatcaccatatgatccagcaattctgcttcttggtgtatatccaaaagaattgaaagcagggtttcaaagagatatttgtacacctgtgttcatagcaacgttattcacaatagccgaaaggtggaagcaaaccaaatgtccattgataggtgaatggataaacaaaatgtgctgtatatacatacagtggaatattatttatcctgaaaagcacagaagttctgacatatggtgtaacatgaccccttgaagatattatgccacgtgaaagaagccagtcacaaaaggacaggtactataaatcacttatgtgaggtatcaagagttatcaaactcttagcaacagaaagtagaatggtggttgccagaggctggggggagggggagatgaggagttgtttaatgcatatagagtttcagttttgcaagaggaaaagaattctgacattggttgcacaacagtgtgaatatacttaacattaccgaactgtacagttaaagggttatgtacattttatcacagttttaagaagtgagtaggacagtgtatcttaccatgcacctgaacgtgaagggccagaattttttttcagtagcattaaagactgctatactacctactggggttcttgtaagaattaagagaagtacttatcaacattattctaaggattaaatgatgacccatttatcaagagagatggtatcccctctctccctttttaaacaatacttcacaaatcaattaatataaacacaaattaatacagaaaaatctgtacacaattgtggatacaacgcatttctatacagtaaggcaaggataaactttgtctttttaggtcacacaaaccataaaaagacaatttaaaattttcaacttttgtttgctccaagcagaaaagaaaaaaatgaattttggtattaaatgacttggaaaatttgtagatgactaattctaccagcagtgtgaaacttcacaaaagaatgaagtagctgttcagctactttgggtgaaaaactggtacctcgttccctccctggtgagggttgttgtttttggatttttttggactcttccatgtaaatacaggaaataacctatcaaaattttgtagaaatgtattctgattaaaagtggcttttcttccttcccatgtccaaataaacgtgcactacacagagtatgagattgaaatgtgtaatgatgataggaagagcaggcactttgtgcacaaactgtgtcaatttctcttccaagttcatacacgtagtagctcattttaactcctatgagagtcctgtgggtgcagctatcatagttatccgcagttgacaggtaaagaaatggaagaataagtaccttgtgcaacgtggcactgtaaataacagagctaaatgcaagtgcgtgatagccacataagtgtttttgtcttgtcatatgttatagttctttaatattttctctatttataggtccgaaaattgtaatcacatttatattttttaacatactttagggatgaagagaagccaaagaaccccatggtagagttgttctatggcagattcctggctgtgggagtacttgaaggtagagttatacatttactttttattgcaagtgaagagagattattattcattcattcgtctcgatagttactatttttttagtggactttatttttaatttgatatattctgtctagtaatttttgttggattgctactgttattcacataaagcacagaattgaatgaaggaaaaggaatgtacagagtgcattatcacatactaattaatactttattttatcctcatgttttttccagtgagagggcttccatgatacaattatgttggaatacagggattaatgggatggttgatagatcctttgaagataatattggagttaaatactgggcttgatatgatgctcactttctttttcatgttgaaagctgaatttagcaacttagcatagtcagggtattatagagttctcactttttcagtgattttaaatgtagatattagttttcaggaaaagattgtactctatcttttgaaaaatcagtgaagagtgatactactccatttaagctaaatacctgtttcttaaaatttggcctaagtagtttctgtttgggttccctaacaagggaggagactctttaaatgtaacttcatgtaataatattaggtcccaaagcataaacttttgaaaaattgtttttctcacatcacccaatgcatcaacttttgaaagttatctttttccagatcagctaaagtgtaaaatttgaaaaaatgctttttcttcacgatcttaagtagtggattccctgaagttctgtttgaacgtaggtggtttgggattcagaaaaagacaatactaactcagatgttggccctttaaaaagtcttagtgacatgttcgtacgtttttgtttgtttcaagtggtaacaacttatatataagttgttttatatatatatgcacatatatatgagttaatatatataagtttatatatatatgtagaatattttacatagtacatttacgttgggtcattcatcttaatcattctgattttatttgaagtagaacactatctgatgcagcgagtaggtctcatcaggtcatgactaggcactgtttataataccctgcatgagcatttctacctgtattatattgattcctaaaattgattgttattaaaatatttaatttgttggctgggtgcggtggctcatgcctgtaatcccagcacttcgggagcccgaggctggtggatcatgaggtcaggagatcaagaccatcctggctaacacggtgaaaccctgtctctactaaaaatacaaaaaaaaattagccaggcgtggtggcaggcgcctgtagtcccagctactcaggaggctgaggcaggagaatgacgtgaacccaggaggcggagcttgcagtgagctgagatcgggccactgcactccagcctgggagacagagcgagactccgtctcaaaaaaaaaaaaaaaattaatttgtcaatccagtgttgaagtctttgtacttggtattagtaagttgctttagtgattgtgttatataaaggtggccttaatacgttttcacttgaactatgtgtttgcttcagtaaaagtaatttatttcagagtactttcttatcactttttacatagatcttcctaatactttctttcaaaccaatggttcttcattagggatgatttttagtttgtttgccaaagtacccccactgcaaaagtccctcaactttttgagaacttctagttcattgtcccctctcagcccttctctgtacttcactccttcctttttcatctaaaacctaaaactctctttccccccttcccttctggcaccccctccctgttctctaaccttcattaagctgttcatcttttctgtgtctgtactgagtacctgaagattgctggcaaaaagtcacagaaatgggctaactgtagtggatcatgaatttgagtgatactgagcttccgtgctcccaatcctataacccaacttgttctgtgtaatcaccattctttctctcatttactgcaataaatattttcgttttttccactcatttcagatctaacttatctcttcattctctgagaaaatctttacctcagatttcatagatttactgtcacattaatgaaacttaatcacaggttttgcccagtccccgaatctaattttacatttgtagttttgtatcatattctaaaaacacaacattcccaaatatatgagcctcaggctccataacctagatctatcactacctctactatatttttacctgctcctacatataataaaggaattacccagttttatatcaaaagactgttctttatacgtgctcagaattccctcccttcatgcttttactcagaccttacttcattcgttttttcttggcttttgagcttctcccactctttctttctcatcaatatttacacattgtctggtatctcaaaccttaaaaattaaaaacgttatcccctcccatactctttttcagttaataccctctcttgattcttattcaaaattaagcccctttaaagagaggagttagtttcaactgattactccccatttattaaacctagccccagtttagtttctggcttcagaacttgtctaaaagggatcttgctaaggttattgattttctacatgtggttaaatccattagatccctttcagtttctgatatagtttggtcatgtcccaaaccgaatctcaacttgattgtatctcgcagaattccgtgtgttgtgggagggacccagggggaggtaattgaattatgggggctggtctttctcgtgctattcttatgataatgaataagtctcctgagacttatcatttattaaaggcacttcttccatggcggcgacaagagaaaatgaggtagaagtaaaagtggaaacccaggataaacccttgagatttatctggggtttccacttttacttctacctcatttcctcttgctgctgccatgtaagaagtgccttttgcctcctgccatgattctgaggcctccccagccatgtggaactgtaagtccaattaaacctctttttcttcccagccttgcctatgtctttattagcagcttgagaatggactaatacagtaaattgggtccggtagagtaggacgttggtgaaaagatacctgaaaatgtggaagcaactttggagataggtaacaggcagaggttggaacagtttgaagggctcagaagaagataggaaaatgtgggaaagtttggaacctcctagagatttgttgaatggctttgacaaaaatgctgatagtgatatgaacaataaggtccaggctgaggtggtctcagatggagatgaggaacttgttgggaactgaagcaaaggtgactcttgttatgttttagcaaagagactggtggcattttgcctctgccctagagatttgtggaactttgaacttgagagagatgatttaagatatcggtggaagaaatttctaagcagcaaagcattcaagagatgacttgggagctattaaaagcattccattttgaaagggaaacagagcataaaagttcagaaaatttgcagcctgatgatccagtagagcagaaaaccccattttttgaggagaaattcaagtcgtggctgcagaaatttgtgttaagtaacaaggagccaaatgttaatccccaagacaatagggaaaatgtctccaggatatgttataggtcttcctggcagcccctcccatcatagacccagagaagcctaggaggaaaaaatagtttcgtgggctgcccgtggtactcatgctgtgtgcagcctaggaacttggtgccctgtgtctcagctgctccagcttttgctagaaggggccaaggtgtagctcggcccattgtttcagagggtgcaagccccaaaccttggcaccttccacgtggtgttgagcctgcgggtgcacagaagtcaagaagtgaggtttgggcacctccacctagatttcagaagatgtatagaaatgcctggatgtccaggcagaagtttgctacagagttggggtcctcatggacaacctctgctagggcagtacggaagagaaatgtggggttggagcccacacagagagtccctactggggcaccacctagtggaactgtgagaagaaggccactgtcctccagaccccagaatgttagatccactgatagcttgcattgtgtacctggaaaagctgcagacactcaacaccaacccgtgaaagcagccaggagggaggctgtaccttgcaaagccacaggggcggagctgcccaggaccatgggaacctacctcttgcatcagtgtgacctggatgtgagagctggcatccaaggagagcatttcagagccttaaaatttgactgccctgttggatttcagactgtaacccctttgttttggcctgtttctcccatgtggaatggctgtatttacccagtacctgtactccaattgtaactcttctcaggaaaaaaatcagtcagtgttacagtttttaggttcaggtgagaatccttacataatcttaattttagtagccaaaaggccatgttgaggatcattaattttctcccttcttatagggagtaactagcttgcttttgatattacaggcttgtaggcggaagggacttaaccttgtcttagatgtggtttggactgtggacttttgggttaatgctaaaatgagctaagactttgggggattgttgggaagacatgattggttttgaaatgtgaggacatgagatttggaggggctagggctggaatgatgtggttcagctgtgtcctgatgtaaatctcaacttgaattatatctcccagagttcccacatgttgtgggagggacccaggcggaggtaactgaatcatggtggggcagtctttcctgtgctattctcatgatattgaatacatctcatgagatctaatgagtttatcatgggtttccacttttgcttcttcctcatcttctcttgcctctgccatgtaagaagtgccttttgcctcccgccacgattctgagggcttcccagccatgtggaactgtagttccaattaatcctctttttcttcccagtttgggatgtgtctttatcagcagcgtgataatggactaatacactttccatattgaattcttaccagttgttaatgctgatgactcttaacctcttcttcctcctttttcctattctttccttaaaaacacatttctctggcttttgtaacaccatattcttgtggcttttttcctgcctcagtgggtacttctaagaaaagttgtatttatagtctctttttgcatataaaggtagcagaaccttaggactttgtttaggcccatttcttcttcctgtcccatcccctaggcatctcattcagtgccttaatttcctgctgtcaataagccagcaattctatctttattccagaatgttaatcttagttacagattcatattcaactgtcttctcaaattgaaatctcatggatcataatgaaccagtgatttccactgctacctcaaaactaaagaaaaaaaaaatcctgtgttcttacttaagtggtgccattttcagtccataatctgccaggcatgatggttcatgcctgtaatcccagcactttgggaggctgaggcaggtggatcacttgaggtcaggagttcgagaccagcctggccaacatggtgaaaccccacctctactgaaaatacaaaaattagtcgggtgtggtggtgggcgcctgtaatcccagctactagagacgctgaggcaagagaattgctggaactcaggaggcggagtttgcagtgagccgagatcacaccactgagctccagactgggtgacagagcgagactctgtctcaataaaaaataaaatgtcatcatcatcatcatctagttgttcaaaaaaaaaaaaatagtaatcattatcatcatctagttgttcatgccagaattctgttattcttgatattttccttcttacctatctcttatcctgctcagtcaagtcctgttggtgcccttccttgcatatatgtataaatgtatatgtatgtaattttatctcttttctgtatttttacttttaacaaccttcatccatgctacctttatttctggatagattctgcaatagtcttttaacagatgaccacccacttcacacagggactttaaaggtgtttcagagacataaacctgagcctgttattcttagatttaaccattcagtgactgtattagtccatttacatgctgctgataaagacatacccgagaccgggcaatttgcaaaagaaagaggtttaatggactcacagttttacatggctggggaggcctaacaatcatgggctggggaggcctaacatggcagaaggtgaagggcatgtctcacttggtggcagacaagagaagagaacaagagccaagccaaaggggaaaccccttataaaaccatcacatctcatgaggcatattcactaccacgagaacggtatgggggaaaccgcccccatgattgaattatctcctgctgaatccctcccacaatacaggagaattatgggagctacaatttaagatgagatttgagtggggacacagccaaaccgtatcagtgactttgcattatacccagaatgtggtggggaaaaaaattcttaataggaccacaagaccttgtagattttaactcactgcctgacttttcattgtaatctctcccttggttccccaagctacactaacctcctgttagttcctaaacatatcaacttctttactgccttaaagtcttcatcatgctgttccatggccaagaatactctatagtcccccagcactctggcatggctaactcccactcattattcaagtctgagcttaaatgtcctttgccatggaggtcttccctgctctccccaccacctccaagactaagctcccatttttatacctctcacataattctgtctcatcacaactttctttttataacaattgtaatataattatttgtaattatttgtttataaatatatgtgaagttaatgggtataatgttttttaaatgaggctgagaattttctcagctcagggaccatatctctcttgttcactgctgtatatattcccagtgttcagtacagtatcttgcccttagaaaatgcttcttgcgagaaaaaatatacatacatatgtgtgtatataattacatatatgtggatgtgtaatatctatggctgggtataaatgtacatttgcacatgtgtataaaccaacaggaaaattaacactaacacttctcaggaatgaaatcagtcagtgttacaattttcaggttcaggtgagaatccttacgtactcttaattttagtagccagaaggccatattgagtattattaattttctcccttcttataggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagaggtgagtttaacattttcattgtcccctttcttccctaggtctttcttacaatgctatagcacaatgtaaggttctaattatagagctacctaataattgagagagaatactcagagagtatgtttggatttaattggtaatttagacattcaggagacctgtccagtcaatatggcctataatctatgtcaaattctcacttaaataatttatctcagaattttaaaatcttaggacattgttcagtctttttagacctttcaatcaaggtaccagccattagcagcatgctagttcctcgatataaagaagaaaaatcctgatattacagtggattttaaaacagatatatgctacttatatcaactgttattggaatttgtccacgatgcccagattccttttcttgtaaaattgctatgtgattgcataaggtcagatggaagaacttcccttctcaaggaagaaatcatttttataaaatattgttaacttatatgtctacctcaactagtttctttctttccagccatctctgtttctttatccatctctgtagctgcatctgtgtagccattcatccatgcattcatctgtcagggagttttggcactgtaatagtaagcaaaggacatacgtgcttccccaatcagttactgttaagaaattgctgatagttgtctagctgttaaactccatgaatgtggctagaggtctttatctgtgtcattcactattatatccctagtggtaatatggtaactgcatacataatacttattgagtgaatgaatgaaatgtcttggtgcttatcaaacaagtttctgaggtctttatactgaataggtgcttaataaatattaagtgatacgatgtctctgtgtttatctaaaaggagactttgttcttgtgtttttgagaacaaattgcttttgtctaaattttaatttttttttcttaaagatgcagttaaccctttcctgtttcaagtgcatactcatttttttcctcttcccccccacatacataaacaaacaaaaatatgcttttcctgttaagaggaagagatgtatttgaaatagtctttctctctacatcgtagatcatctatttcagtgattctcaatagagaatagccagacttcaaagttatccaggcagggtctacgatagggatgtggtatatggacacaagagctgcacaagtaattctgataaaaacctctaaataagaatgtttaaattcagcttattttattgattgggaaacagatctcttaagagtgggactttaccagtatcccacaatggaataagaaagcagactcttaaaatccgatctgtttgctgttaaatgaaaggatgattggggtagtaaggcagggatggtacttgtttttatattatcagagtagctgaaatacactatggtttattggtaatctttctcacatattcccagcttttaaaaatttttattgtacacagaattgaaattttattgtttatttaaaatatcttagatttgtcctccatctttttattggttttatactctgaatgcccctatgttgcaatataaatgttctgcctaggttttttcatctagcctagggaatataatgatttatgatggttctctattttagcagtttctaatctccactactgtggcaaatttgattgcctgtgattcctgctaccatttttctagatttgctggaggctatagtttcaataataattcagcttgatttaagagactgtcactgactaaagtatagtatcagtttttaaaaaataacatatttaaattatagtcttattatatcctttagaaaaagtattcttgaatctctaaaagccagtaagtaacattacagactatttctaaattggcataatccctgataacaatagctttttcctcaatctattaaaaattgttgattttattttggcccagagaacatcttatttgctgaaatagctgtggccaactaatatataggaagacctccagtcttccaagctaaaacatccaattggctataagagtttaaattttgtggatgatatactaagagacaactgaataagttaaacatgattatatccaaaataactgcttaaatattttttaaatgatacattttaacttttaaatggtatgcaatttgtagatgagtcagactctccaggaaacatggagatattttttgattgtctgttggaggaaaaaaatttcagatagtaaatacttcacttgtagtgtgagtattcactactaccagtgtgtgctgtgtgttcttttagactattgctatgcacatataagtatttgcatctgtccacactgccccgaaagttgcatttttcactcagcagtatatcatgagcatgcttctaagttagtgtagagctttacgtcagtgtttttaaaatctacatagtgtcacatagtctgtatttataaaattaaattgatttaattatcctgtaaggcagtaactcgaaaaagaactattctgaagaatgtctttgtataaatacccttgcgcacttaggaatgaagtatagttagaagtagaatctttgggtcacagggcatactcatttagatgtgttggcactgccaaatttcccttcacaaagttgtaccaagttataataaagtgctagaaggagtttttacaaagctttaaaaacaaaattagagaaacaatatcgacatgtaccatattagacatctgtagaggttatatggggaacttaacttttgaaatcaaagggcaaatgagtcaaggcaattaaatgactggagctaattttttaactggaataaaaagtttttgcttcttgtgcatagtttacatcctggcttggtttgatattccgtggggaatttgaagtgataggtgtgttttttctgttgtttttttctctccacatttgtgtaatcctctcataaaagcaaggtatcttatacactttaatagaaaaccagctattaaaactcataaaaatgacatactctttaggaactacttttgttaacaggtgagatttctagaattgtgatgaatttagaagcacttgtgctgccaatactgattatgtaagttctttattcactaactgcagaaatctattcctcctgtagtttcattatctagtaaaataataatatgtttagagatatggagaatgacctctgtctcacaagcatggcatactagttagattgtagacaagtagatatagttttttgttgaatggaaatatttttttgaaagaaaaatttctcatgtttcgtattatttaaaattcaaattatgtactgctatactacaatccaaatattgcagagctagacataccattaatattttaaaacatgaatttacagaatgtctggttatctcatcttgtccccatcagctttagaatgagaaagtgaaatccttccactcttgtagtaggaaaaacctgccatcgctgatagaggaaaatgcattcataacagagacatattacataacatttttgaacatccttttgtaaggtatggaagctatttatatttcctggacttttcatggtctacagaaaagtgtaccccagtttgggtcatttcatttcttgtggccattgtagatttccatgaattaaaatatgtaactatttaattttaatggtgacatttaaagtattgcaataaaatatgaaagtgatagttcttgaaatctactttcttgtttgagtatcataaaatggagcagagaatattatcctaaagaatcaaaagtgttctttctgatgtgtctggggtaatgttttaattcttaataataattttatatgtggattagaactaactcaaaaattcttgccagttccatgtgagatcaaaatgagtaagcaaactttgctaatcaaattttaaaacttgagatgtttcttatatttttcataattttatttaatccgtttcaggtattatccatataaaacaaattccttaaactttagctttcagtaaaagataaccatccagctcaggaaatctcagttcaagtaattatagcattttgaaagagaaatagtattgaataccatttgcttttatttgctgtagagaaaagtagcaactttccagatcctcctcagattcagtttgccagatgtgtgccattcatgctttttttggatgttcaaatttaaatttggtatattcttaacttattgacagatgtgtggtggcattttgtgacacttgaaattatcacacacaatagattatgcagcagtttcgcatattgcagtttataataagcacttcagaactattttatacttctgttctttgttgatttacatacaatctttctttctctttaaatacatatgcttatgtataatttgaggttgtatatgaaaataattttcttttaaaaatgttgaatttcatgcttaattgaacagttaccaaagcatgtatggggattaggggctgggggtaggggaaggaaattacggctatactcattatcagaatttggctcatagcaatgagacattcaattctttaaacactagttattttaaaagattttaagtaaattactctaagtattaactttttgttagtgatatgtctttttcataaattagtatgaaatccagcagaggagctaaagctaaaacaggaaaacaccattttttcatttttagtatgagagttgtgacgatttatgatataaatttttttttgagtactccctctcataagttattttatcacaggattttgatgctttggttaagtataagtgccattcaacatcacgttgaagaagacagagaagacttgagctactaagtcatggttttaaccagtgtctttttctttgggctagaaattctaatgtaaagaattattttcgaaggatagttgtgagatttctttttttcctgatcatatattatacccactcttggaattttcaagaggtgtggaaaacttttagaaagaggttgagttttaactaaactgtgtacccagttacttgtcaggtccgcattgtggtgatacatataacaatgtcagtgcccacatcctgtgcctaagattgcagtgaagaaaacaaaggtggtattaaagtttttgttattgttttatttcctttcagcattggtttactgaattaccacctgtgttaacatttgaattgtcaagatttgaatttaatcaggcattgggaagaccagaaaaaattcacaacaaattagaatttccccaagttttatatttggacaggtatggtttgatatactgcatgacttagtttgaaacagtttagtaagggagaaaatattgtttagaggaaaattctgcataattttcttagaattaatttctacttttgcataatatacctaataccatttgtcaaggtagatgaaatttactttgtattagaaaagtatagtttttgggaataatgttataaggaaatttaaaaaagatgaattttgtaatcttaaaattcagaattttaaaaaataccattttgtattatctaccttacatcttatacaattttgaatgaattgatgctttgtggtgatgtctgtacttaatattgtatctatctatctttctgtctttctttctgtctctctgtcttcctgtctttctgtcttcctgttttcctgtctttctttcttttgtttttttctgtctgtctttctgtctatctttctgtctttccttcttttttgttttgagacagagtcttgctctgtcgcccaggctggagtgcagtggtgcgatcttggctcactgcaaacaccatctcctgggttcaaatgattctcctgtctcagcttcccgagtagctgggattacagacacccaccatcgtggctggctaatttttgtattttagtagagacgagatttcaccatgttggccaggctggtcttgaactcctgacctcaggtgatcctcccgccttggcgtcccagagtggtaggccgggtacgctggcatctggccatattgcatctactttcatgatattcggaaatgctaatgattacctttttctgatagatacatgcacagaaacagagaaataacaagaattaagagggaagagatcaagagactgaaagattacctcacggtattacaacaaaggctagaaaggtattttaacttttatgaaattaggagataattatcagaaaccatgtatttggtgactagatttttaatttcaaatttgctttgagtgatttataattttaggagtagttaatattgtgtgaatagttttgagttttgcttgaaactaaaaatctatagtagactttaaaaaattattctagtgtttaaaattaaatatctcattgtcaacaggtaatgttcctactgctgaaaatagatacaaagttaaatgaatatagttttgaccttcctttttgcatgaaactaaagattactcttgagattttcattaaaatgaatggtatctgagtttttctccttaaaacaggatacaaactcagctgcctaccaagtcttctcagcagcttcgtaaaggaggaaattgtgtcaggtgtaagatggtatgtgccgggagcctagagagcaatctgtgtgtacagggaatgaatgccattccataccagtggatggtaccatgtatgagtatggcctcactgttgtctattgatttggatcatttctaaaagacgtcagaatctggactgagaaatgttctacaggccagacagaaatctaaaggctgaaatgtcacaagtcatttcagtttgcaaaccccaatctgctctgcattcccctattttaggaattttcaaattagtagtctaaaacttcttacatcaaatagtatattgtattttaatgatttttattcttaaaaagtatgaataatcatattgaaacatgattagtggtaaaagataggaggatagtacacatcactgtcttgatcatgagaccagatgccagatctaaaaataaaaacagtctcaggagatgtcagttttcatcttcctattgagttacaatttagaacagcatttacagattataacagtatatactcacattcagtcccaatcggccttggtttcctgtctttggggaacttttaatgtttttcttaagtgtatattcagttttaccatcttcgttttaaagcaaatgaattttattgctgaggaagttttattgaagtatcgtatcacgttttataataataataaaggcccaaatatgctgtatatagaaataaaagcatttgtacattttatgattaacagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaaggtaaaaagtaatcctgatgcaagagacagttgttacctttattacacaataatgtaactgctgcctttaaagacagtttctataaaatgtatgctttgatttacttcagtgaactcctaagagtagattcacttagaagactgtatgtcctctgggagtttttttattatttcagtagattttatggttatggattaaaattttaatcacattttttttcagttcagaattatactttagcatgttttggtatgtacatatataagattcagcattttatgatccataaaaatagtactatcaaattagaatttgtttctgtaatgtaagctgataagccagggaaaataatatcaccatgcgtaagattttcttgttttttagaaataaatatgattaagctgttttaactctaaagctacaacttcatcttataataatttagttcttatgtattaaaaatctcatttggatgttagatcaatccacatatttctttaagattttttcttttgaattacaagccaatttaatactgtgggtttggcacgatctttgtcaagagtttcagcttgaaaggttaataagaaatactctatgctttgatacagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagaggtaagaagtgtctcatagcatggttactgtcacctcagatggatatgtgtaatgttaatattgagaagggaaatcacgtctggattttatatttaaatattatagtcatttttcttttccagaaagggttttaagataaactagtttggctccccatttttataatctcaatatcaggttcacagggaccaaaagattttccctggattgcttagctgattaatgacatagcagatggcctgattttctagtttgctgctctaaatttatatcaaactggtattcacagttactccattggagaaatgtcatacaatatcaatgtttgtacatatcaattaggtactaaatctaagtttgcacagggagttccggtgattaaaaaattttctttgggcttaagaattagaaatgtgaattttaatttttaatagctctaacagatttatgagtatctatgatcccattactagtctgtaacagagtttttactggcatgcagcaaaataagaaaaataaggacagtgctctgggtggggtgtgtgcacttgtgtgcgtgtgcgtgtgtgtgtgtgtgtgtgtgtgtgtgtgtgtgtgtgtgtcaagttgccatctgtcctttcttggaaggaactctcttttattcttttctattctattttttcttttttttcagaataagttattctgaacttttctctttcctactttgctgctgttaaagtgtacttaaaaaaatggattatggtagattttattacatttttttccttaaatgtgaaaatataattccctattatcattccccaattttatgctgatttattgatttttgaaaaaaatgaactatgtgacatggttggaattatattgaacaatattgattgttggatattatatgaccaacttaactctttatagacaatatttgaaaaagaatggccctaatttagtaagaagtacataaggtatgatggtgactaacagcattagtagctgtcaagattttctttagtatttttcaaataagagggaatttttaaaaatatttgaactcattaacaaacattaatcaagcaaatagtgttgatgaagcactatattaggcgttgggtaattttctactcctcatggcaggttgtttttaaaagattacattcagaggagtggaagctaggaagcttttgacacctaagtagtggcattgagggagggaagaagtgaatgtacttaaaatactctttggagacaactgacagatgtgggtcattggctagaggtaagagagagggacgaatcgaatgattctctcagttcataatggtatgaataaccaaatagaatgtattttggaaaaaaggtaaagcagtgggcaaagaggttcccactcaggggaggaaagagaaatatgatgagttctcttttggccattttaagtttgaagagcttttttgagacggagtctcgctctgtcaccaggctggagtgcagtggcatgaactcgggctcactccagcctctgcctcccaggttcaagcgattctcctgcctcagcctcccaagtagctgggattacagttgtgtgccaccacacccaactaatttttgtatttttagtagagatggggtttcaccatgttggccagggtggtctcaatctcttgaccttgttatccgcccacctcagcctcccaaagtgctgggattacaggcgtgagccaccatgcctggctgttaagatttttatatgtaatactatggatcaggaaagaaggttttcctcaggatattttttttctttctttcatccatattgatgttagcagttagcattattttgtaaactattgtgtaatattccaacacacgggtatgatgtaattcatttaattcccatattgatatttcctaaatagtgctggtcttcgatatacatatttatacacttctgtaagtaggatatgttcttttttatgttcaggggtacatgtgcaggtttgctataaaggtaaattacatgtcttgggggtttggtgtaagattatttcatcatgcaggtaataagcacagtacctgataggtggtttttccatcctcaccctgctcccaccctccaccctaatgtaggccccaatatctgttgtttccttatgtccaccatttctggttcagagtgtgtatattttaaattttgacgactgttttaaaattgtcactccaaaacattaaaccagtttgcattcccactgtgtgagagagcctgtctcccagtatcctccctagccctggacactttttagtagtttttcacaattgaaaaactggtattttagtgttttgatttgcattcccttagcttcgagtgaagttggatatttatattgttctgtaaatttcttgtttgtgacatttgcccattttttaagtattgagctatttgtatttttcttattacttaatagaaagtttaatgtattgtggatattaacactttacctataatatcacatatgctgcagatattattttcccagtttttcatttgattttatgttggttttgttttctttttataatgtagattttttaaagtgttgggcagggaggatcttatcttttcctataaggttactagttttctgacaggcttaagacaggtctttccccactctaaagttagccagtttcttttatagtttttcaaggtttcttcctgattggttcagcagcttcacaatatgatgtggttacaatctaaccgtttccttattgacagatatttaggttatctcttttttaaaaattattgtggacaatatgactgtgaacatccctatctgaacaattttgtaggattattttctactagaagtagaaataattgtcatgggagtgccataattttattttcactggtgattatagtcgatttttattcagttatgtgtgtgtacaagatatgtggtgaacatgttttactttgttcttaagtttacttgtgttatagcaatatgtaaggaagcttagctttcattttcattgaaactctcctttatagatttgaacaaaattcacttttattggctctgcacattttctagataaatcatatttgtgttgtttttaaagtatgcatttgtactgtgtcttttattaagaataactataattcattttctacagatttcaaatggtaatgttttttaagaaaagttttaggaaaattttcctattcctctaacatgtttgtaggaaaaacattagtccttatcttataagtagaaacacatttgctgttaatcattaaatgacaccttatatccttagatttgcaggaaagcatatccagaatccatcgaacaattgaattaatgtactctgacaaatctatgatacaagtaagtgaaattttgagctagtaatcattgtcaaaattatttacatatattttaatttacctttacattatcttaatctaatttttctttacatgttttgttttaaaattttggcaaatcttattgtaaaataataagggcttgcaatatgtacaatgtgacagttcatctgaatggggaaacttttataacaaatttataacaaaattcatgacaagttttccccattcagttgtattttcacaccgtatgtgttgtgtacccttactattttacagtaaaatctaccaaagtttttcaaaaggctatagcatctttaaaaagtcttatgggagaaaatctatggttgttaaaggatattaagatttgggaagaaacttaaggactccattacattttaacttctggtgtatatcatataatctattttgttaaccgtcaatttagaattctgaagatgtagacacatttgctatatgtaaaactgcccactataagctttttattcaaataaacaattaggccaatgagtatgtacacaataaatacatttttagtttttcaaaaatcatctttttaatctatcaactttgcatatctttagcttattcagattccgtctttttaaagttttatagtttagtttttttcaaacttttaagcccagccagttctctctcatttaaaaaaaaaaatgctcttatggttttctccaaacaggttgtttgtgggtttcatggaatgtggtatatagtaaactacataattgcagtttaactcttctttttttcacatttaggttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaaggtaagaatatatagggtggtgtgtatttttaaatagtcataaaagtggctctggtatgtggtgtgattagttaagtgtaattcactcagacgatgaaggatgtggttaggaaatgctactgggttttgacaagactgaattgaaaagtaatgtcgtcagggctaagaattcgtatatattttgtattccaagtcaactattaaaggtaaatatgacctttttcgtccttgctaaaaatgctttagtgactgttccacagattgactcacatttaatatttaattccttagcctaacatatatggcctctgttcttggcctctgattatctccccaccttcattgatcaccagtgttccttttgaatttatatccttactgaacttcttgctgtatctgctcatatcaaaccatttcacacatttatgtttgcatgttcgtatatgttttattttttgctagtaattcttttgcctaattcttgtttatctgtcaagattcaattcaggtgtcatttcccctgcaaactatttcttgatctgccaaaaagtatctctccttatgctgtcctggcatctgtctactgggcatttactgttgtgtattggaactgtgtgatgacttgtcttgcacatttctctcttatctgctcagagccagagatcatgtcatactatgtctgaatctttttaatgctgatattctgatatatgctttgcatatagaaaataataaaggtttattgaaactgataaaaataatctttttatatttagtcattcagaatcagctaggcagtccacttctgactaaaaaaatgaagttatttttctgtgtgtgtagtagaagttcagtaattcttctgaatactctattgtttttaagatcttgctatattaattttcataattgcatatttaagtctacttaatttcttcatatgacaaacaattttcattttattttgagctaataaggttaacatgattatgagttgtttacattttgtgaaaagttttactttttaagtgatcaaacatctggtattttccaatagtggcagaagtagtattacatcactgttagagtagcaaagaaaaaaaaaaatggccgggcgcggtggcttatgcctgtaatcccagcactttgggaggccaaggtgggcagatcatgaggtcaggagatcgagaccatcctggctaacacagtgaaaccccattctactaaaaatacaaaaaaattagccgggcttggtggtgggcacctgtagtctcagctacccgggaggctgaggcgggagaatcgtctgaacccggaaggcggaggttgcagtgagccgagattgtgtcactgcactccagcctgagtgacagcatgacactctgtctcaaaaaaacaaacaacaacagcaacaaaaaacttggctttggctttgtattttctgtcacttctactcttaagataaaaaaaaatctgagaccattacctatgatggattatcaaatattttcatcattgtttttctgagcatttgtttgagttttaaaaagttttgtagataataattatttgctaagcaatagtaattcttaagtaatatgattggctgagtggtaataattcatagtttaaattctatttgaaatgcagtctattttgagctttgcattttccctttaattcttaattttatactagtttttgaaatatgatttgcagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacaggtttgtccatttttattaagttgtgtttgattatcaatattatttttataataagatatgctcattattaaaaagttttagctatcttaaagtgtgaggaaatcagtagaaatcatttcaaattccatcactcagattatcacagttaacaatttagtttacctttttgccagacaccactgtatatatttatatgtttttcaagataaatgagataattctgttgactttccctctacctactctgcctgtgttgggtgggcttgaattttcttggcaagtagcagagaaagctgtgaaatcagcaagaaacccaaaccaattcactaaagctatcaagagtatcaattcaataaagctatcaagagtatcaattcaataaagctatcaagagtagtaattttaaatttggccaaaataatactaccggtatattcatatatactttgtgcaatagtaaaatactaccattaataactatttgatgtttttcggaattcttaagattaagagaaaattgaccaaaactatttagtatatcacaggtaaaaagtaagtgtatagacctgtaaaccaaagatataaatgcataaacatataaatatttaaaaacattattctgaaatgaactattagctgatgaaatcaataagtcaaagtaaacactgtataggaattaagaaaatagtttctagtaaaattgaaaatatattgtctttttattttcttaaaagattactcttcactgagttgcaaatatgttttagggcaacatgttttctggtatagaaaatgctatttctcagagaagctataaattaagcgcatatattttcctcaaactcatttgtctctttttataactgctagtggatattattgaataactttttttttttgcaagatctgcatgttttgtgttttaaggaagtagttccagcttttgtttgtttaatttcatctttcgcagacagaggtttccttgcagcattacctggttgggcttcagcattatcatttgaactttagaaggaattattacttcaatagaagattgttttacagtgctacaatgtagtattgtgactgtcgcaggcatgcacaaatctgtccagatacttaacttattttcatgtagatcaaataattgtcgttgattttgatcctgagaggcagataattcagcattttttaaaaagataatggtatcacagcaacatttggatactacagtgctatggagaataccaccattatagtggctggtgaactctaccattatgtagggctgcacttttcccccacgtgtacaaggctaccgcgtagagcaggtgaagctatgtgggtccacaacaatgtagtttttagtagatgtcaagaggtatctaagctcaaatcacagtgtagtaactatattatagttcctttcatttttaaaacatttctgtccctttgtgatttcatgctttgcattctgtacatattctttccaaatcactcctcagaacctgccccaagatggagctactgtgttattgttcccttaacatttacttattccattcacatgtgactattcttgttattagtgggaggaaggggctgcatagtgtactataagcagttgtggtacctaagctcccagacacaggtgaatcctccattcattggttaagctccagttttattcttggctcacctatattttgtgataccaaaatattaagttctatatatcctcctcctcttcatcctgtctgtttctcatctctccaaattttcagagttaacatattttatttctgcttagtcaaacgaatacatatttccaactaatattcctatctattaaggactagccttgccccatcctcattttacatttgtcatcttttttctttctctgtgaaaagaccatgtgtgcataactgcatccattttcatgatcaatacatctgaccatacactttacatggtgttttgtaatttttaaaaaatgcagtactaggtattggacatatattttcatgtctgtttttaccatgcaaaataatcttagaatgttgatatatttctgggaggaaccagaataaaagatgaagagatggaaatggtcaattcctattcctagataacttttatagttacctttcagcgtgggttatttagaaagcagtggtaatactacttctgtaggaaacattgtatcctccatagacttgacggaaatatgcacttggtttgaattagtagaagtagaacatgccaagtccataaatttacagagtgagattgttgtttaaaagattggtttctattactgttatctttgagattatattaagaaatttgttctctgttgcaggatagtttcacatatcataattgaataagactaatgtttcattagaaccatttattccctattattaatagggaaattttattttaatgtccatgccatcctcttctgattcttctcatggttttcaaagtaagtaatttaatttggtataatacttccaggatctcaaagcaaatctgtattttaatctctcaggtgttcactagtattaccagtgactagtggaaataataaaaggaaatcttgttcataaaatccaacagaatgatttttttcctccctgcaaaatcttctcgttaaagctgaaacataagacctcataaaattcaatttctactgagtgatattccaattaagagtactaattcatattatattaatcaaattagtatttgttcctcttctgctaaaatgtgatcgagaaattcatgcgtatcagttcaccagcaccattcgttccctactgagataataaatgatgggaaagtattttttggttcatttcatgctgcttccctagatctgcttactgcaaaggcaaacttacctgaatacttttgttgagattttcagccagccattctttgctgtcagtgtggggatcagaatgagtaggggagcaaacttacctgaatactgttgttgagattttcagccagccattctttgctgtcagtgtggggatcagaatgagtaggggagcaaacttacctgaatactgttgttgagattttcagccagccattctttgctgtcagtgtggggatcagaatgagtaggggagcaaacttacctgaatactgttgttgagattttcagccagccattctttgctgtcagtgtgtggatcagagtgagtaggggagcaaacttacctgaatactgttgttgagattttcagccagccatcctttgctgtcagtgtgtggatcagaatgagtaggggagcaaacttacctgaatactgttgttgagattttcagccagccatcctttgctgtcagtgtagggaacagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgcatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtggggatcagagtgagtagggtttttttttctgagtgtgaacagcacaccctacctaaggccacttaagagacactggagtcagaatctctggagaaaggatctgatacagtgctatcttaaagagatcttcagataattctgaggttaagcagcatggctctaggctgtatttataaaacagaaattatgctggagagaagagcgttgtccgagttactattttacttatattactcttgtcttatccaagaagtatctgaagtccttacaatatagcacacccagatttctttaaaaaataaggaaacactagtgaagattggaatgaagtgtattgcgtaaggttttataaatttctctagaggaagcaggcagagttggctctggaacttctctacactgtctacaagttaaaaataagctgatgttccaggagagtacggttggatcctgagagtaagacctggtagaataaacagtatcgtcagtgttctcagattccttgaaagcaggaactaggtgatattcttttttttttttctgagacagtttcactttgttgcccaggctgaagtgcagtggcatgatcttagctcactgcctgccgggttcaagcaattcttgtgcctcagcctcctgagtagctgagactacaggcatataccaccacactgggctgatttttttgtattttagtagagacaaggcttcaccatgttgatcagtcttgaactcaaattcctgagctcaggcagtcctcccacctcagcctcccaaagtgctaggattacaggcatgaagccaccatgccaggcctggtggtgttcttatttatatctccagcatctagtataataaacgacatatgatagatgttccttgaaagttttctgttaataagttcattccctatggagatttccaataatgaatttcttaggggtgatcctcagtgtaggagaacataaaattttaaagtagaaacaaaatagtcacacaataaggaggcaggccaaatacatggggtgaggatgtagctctttgtcccggataaatttatggtttgactctggtttctaaacctctctcccccacacccctcagactttcttcggaatggggcccaggaatctgaagtttcaaaaattccaccagcgattctatgcaaccacctaagcgtggctctttgtaggctcttacagggtattgtggacttttaaatacatttctagaaatggatgcactgtgtatctctcaagcagtccgctttaaatcttcttcagtgtgaacgtaataagtattgacttactagtaagtcaaaaaaataaagacttctgaaagatatcagagatgttggtcttatttttatagttaagagcaacccttactctttaatagaaagccaattggtggtaaagttgaccttcttaaaagattgaagaccataaccaggaaatatgcataagtaaagcacccccaaacctcctcaatagcctgtttcaacatgaagatggacaaaaggagcagactcagagttccctcagaatgttgagttgtcttctataacagctagagaagcatggccggaaaatcactctgtggaggccagtcatttgaaaatcctagagaaatacccatagaacagatgagtgattggagagagactttaggaataaggatattatttacctccatagagaactggtcattcatggtgaaatgagtgcatttaaattttttgtttgtttgtttccagtctcccagggtttcaaaccattgtgggtttacctaccgtgactacaacaccactcatctaagttccctgggaggtatatacacagggaaaaccctagagaaaattgttctgtatggcatttagggaatttatagctgtgggccactagtgatggggtttttaatagggttagaggatgaacaacaattgtattatatggtaaaagccgaacttgttctgctgttgttcctaacacagaaatagaaattactaaagtgtatggtagggtattagttgcgtgagccttccatacagaacaacacaatataaccagtacatgttacattgaatagagagtaattctttttgtttaaaaatatgagtaggtaggtacagtctggaaataatgtatcagaaatattaatagtgcttatctctgagtaatgcaaagagttttaaattttccacatttttcttgtttgttctagtaaacatttttattctttggtttgataaattgaagacaaaacctctttttttgtcttctttgacagtttttttatacggactttattttataatctgattcccttgtaattcttctaagaccacttccctgtgagtagcctgtgtttcatctacaccagattactcatcgtttctattgcatataggaaattttcctgtcattatggcatgttcatgaagtatccttcatcttaaaaatgttcttttatctttagtgttcatgaattttttcatattctttaagatcttcctcatatcccagagtctttgtgagtttctctgagagcacttctctagtagctattgtcttttccctcttaattccaaccttttcttactaccaaatgtattatgttcttctctattgtacttatattttggcttgccttccagtgtagagtctcatatatagcagggattttatgaatctttgatcagaccttacaatgtgctattccttctgcctggaatcttttctattcttttctccaagataatcctctacaaatccttcaagactcatctaagttagcacctcttctagaaagtgtttcttaacaggcagcattatctcaagtatgtgtattgggtccacagtgcttttataaaaccttgtgcgtaacttttattgaatttagcacattgtattataatagaatgtatatttatcagattttactcagagttccttaaaattagtgaagtatgtaatcttttttgttttttatatttttaatacctaatatagtactgaaaatggcacaggttcaataaacatgttgggaatgcaatttgaattttttgtttccaatctcccagggtgtcaaatattgtaggttcaactcccgtgacaacgaaaccactcacttaagttccctaggaggtatatacatagggcaaaccccagagaaaattgttctgtatgacatttagccagaagcattcagtgttactcataacgtttttgtactcaaactcctttatggaaggaaaccttggccctggtgacctaaggtggatttgacatgtgttgatcagataacattactcttggtcctaagaaccaattttacaaagattctaggtttcagtgggtcattagaccaatgtcagaccagatggatttattgctttaagttcacatccaattattaaccgttgacattatctgctatggtgaagagaggaagagtgccaaacacaaggaaaagttttatcaacaaggagtttctctcccagccctaaagcagctggcatgagccacctatcatgaagtcttccagaagcagaagtattgctaagctgatggtagccaaagattttctttatctattactcatgggcattgaaaggctattgcagtccaaaatcaggaaatgatttaatgaggacattaaacttcttttaacttctctccttcctttttgtacacattgtaagcatcctcacctctggttttccttatcacatagttttacctccatgatcttagttaactctgtcaaaaacttggtgtgttcatgtgcagtctccacacctttgtgtccaaaatatgtcttgattctagccaattttgtgtccccctgttgctctctctcttaatcagaaagcacatttatttctttttcatgttgctctactgccttctattaccttcaccgatctctagttttactttcctctctaattcgttcttcacaatatccccagaataattttttaaaaactgctatgttgccattatattatgtactatattatatacctgcatcatctcttgccatttctccactctcatactgtagtccagtcatattattcttttttttgaatgtagtccatgcttactgcatggactctccattcttccacctggaaaaacagctcattcattattcagcttaataggtcactttaggtcacatccaaattgctcacatcacttcactgccattgttcccatataaagtgttataatattgtcaaaatttatatatatgattatttggttagtggtgttctccacagatgactgtgagcttcatggagacagagactggctgctttgtcagagactcactgagataaaccctttaggtcatgtaaggattttgggcttgtctcatctagggaacacccagtggatgttcattgtacattgttggatatataagtctggaactcaaaagatggataggagatatcgtgaatttttattggtaccagtttgcctttcctctgacaacactcagctactggggcaagtacagaaaagatggaaggttaggttcattcagggttaagattttgtcaggaagtgtgaaggaagatgctgtggccagagaaaaatagctcctgtgcactctatggaaagtcagcccaagattgctgttcaaaccaaattcttttggtaaaatgctggcaattttccaaaatgagcttttgttatttctcatggcagaaaaatttactgtgaattccttaccataaactataatgagagctttctttcataattattggagtactcttagttctgggtttttgttttttaataaattctgggaagaagtgctatacgtggaaagatatattttactttgaatggaagactaaaattggttcttacataacttcagacatagaaatgaataaaagatttatcttagtatagactctgtggtttatattagatatataattgattcttttctcatgaagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggtaagaacttttcttttggctctctgaacatagccatggtcacgacatttcctccagtatagtggagagggacctgtcagggagtcaggagagacggggcccagtgatggctctgccatgggcatgatcagtgaccatgggcaagtcatctcatgcccaggctgtgatttcctcagctgtgattttaaagacacttttctcttaagtttctgtctttctgctagagaattctaatgaatcataatcatagattaaattgaccatttgatctggaacttaaaaagagaagtgtaaaatttagcagtatttctcctgtctctcacccattcctccatctgtaatctgattacatgggaatagttgagaatttaagacctaattgtcataatttcatgaaatgtgtttaacaataaaactactagatactgtagattagagtattatttaaaactactagatactgtagattagagtattattagaaggataagtaggatgttgcaaaactgtttgtgaatattttaagaacgtcctgtgcaaaaacgtcattaggctactctattgtagttttcaactacatctttttatagcggtaaattgagcatgtttggtgttatactgtgttatcagtgaatatggcattctgagagaagctatttcaagaatttgttactactaaaccttttagttcctgtagtcatttatcttttattagtgagcataagcagctctaatgcagattttgtggtagttccttttaatatttgaagattccccttgacaactaaaaagagtacgacatatcataattttacaacacgtaattttctgcttagtaagtgaattcagtgccagcaataacctgctaattgcaatgaggccttaaatatataataagacttcctttagccaaaatgttcaagagatatggtactctgttaattttgttttgatgaactaaataacaatacaaattattttttgtttgaacaattttgaaaatgtattaatatatcatcttattaaaatgtattaatttaaatagatatttgatgattccaaattttgcaaatgccttagaagctttaaatgaatttgatgtgaacatcactaactctaaagcttttcctggaaaatgctttgtttagtggatctgggatgtctgcttcttgggtgatggtaagaggaaaacctagggaaggagaaagaacagaggagtaggtacaaggggaaatagttttgtctgacaaaaactgcatttgcaaggcctctgctaattagaacttttatttgttaaaggcctaaattatgattaatgagtgtcactttttaagctggtattagaaaaccaaaagcattacttagcttaatgtagaatcctgattttaagtttggaaaatcatatggaatttaaatttgcagaagtcagctaaattttgattgctcagcttcataatatggatatcgtcttataaggtagcaacctactacctcatctttacttcagaaaggaggatgacagggagactatatgatatagacaaatacactatttgtctattcatttaattgttttctggagtggcatccacagttagccccattgcatatgtaaatcctgaagcaagtctgagaattcattaaccgtggcttgatcttacagtcagttgcttagcgtcatggtaactacttcatagcggtttttttcatttaaacttagcgtacactagaagctaaattgcacaggtgaaaagtatcttcagactttgggattaaacatttctggattttggaatattagttttatttattatgaatgcaaccttgaataaattgccaaatttctccagatagacctcagtcttcttttccataaaatgaaggtaattgtaggattagtcaagagcattatttgtaagtgcctggcatggcatgtagtaggcactgagtaactgttggtttccttctgttacatcagtcctagccgcttttcaaatatgcaatatattaaaatcaactttaatataagaaaaatttcctggaaagcgtagaatcatggaaattagagaaagtcttcaagtgtttaggcaccctgctttttagaaaaatgtctttaattttaaatggaatacttaggatattttcaatatagaagagtagaccctgagaaaaagtcatgcatagtcccactcactactcatagttaattattgtaaatatgttggtatttatttcacttttattttaatatgtagatttgggatttatttttatagttgagttgcatacaaaattttgtgttgccttcttttaatcacttaccttttataaccatttccccatgttgtaaactcagtgaaaacatttagtggctgagtattattccattgaataattaacttcttgtttatgtatctgctactcaatcgtatatttgtgtctacttttacattataaataggctgctagaaatgaaaacttttttcatatttcaggttatttccttagaatagatttcccatgctagaaatgaaaacttttttcatatttcaggttatttccttagaatagatttcccatggttgaattactagcttaaaaggtaaaggcacattaatgtggccgtggacttagatagcttttttgtcacccttcttatgagaccactttttaagaagtcatataattaatggatttcaggcaagtcataaaaatcttcgtattttaattatttttgcagcatattaactgagaaacttatttttaactcttttcaagtttagcctttgttaatgtattcatataagacctgaaaacaatagaaaaagataaataaacatgtattttactctagtgagcccttaaattctttacatggaaaatttttatggtactttgggatatctaaatttggcaaatgatactacagaattattatatgtggcaaagtttcttccccctttcagcttttacccatgtatttaatcagcattatgctgttgaaattcttcaatagtaactgaaaaggtttataaaacatttatgttccctaagtgcaatttttttcccccaaagggaatctgttttgtaaggattaatattctaagtgataaccatttgcttcaaatttatattttcttttcctaagatagaattgttttggattggtttgctagtgagaaatcatcaccacaaactccgaacagatttctgaatttacctgtttatatttcactcttgtgtacagagacctagcacagttcgtctcttatatgctagaaagattaaaaatccttaattaaatgtcatggaccaagcacatctctgtagaatgtgtgtgatagtagtattaggttaaaattattcaaatataaacaatttaaagtagcacaacaaagtagtacaatgactcatagctgtcattttatagaacagccgttacatacctggtgttggcttagctgcatattatctctcatgatcatgatacctgttcatgctgatcatttcctgttgaaaagttgtggattttgataaattaaggataagttgtggattttgatatatgtgtgtgtgtgtgtgtatatatatatatatatatatatatatatatatatattttttttttttttttttttttgagacagagtcttactctgtaacccaggctggagtgcagtggtgcagtctcagctctctgcaacctccgcctcccaggttcaagcaattctcatgcctcagcttcccaagtagctgggattacaggcatgtgccaccatgcctggctaatctttgtatatttagtagggacggatttcgccatgttggctaggctgatctccagctactgacctcaagtgatacgcccatcttgacctcccaaactgctgggattataggtctaagctaccacgccatgccaaaaatagtgtttattttaaaaggggcagtaccagttgcagctattggttttgttttgttttattgttcagttaaactctttttctatatatgcttccaggaagccaggaaatgttcacattgctaaaatttacccatatttctaatggaaatgaaacctctttaattgctgttataaaaatgttttttgtaatatcaaaacaaaagtttatctttgtgtatgaaaacttatgcaattcagttacttaagttgttttcaagcaccttcagtacttttggcttttttaataggtaaatagtggatatgctagttataaatatgttgaataagataaataagtatgtaaacatctgtatggtattttgaatgaatcatattagtgtcatgaagttttgaatgaaattttctgaattttacactgacttctgtattagtgtagattactgaaatacatagaatttgttaacaataaaaagaaaaaaaggaataaatctgattgagttgttaaaaatgggtatcagcttccaacagctttttcttattttcagcaggtgtttgttgaacacttaagatataaatatactggagcctcataggctgtatataataagttaaacaaaatagaatatggatattaactggatacacaattgattaccaaaaacaatagaaggataaaattataaggaaaaaaaccctacaaattctgatgagtttagaggaggtcatatcttattttggttgagatatcaagaaaggtttttgggagctattggactttttaaaaaattgtcagctatacagacaataatagaaaatacaactccactattttttatcttaagtacttaaagttctaaatactttcagggaaaaatgtaatgatattggtaatacccagtttgaggatgtaaagggaaaactgcagattttgtattactacttgatgaatgcatttgcttctgatgttcagttttaagtggtttcatttgataccaagtcaatgcaggtatttttaaaagatttaagagtatgtgcttaaacagtttaatagtgcatgtgcgttggaacttttaaaaataagtcatatggatacagggctgctgcttagggatgtgcaggttatacagttgtgcaaggatgccattgttctccactgttctcttttctaatgtttatattaatgatttccttctgcagaaacctgaaaatactacaagccaaccactttctaatcagcgagttgtagaggtggcgatccctcatgtagggaaatttatgattgaatcaaaggagggggggtatgatgacgaggtaccttttacagccctctgcaccattgctacttaacttttgctatttaatacaaatactttgggcatgcctgcaccctcatacttaatgtctattgccacataacatacagctttgccccctcatagtccaaaattactttaccaattattaacagaactttgaatttcaaatgaaaatttaagtagaaaacttatggaatttgtcaaaagaattttctgtttgtggagttaattcttttatgcagaaatagtaccagtttacttccaggttggcagattacaataagatttgtttaattagtacaaaaattttttgcatttaaaaataattttttatattccattcttgttttactggaattacttataatccttttcccactatctcctgccagaaaatcccacagcatgattgcaggatggataattgatatttttgcttctacagcctctccatgtgactgtgagtggagtaagtcatcaccgttactgagtgcctaccgttaataggacctccatgtttattcttatctcttcactgttaattctcatttacttagttttccaacagtatggaggcatttttgtttttcatgatttagttctttggaatccagatgaaaatgatctattgtcttattctatcagatgattttctccccttttccacttttctcttgagacacttaatattactctttttgaggaacggccagtaaagctgtttttgaacaggaacacagaggaggccgtaactattgggtagtgggggaggggggtgatttggaaaaatgcttgttggattctagtttttgtgggtttgtataagaattgcatttatgttaagttttttttcacgtaactttttttctgacttactccaatgttactatcatgctagagttaatcaccaaagtcagaagtgtcataaagacatatcactgtaccagtgtaagaaatcacacgccataaagagaataagcagatttgtgagataaactggtcagagagttttctcaagcaggtgttagatatattgcaattctcagtatataatccaaagtaaatacaatgagtaataggttcagtgaatcagaggtgacggaggcaatctcttgatttctgtaagatagcttcatagggctttgagtaatttcactttgcagatattttaaaatgtaaacagctaaaaataataagctattatgaaaacaaaaaaaatgcttaagtatttgtacttaatggctctacattgttctagttaactattttataaacatgctggctcttgaaaattatgggaactggcatgtttttaataaacctatcaatttattgattaagcagttaagtacttgttttaggatgtgccctctctcatttaaaaaagttgaattgtgattaatcatttaacactatcttttttgcaagtgcttatgtgacagagttgtgtgttttgtcgttttttaaaatttattgcagtgacagtttaacagtgcatgtgcattggaacttttaaaaatgagttgttatggatacagggctgctgttcagggatgtgcaggttgtacagttctgcaaggatgactagacaaggggcagaagtgggaagcaaattgagttcatgatgagctctctgaggcttgaggaagaggtaccttttttaattggtaaaaagggatgttgctttttctaaatagttcactcagaggatagcacatttttctaatttgtttgtctagaagcagggtgcctttttcaaattctccaattcagagaggatgcctttttgcagtttgcacaaaggctccgtatgagccagctgtgccctgtatggatgatcttaaaaggtgcttacatgcatattggattaaatttggtattaaaagtgcaacatttgatttataaatatggaaaacaaaagagtttcagcttgcatgtgaataaattattttagtttaaaaacctttttttaatgttaactatcttctgtggcagatcatgatgacaccgaacatgcaaggtattatcatggcgataggtaaatccaggagtgtatatgacaggtgtggccctgaagcagggttctttaaggtacaatgaacattttcattttcgtgtcttttctttttcaaaattaaacttcttaaaatattttatttctttgaattcagtttggttttctgtataatttctcttttcctatcttagttatggccaccggatatcctagggttttattttatgtattaattaacctaatactgattgtttttctcttaatccaggtaattcaagaaaaaaatctttttatttgagtcactctaatagtgtgcttttgatttgtcagcagaaatttgaattgtattttttatttgaagggaatgaggacattaatgaacaataataagaactgagtaaattgccctggtaatagtttattttatcttcattgttcatattattggtcaatatcataatattctttaattttattatcattaggtactaaattgctttttcgtttataaaatgatttatttattatattatttttgttatgtttccccataattaatttttgataacctagtcagttcaagacatgtgagaacatcaagctgaacacgattccatgatttacccacatctttttccctctaatatcagagctttacaatgttttgattacaattttttccttttacagatttgaaagatgaaaataccatgtatgttttgtcattttatttacattaactgaaaatcttcaagtttttttttttttcactcttttcaaacccttcttagtggttttaaaaagcagcttttttgaggtccagtttgctacagtgaactatgcatttctttctttttgacattaaaaatctaacatttttcattttctgtattttgccattatccaacttggtctttcaaaaactggttcttttttcactgtttctttcagtatacagtacaaaacaaaagccttgtacatagtagtagacctatcaataagcatttttgagtttgctaagattagggtgactaactctcctgatatgcccgggactgagggatttcctggactacaggatttaaagtgctaaactgggaaagttctaagcaaactggtcccaggacaagttgatcaccctattatgatcccataagaaaggttgaaaatctacttctaaaaaaagaagaaaaatgtattttttatagttttctgttttaatacatttctttatagtttctaggtttctaactggcttcctaatttttaccattagaaattccttcttatgcccagatagtctacattttcttttcttaaaaaaaaaacactgaatatatgtcctctaaagtatttatttcttgtggaaaagttatttatgatttacagtgccattgtcatttctgaccagattgggtcttcttatgttgaattgcaaatctcatttttattaagttaatatctgcatataaataatcacctaattgtatatattacaacagttagtaagcccccagtggataatgactttcagttatttaatctgtttggcattaattcatatctttaaatagaatatttgggttttttattcacagtttacacattacctgttgaatttgcttctgtggaatatgaatgatgagctctctttcttttcctgcgtcgcatacatacactgagagacacagctcctatcccccatacacacacacacacacacacacacgtaaaatcttgtaattttgattatatcagaattctgcatttgtaatattattatgtatgctatatgtgattgagttatattataaatattactactttctgtttttcccttaacttttgttttccttaaacttagttgttttgttttttggtttgcttagtttatgtgtattactgatttagttcaaagctgtccactgcttgtttaaatctcctctcattctgcctttaccagttttatcttcttgggacatctattctggagctttatgacctgccccaatctgtattggtttttcttttctcctgatccataactagtaacttgagatctcctttcaccatcattctggggattccctttgcatcctttcctttgtgtattttccatatttcatatatttttctttattggtttgctctatgattttgatagtacagcaagaaagcatgggcaagaatcaagtttgtggaagagggacagagcattttcttaaataagttatgttatattgcaactctcagcacataatctaaataaatactgtggttaataaacttcagtgaatctgaggtaaaagttttcaagttgctttggagattgagtcgaatttgacgttttactcatagcataaggaaactgtgctctttgtcagatgttaaaaataattactacagaatttctatttcactaaccattctccttactatcatcatactccctttcttgcttttttttttctgctggaaaaacacttacaagaatagtgggaatgtacattaggaaggaagtagtttatatgttgatattagcagccagactgcctgggccgactgctttctagctttgattttgggcaaattattcaatctttgtatctcagtttcccgaggtgttaaataactatttattttattgagtcattgtgagctttaaataaattgtatcaatgttacgcttttaaagtagtatctggttgatagtaaatgctcagaatttagctgttattgttgttagtattatcacgaagcttatcttatgtgtccagttctggtccacatatagtcggagatgaaaaatgagaaaaatgaatgtgccatatctgtgtcaaggacctttatttgctaatagaatttttttaactcatttgttagaaattgtcagtaccattttggagtaacaaaattagcagttttgtttggcttaacctaataattactatcataaaaccctctttctacctttttatgtctttagtgtgtgtatatgtttataaaatttctgaagtttgtgtacatttgcacctatctgtgattgagtaatacatgagtgtaacccctttatgtaaacatacatcaagttgtttctaattaatgcatgtttttggtaaaggtagaagcatttggacacaactctagctgataatatgtcaccttaaaaattttttcgtataaaaaatgaaagtaatgtatacaaaatgcagttgtattcagtaatatagaggtgtctaaaataaaactaacaatgacagtctctgccactgccatggccctattgtaaccattcttagcactgtgtatcttgtttttttctttttgtttataacaatgcacatatacagagacttaaaatttttttaatgtagattttactgttcataatattttgtaacttatatcactcagaaatctattgtgggcttaaagtttagacagtatcacattatctttactagctgtctgtatacacacatacacatgtgtacacatgtgtacacacaggtacacacatgtacacgcacacgtgtacacatacatgtacacacacatgcacacatgtacacccacacagtattccatgctatagatatattctcatttcttgtatcttaccctctttatggacatgtgtcctatattttctcccagtctaccatttctatttgaattagtttagagtactttttcttaaacaggttttaaaatagtatgttcgttttcctactttatggattttttttgccatattaaaagatctactcttacccaaagttatataaattttcccactacttacttaaaatacttttcttagtaaatttttattttttaaattcaaatgcttactgtttaactcattagcattttatttgggctttctgcgttctgtattaaatgaatttggtgtttttctattttgtgctgtcttcatcaagtttgcaattagggttatgttagctttggtaaatgaatttgagagctttcctgttttttttaatacttaaccgtgttagcgttggaatgatctgttctgttagttagaactcactcgtaagatcatacgagcctagcgccttcttgcggggtagatcttttaacacatttttttggttcattccatagttattggcatgtttaaatattcttcctttttttgattgattctaatcatcatcatcattcagtattaattcataaaatatgtacacaccatagaatctaacatatggttgctgcttctgtcttcctgtttcccctcaattagatatagtatttttaaatttttgttcttttttgtgcttagtgtattataaattgagggaaaagttgtttgttttgttttgttttgttttgtttgaggcaaagtctcactctgtcgcccaggctggagtgcagtggtgcgatcttggctcactgcaacctctgcctcccaggttcgagcagttctcctgcctcagcctcctgagtagctgagactacaggggcccgccaccacacccaggtaatttttgtatttttagtagagacggggtttcaccatattggccaggctggcctcaaactcctgaccttgtgatctgccctcttcggcctcccaaagtgctgggattacagatgtgagccaccacgcccggccgtgtttttgtttttttttaatatctcttctgtcctgccacgtcctgaaaaaatcttggtcgggtctattttacattagctttttggctatgaaagaaagctttttaactctgtgcctgtttaggtacttctgaatatggatttccttatgtattatgattagaccaactttttaatactctgaatgtttgctagtgataagaatagtgatgccactgtcagccttgttataagaaacttaggtctgagtaagtggacttgctaaagtttaacctccgaattaggaagttaccaacccagtcataggaactctttcaaccacaggccatcatcccacgtgaacgtctacccaataagaatgcagtatgaaaaagttaataggcaaagttgatctggaaaaaaaaatgcaatgggctacactacactaacttgagtccttcttcaaattgactttaatggttaaaactagtttctactatagaaaatccccaaataatagtggcttacggagagaagattctgttgtgtaaaaatgaaattcagaggaaagcaatacaaagttactatgataagcaaaaataaaagccagaagataaaaacaaaatattttcaaagtactcgttgcttgtatatatgtgtagaggtgggagggtcatattataattacaattatgggattagtgtaagttttttcatttattttaaaagacattaaaatttctttttttgtaaaaattttgtcggtatcaaagtacccttagggttttattgaagtaatacttttgtattataaaaattttttcttaatagttgtttcattgcttcataataatggtgtccctacttgccgtaactttatcacccttttttgcttttgaaatgtctcttaatcaccttgtttattcaatagatataaaaatgtttattagaatataaaacatgttgaaaagtacaactcggtgaatttttttttgagtgatactttccttatttacatggcctttaaggaatgtgaagaggaagaattatttatcaacatggtattaatgaaatcttgttccctaaaggtatacgcaggcctaaatcgttaatgcaaaaaatatacttctccatgcatcttgttaaattcaagacagcggtccaacatttccatgcttagccaaagaagactcttttcctcttggttgtgtacatttgtagcctgagttttaagtgccacatctttcaagtcagttacacatcctgcctttaggctctcagacttgtacttccaactctgggttatcacagtgtgtgtttacccatgtgaccaccaactaggccaagaggtagaacaggagtactccagaagtaccttttttccgccttcccatcactacagtctgtccgtacccaaaagtagccattatctggacttctaacaacatacgttagttttcttgttggcctttatacacttggcatcttttactctaggtccttttttgtctgactgcttttactcaacagtgtgtttggagcttcatccatgttatacagttgtcatttcttccctctcatggtattttgttgtatgactataatttttttctatccttctgttgatggacatgctaaaaaggtattgcctgtttatatgcagggcattgtcctaaatccagggatgtagctgggataatgatggactgagttcctaccttaatgaacctcattttctgctagggaaagaaacattaattagagttattagtatgataaagaaccagtgtaatgtggaaaaagaacataaaataagaaaacagagctagtacctagagggcttcttagaaaaagtgacttgtaaactagtaatacataatccaaaatgtagaatgtaaatgtttttctctcacttcctaattctcactccacagtgagcatctattcattgtttcttgtatatcctagagagatagatgagactggcttacattcaggcattcatcctgtatttataatttaaataaaagtaggagtatactctttctttttttttctttttttttttgagacggagtctcgctctgtcgcccaggctggagtgcagtggcgcagtctcggctcactgcaagctccgcctcccgggttcacgccattctcctgcctcagcctcccaagtagctgggactacaggtgcccgctaccacgcccggctaattttttgtatttttagtagagacagggtttcaccgtgttagccaggatggtctcgatctcctgacctcgtgatccgcctgcctcggcctcccaaagtgctgggagtacaggcgtgagccaccgcacccggccagaagtatactctatttgcttctttttcttgagtttatttttcatgtatatgtaattattcatatcaggatttgtagatttatctcagtatttttcctttgtttcctagggtttatcaaaatttatttaaatattctcctagaatagggtattcatgttacaacaaatttgaagaaagttaatacatttccacccaccatagaggctgatgggagcagtatgtcagcacactgataacttactcatactctaatttaggaaactgtctcctactagctgttaccagcaaggtctccatagtcctaggtttaaatcctaacattatcatttaataattgtgacctcaggcaatttattaaattatcagaaccagtttattcacttatatgagaagttatcttgagaattaaatgagataattcacgtggaactcttcaggcagtgtctgtcacataaagaacacctaagttgttacctattcttattaaatttatcagcattgttgttgctgaatatttgagttattttcaatatcgtgaacatttttgtgcatatattattgaacacttgcgtgaacatagcagagttgacaagtcaaagtgcttgcaaattttaaatactagtattatcaaattgcctacatgtagttatattgatttattctactattgatatttgcctaaaaaaagacattaaaaatgtaatctcatatttcaaaatgtatttctttgatctttgtgagggtcagtttttttcataaatattttggcaattggtatttatgttgactgtcattcatctttatacgtttattacactgagtttcttttagttaagtgaacattgatcttctaagacaattgattcatctgtaatttgcaaattatattttgtggtttataatttgtcttttaaatttattttttgtgtcttactatacataattttttagatcttataaaatacagcaactctttttatagatttggtcctgtgatcacttataaaattatgcaaaattttaattctgctgctttcatggttttataatactttttgttttgattacaggatagaagattttagttttctctgaatagtaaaatatccagatagtctaaacataaaatactgactaatgcctccttttcacgctgacttgacacatatactaaatcatacctatactaaatcccttatcagggatttatacttaatgatatactaaatccctacttataagtagctctaactgggtctctgtattccactgatctagttttctgtttttggacaatacactgaataccagtgatcttattgtagatcgtttgtaatacactttcacattttgttagaagaacacttagtaatttttgttcttttataaacaggaagtttggcaagcctcatttttcttctgatgatttttaaaatcaattgccacttcctttccaaatccttttagaattgtatttatgtattaatttaacatgaagcagataattttttttttagtattttgagtcttgcccaaaaggaacatgatacgccttttcacttttattgtcttctgttgtgttctttagtgaggttttataattttatttcataatagtcttatgtccttttgtttaatttattcctacataattttttttgcctttatgaatagggtcatttacttccattttttttttaaccaggttattgaaagggtaggtaacgggataattaattttacatgtttatgttgtatttagttaactttattgaactctttgttttctaatggtttttcattttattttcttgattatttcagtaaactgtctcccaaaaattattttctatatctttatttcttatttcatttctggttttattgcggtgatcagaaatttttattacatattctcaatattgaaataatggtagtaggtgcctttgtctagtttctgattttaatgtctccagtgttttagtattatgtataatgtgtagttttggttccgctttatgaattttaaaatactctcaaattagtagataagggtttccagctaaactgattggtattgaaatttagaaattttataatatacctattaagatgctgaatagatttctccttcttaatacttgtaaacccttaattcttaataattgtaaaggtgttaactttgatctatgtttaaaaaaattattgtaaacactttttgttatctcatatattttttgtacaccacactgtttgtttaccaaaagtgggtgtgggtgttggcatctgggtacatagacaaaattgatctatagtttctttctttatatttgtcaattttggatatacaaattatatatatataatatatctatattatatagccttttataaccattaaggaggctttctcttgttttgttttgtgtttttttttttgagacggggtctcgctctgtcgcccaggctggagtgcagtggtgccatcttggctcactgcaggctccgcctcccgggttcacgccattctcctgcctcagcctcctgagtagctgggactacaggctcccgccaccacgcctggctaagttttttttgtatttttagtagaaatggggtttcaccgtgttagccagggtggtctcaatcttctgacctcgtgatctgcccatctcggcctcccaaagtgctgggattacaggcgtgagccactgcgcccggccgctttctcttgtttttctggctctgtggcagtttagatatcacagaaattatctgatccttgaagatttgacataacagcccagctcgaaaacatcgtgggcttgatatctttcgtgttaccagatttctagggcaaacttttaagttttacagagtctgttcagtttttctgcctctgaaagcagttctggtagtttatatttttctagattattatctgttgggatactgtagtctattaacaaagttatatgtgttattcttcaagaaattttaaaacattttttctgtattatcacctttcttatttctaccgatgagttttcttcccctttttggtcttccatccaactttttggaaagaaaaagcctttgactatcaaattgttacattatattttatttctcctactttatattttatttttctaaattcttgaaatcttttctatatttaaattggatatatatatgtatatatatatatatatctatattttttttttttttttggatggcgtctcgctctgtcgcctaggctagaatgcaatggcacagtatcggctcactgcaacctttgcctcccgggttcaagtgattctcctgcctcagctcccaagcagctgggattacaggctcccgccaccatacccagctaattttgtttgtttgtttgagacggagtctcacactgtttcccaggctggagtgcaatggcatgatctcagctcaccacaacctctgcctcctgggttcaagcaattgtcctgcctcagcctcccgagtagctgggattacaggcgcccatcaccatgcctggctaatttttcctattttttagtagagacagggtttcactgtgttggccaggctggtcttgaactcctgacttcaggtgatctgcccaccttggcctcccaaagtgctgggattacaggtgtgagccactgtgcctggcctggaaatttttttgactaacagcccaataggttttgatatctgatattcccatattagtatagttttttatttctttggctcaagaataatttagagccatattttaaattttctaagtatttaggttggaagatatctctatttataattcctatttgtattacagtgtggtcaaagaatatggccaatattatttcagtcctctggaatttgaagtaagttttcttcatttcttggcactgtcagtttttaaaaaatagcccataagcattttaaaatacacataaactctcttaaccaactttattttagagataagagcaatcagacttagaagattatgtgccttattctatgtcacaattaattataaatgatgtatctagctttttgaattttaatctcatcagtttcccattagatttaactgcctccagaatataaatgtttatatttttggtatccacatactcacatatatatatatttggtatcttcatatatatatatatatatatatagagagagagagagagagagtttacataaaaaattaagtccataagaagttataaatttagaatatggttttacagtattacttagaaaagtagaaaaaagtctaggtagaaattatttgcatctttagaactgaacaaggtctcaaaagcatgacttaaactaattttgctgatgggtcatctgtaggtagatggggaatgaacaagaaaggatatcacacatatggagaacttaagaaacaaaggcatgtgtgcatttgtgaggagacaagcctaacctagataggagggagatccttgttgcaggatgataggaaataagattgaataaatggcattaagcctgattaaaggtctagtgaaaaagttaaaaaagttaaaaaaattaaatagcagttctgtcatctaatgactagtatcacatttcattttgcacatgcgtggtgatttcattgcagtgtctgtgataattaacttaaaataattagcatagaccgccaaaaaatatgggcaaatataattctagaacaggattctgaggaggtagtatgagacaaatataatgttaatttactcataatggcagattgtgtagaactctgctaaatatactagcatggaacatctgttgagaatttgaataaatatgattccagtatattttaaaagccaaaaatttcttaaggaagtgtgtaaaaaatagttaaggaatgcatttatgctagtgaaaatgtttttttgtatgtttgaaaaacagcttctagaaatttagaaggtaatttcttaagaaggaagtgtataaaaaatagttaagaattgcatttatggtggtaaaaatgttttcttgtgtgattgaaaaacagctcctagaaatttagaagtgtctttctacctctgctggtttaaacacctatatactgaaaaatactgtgactttggcaatttgcttgtgaaaattaggagagtcttaaattcagcaaaatcaagaggtgaacatataatcttagagtataagaggttatatatttcagttctataatagaaatctgctatttattaaaacagcttctattttgaaagtaggtaggggaatgatgaccatttagtggaatcactccgtgcatgtaaacctgcaatattaatttaagagactcagtacaaatttgttttattttggtcatgctattttgtactaaagtatgatatacgaaatatttgaatattctaaaagtctattacaggttgagtatcccaaatccagaattcaaaatctgaaatattgcaaaatccaaaacattttgagtgccaacatgatactcaaaggaaatgttcattggagtatcatggattttggatttttggattcggaatgctcaaccagcataatgcaaacattccaaaatctgaaaaaaatctaaaattggaaacacttctggtcccaggtatttcagattagggatactcaacctgtagcctgtgacaatcattatcgaaggttcatatcaacaagaacagtaattgaattgttaatgttttagatttattctcaaattcttcctactttgattattatgtttggtctccccccttccccgtttttttttttttttccgaatttggataataggaagatttttaaagagctctaagagaagcttatgtgtgctacctaggcacacagtaagcgttgataatcttaaatattaaaatacagttgatatttatggctgttatttattcacataagactttggaatgacatgtatatcctcaaaaaaaaaaaagtcagttttttcaagggaaaagtattttaaaataatttgttctcttattctatttataatcttatgctgcatagaaagaacatattagccttcctttttaatgagtatgatattacataactagaatatttcatttaatgtttatcagttattttttctcccatctgtacaatacaaccatatagatcataacatctagacgtcaaagaattacttaagaaaggcatgcattttttaaattaaaaaaactttttaattgaatggattttttgtaatcttgcctgaagcccaaaatgtttatgcttattagagctagaatttacatataagtataatataaatgaatataaaaagctttatcttaatcatatggtcctcttgtacatagcaatatgtacaatatgtgtaaatctatacatatttctatatggtcagatattttctagattttgcttgtatattaaaacatgcattagtatttgttatttcccattattatttgtatattatgaggtatttttgtttataaagaaaaactaagtttaaaccttaaggtaataatagtgataatatattatcattattattcttacattaataaaatgtacgtactgttggagcaataaatacttctttttgtgataattataaccccggggcttgatgttgcattccttatttgtgggctattcagctaaaagttaattgcaataatacgactatgcatttaagaacaattttctttcagatttgagtattgttgggagctatatatcaactctagaattttagtgttcaaactgatgcttagaaaggtaaaacagaacgggaaaacttaccatctccatcttatgatgtctgtgaatagactttgactaggctctgataaattttacagaattactcacattgtaagtttagacatattttaccgctttcatgtgtggaagcaaaaagaacgtttatatagtgaagggataaagaagggcctttgtggccaggcacgtggctcacgcctgtaatcccagcactttgggaggccaaggcgggcggattatgaggtcaggagtttgagaccagcctggccaacatagtgaaaccccatctctactaaaaatacaaaaaatttagctgggcgtggtggtgggcgcctgtaatcccagctacttgggaggctgaggcaggagattcacttgaacctgagaggtggaggttgcagtgagccgagatcacgccactgcaatccatcctgggggagagtgggagacttcttttttttttttttttttttttaaaagaagggcctttgtggtcagttattcagaaaattccttgagtctatggaacatgggactgtgttcttagttgtactgccttgtttgtgatactttaaaagccaaaaaaaaaaaaaagatttaaatgcaagaagaattaaactcataatattgaaggattttttggtgttcaaataattaaccaaaattatcattttcattgcattttccaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtaatttgaaagtataaaattcatatgctcaaatcgttctttttttttttcctgcagattcccaggataattttttgagtatttattttatatatgcatgggcacatattttaataaatacgtaacaaaatttgaactcaatgtgactagttgctggagtctgtggccttttgaagtttgaactgaaaataacttagatcattttaataaattttaattgtgaatcaagtaatcactgcacttattacactcaatattttagaaacaaaaatgggcttctcaacctctgtactatatagacagtttaaattagataaatctttgttgttggggctgtcctatgattgtaggatatttaataatatccctcatctcttcgttagatgacagtagcagctcccaagttgtggcataccaaaatatctccaggtattgccaaataactcctaggggagcaaagtcacccttattagagaatcactggagaaaagttttcagtcttgcagataaaataattaaacattctttgacataaagaggaggcttagaagggttaaattagattcacgcagacatattttctctggaaagagaaaatattctatagaaatttctgtagaatttctgtagaatatagaaaatattctatagaatatttccagagaatgttttctctagattatattagtagttttataaagaattattcagaaagtcctattaaactactaatgttaaaaatcacaatttaattagaatgagtgacactagaaaataatttcagggcccatgtgaaattttagagtattgaaagttattttcatatataaaaacatttatgctgttgcagttcattgtaattttaattctgaaatgatcatccttttatgagtgtctcaaaaatactgagttaaaagtgtatagcaaagaatatgaggggaggcaaagcatctggattgatcctaccttattagatatgtgccgtgaaatgtaggattctgtgcataatacaaataaatagttgtgaacaatatctgataggtggttgaatgctcagtgaatgttggccactactgtttatattagtagcagtgtggacatcatttattttgatacatgcgactgcagagagttcagaaacagggttgttgtgaccctcgttatctgtgctatcagtgtactgagttccattggatctatgctgtttaatttggagaagatattaatggagtaatcacattgacttttcagtcttttgcagttctctgactataactagttaatctgttttgataacctgacttgtgcttgaaagacagagttatgcacatgtgaataaatacatttcgtgaggatttctttatcactgattctgatcataaaatccagtgggatgtttccatttttacctgagatgataggcacgttttagactctttagtatttaagaataaataataccatgtggggggaaaagaagatgcagtgtctcttgagcttgcttaatagatgcacattattttttaaaagtttcatttttttcctatgcaaactgtgttaattagaatgtaatttaaaagccatatatcaatacaacacagtaaatttgaattagaattattgctcctgtcttctttgtaattccccaacattggtcccaaaaatgtttttcacttaaggttatttaggagttgtttctatacaaaagtactgctgtttttgctcagtgtttatggattttgcttttgatttacaaatatatatatatatatatacacacacatacacacacgctcatatgtatgtgtttttttttaaggtgtcacaacataatgaaagttgctcaagccaaactggaaatgataaaacctgaagaagtaaacttggaggaatatgaggtaatgtgctttcttagaggttaaactacagatttagggattctgtaattcactgatattcctttcgtttcagcccaactgaagttgaatttgttatgaatgatgagtaaaaaaattaagtttccaagtcaatgctcaagtaattaataattttatatgtgattttaggattaacatgatatgatagcatgtagaccaaaaagtttaaaatcaaaaaaggaagatttttggttttttatttcaatactaattctcaagtactttttaaatgaacttttctagcttaaaaacagaataacaaatgcattgttaattttgaaatcaacttagaaattgctgttacataataccaacaagtaatatttatcaagaccctactatatgccaggcatttgtctaagccctttacatatattaactgatttaattcagacagtaacactgtaagataggtagtgttcttattcccatttgacacacgagaaaataaggcatagagcagtgaagtaacctgcctaaggttttcacagccacaagtttacagcttggctaatagaacctacattcttaactgttgcactacactgtgcaactgtaccctgtgggctgtattttttccttcactttgattcatcagatatattttggggaagttaattcattttagtccctatatgccatatatgtttgtcatgagacagtgttgtgtgtgagagagcacttacataggtacttgtacatgtgcttgtgggatttttttgtgcacaaaattattttttgtcaactttggctttaaaatattctttattttaattgatgaattcatacacctagtatttcttcacatttttaaatttaatcttatgcattgtcttttttttaatttataagtctagtaaattttaagttgttttcttgggtgcctttgcttaatatttagttccatttacaaacttaattatggtactttagattccctaaataattagtgtaattcactacacaaacagggaagaggaaagagagagaaaacactcattattgatgaaaaccttagctagtttggcgtataaggtaactaccttaattcactaaagagtgtctctaaaaacaaaaataggaaataataaaactgcagcaaatatatagaattgtgagcactgaaagcttaaaatttttgttgtcaaaagcaaggcaatgaaaataagcgaaaagtaaaatactggaaaagaagaaacaaagacatcattatttgtagttttttttaccttgaaattcaaataaaatctacaactgatgtattagaactagtaagacagctttgcagcatgcaaacttgtgtcagacatcaattttattcccttttgccagtaaaaaaagtatgagaaagtataaaagtgagaccatttacaatagtatctgaaactatggagtatatagaaataaatttaacaaaaggtgcgtgtgacttctgtggggaaaattataaaacttattgggagacattaacaaagacctaaataaatgggcatacatatggtatttggaaaacttgatattattaatatatagatatcacttttcccccaaatgctttataaattcagtgcaggctgtatgaaaattccagcaagatgttttatggagcttgataagccaactgaaaaatgttacggaaatgcaaagatcccagtccacctcccatctctgacaagcaagttagtgaacagtataaagactttttaataaatggttctgggaaataaataaaatttgatttcttctttattccatatgcaaaaattcatttcaattgtgaaagactcctgtgtaaagctgtttagaagtcaacataggtagaagcccaaagacattcatttatccataagaggcactcactgaccagatatttttgaccaggatatgtaatctagagccagagaaattcaaaatttgttttctcttgaccctgaggagcaagtcaagtcatcttttagctaataatgactccaaatctgtgccctccacattgattgagagctcttcccttgtccccaagattcgtgttcatggaacttgatttttaattgtgacttgattctgcaatgcttccttcagtttgcttcaacagattggactcattatgttttttttcataaaatcttctcatattctaactgcagggctgttaaatcatacaagtatttaaatgacttgtttttagattctgcatattcctcctatctttgtcttgctctaagttcagggttcagtaaaccatagcctgcagaccagcttaccacctgtttttgtaaataaacttttattggaacatggccatttgtatacatattgtctgtggatactttcacactgcagttacagagttgagtaactgaagaagatgaggcttgcaaagtctaaaatattatctggccttttacagaaaaagtttgcctactcacaacttctaaggtgattctaatgacaacaaggaatgacagtttgaataccttccccagaaaagctaacttcatacttgcaggacaaattttacctttatttgttatgaagatctactaatagcatgaaaattatgtcttgaaaattaaaattaagactggatgtggtggctcatgcttataatcccagcacttttggaaatcaaggcacagggagttgtttgaggccaggaatttgagaccggcctggccaacatagcaagaccctgtctatacaaaacagattaagtaattaactggaactgggagcatgcacctgtaattcaagctacttgggagacagaggtaggaggattgctggagcccagaaggtcaagtctgcagttagccgtgatcgtgccactgcactgcagactgggcaactgagtgagaccctgtctccaaaaaaaaaaaaaaaagtttatattcaaggagaatatcgttggctaataactatgtttcttatttttgtttataatgtttatataaaagccttaacacttttgttatcagtattcactttccaatttatcctacattgaatttcagttatttttcttgagtcaattattataaagtaagctaagaaaatcttgactttggtatcaccttagaattatttagtcctattacatgccctatagttgttttgggggtggggaggggcattgaaatgtgaactgcagttattcttttaccatatctcatgtaaataaactattcgcctacacacttaaagtcaaatttaccacatatttgcgaagttaaaaggttaaataaatctaactttttttagtttcttaaaattatgtattaagtatgtgtccaagctttgattcatactcagcgtaatatttcattttcttccatcagttgatgtagatataataatagttcaataatatgattttatactgatgaatttttgagatgacctgattgattatcctgcctttatatttctgttatctgctagtaaaatctttattgtttaaaacatttcatatccatgcctaataatttttagatttaatgttgtattaataaatagtcttgtgtgccagaaagtaaagtcttgttttagttctgatgtatcttcattttgaactctttatttctattaattcagatagtagcgaaacagtgcattactttttgtacagtttcatagtactttttaaatcttactctgaacatttttaatattttctttcacctacaggagtggcatcaggattataggaaattcagggaaacaactatgtatctcataattgggctagaaaattttcaaagagaaaggtaaggcaaagtggacaaatatgaaaagagcataatttttgcacttaattctattcaggtgtgacctcatccatggaaaagattttattcatactctgtatttttaataaatgttttattttagatcagttttaaatttacagaaaaattacacagttgatatagagacttcccatataccccacataaaatatattttccatttaaaactccgtaaggttggcattagtgtctgtgtttattagctctcaaacactacccttgaagctgagtctgatcttgatatcaagtcagagatagtgtttgcagtctgtctttgtgaactttcaggttctgtaaaaagtgtagctgtagaaaatttttgtgtactgtgactttaaacaaattttggattaattttcatttaaattaaggatggtcttaaaggaatatctacttatttaattatactattattttaattgttattaagaagaaaggatacattttgctttacttacattttaggttatttactagtttgcatgtatttctccacatatttcttaatgcgtgttgttgaacattaacttccctagtgattgttttttgagaaaatgctttattttcaatgcagtgtatattgcagccaagtaaaagggatattgaatttttcctttcttttttgttttatgaaatttaagaagctcccacttaggtaatgatgcttctttttcaaaaaaagaaacaaagatcagtgtttaattctggagctatgctgtccaacatagcggccacctgacaaaacttaaataactaaaacttttaaaaccaaagttcagttcatcggttacaccggccacgtttcagtagttcagtagcctcatgtggttagtggcctctatttttagccagcacagaacatttccataatcacagaaatttctattggacagtactattctagaggacagtactttcatttttatattaatagttatcaaaatttttagttatcacacaaaaggaaaaattaatgttttacttaacaatttgtcttaagtacttaagtacaaattatttaaagtcctagtcattgtgctatttataagataatttcactttagtcattgatgtagaaaacttactttgatcaatacctccaatttatgagttatgtcaatcaagattttatttctttaataggaatattcaaatgtactattagaatttatatttgtgctgatttgagaaaaataatgtgatcgtataattcaatagagtgagatataaaaaggcatttcagtgttacagataaagaaatcagacttcacagagatgtagtaactttgtcaaggtcacacagctaactaggagaagaaaaattaaaatagagacctcgtattcttgtataatttaatgaaatcatgtaagtacaaaatgtattcatttatctcaataagaattaaaaagatgaaactgtcactttgtacctatccggatagcttctgtattagttgttcccagttaacatacattaaaggaatttgagatataacttggaaatatgtttaaatattacaatttgcttgtcagttttcaaatacatacttattcagaaagttaatattctagtatagtaaatacttaccaaattagaaggattaactagaaaatcaataatggtgacagatattacttgtggaatatcttttaaagaaatattggtgtgtgtgcgactgtgatcccagctactcaggaggctgaggcaggagaatcacttgaacccgggaggcggaggttgtggtgagccaagatcgcgccactgcactccagcctgggcgacagagcgagacactgtctcaaaaaaaaaaagaaagaaatactgttttttttttttttttttttttttttactttaaatctttaaatatagcagttattgtagctagctgtttgtaaaatattgccaaaagattctgtcaaaattgtttttaatgaaaatgtaaacatttaaaggcttgaatgaaatactgatggacccttgtgagtcctgagaacagtgaagtgaaatcatggttgcaagaaccataattttatagagtgtaccaggctacatgatcttattttatcttagataagaatatggtaattggactgctaaatcttattctaaatttatttgaatatacattcgtaagcactttaaagtttgataacatatggaacattttgcgtacctcagtagagaattggaacaaggtcatggtttcagagcaattctcaaagaggtgactcaggtctagaaagccagatgtcagtgtcattcaggagagatcttcttaacaggaaactcagtagctataaaggaaaagatagatgtgctagttacttattaattaacgaactactacaacttaatgttgtaaaacaacttttaatattatcacttccttcgtttttcataaataacatctttaactgagaatatgtttattaacctaatatcatttcaaaataaaatgttatacttaatctcaaaaacaaattcctagaaagccgttttcaaaaaatgtataaaatagacctatttatcatgacaccttcaggtgtgtaatttgatttgccatgaatgtatacattaatttttaaataattttacatttaacatttgggatgtggaatggatttattttgtatctaagtacatgaattaagtaataaacagtaattattggcaggagcgtctagagtttaaaattgtgtttctttacaatatttcattttttaaaatatatttttccatattaatctgtgaaaaaatatattaatgaaaaactgacgcaaaggaaatattttaaaataatattttttatttcagttatacaaatacttggctagatatagtttttattttgacatgttagaaggatagttttgaggtaaaagtaattctttattaaatatttttttcttccatttttgttttgttttgtatttttgagttggggtcttgctctgttgcgcaggctggaatgcagtggtatgatcatggctcactacaacctcttaccttctcagctcaagaagtccttcctcctcagcctcctgagtagctggtactacaggcatgtaccacgatgcccagctaatttttttttttttaatgtttttgtagagatgggggtgtcaactatgttggccaggcaggtcttgaacttctggcctcagctgatcctgtcaccaccacctcccaaagtattgggattacaggcatgagcgactgtgcctggccccttttcttccctttttaaaacctaatttgaatttcataatatctagacttacattaatataacacatatgcctaattctatcacttcttttttttttgagacggagttttgctcttgttgcccaggctggagtgcagtggcgtgatctcagctcacctcaccctccacctcccgggattctgctacctcagcctgccgagtagctgggactacaggcatgtgtcaccatgcccggctaatcttgtatttttagtagaggcggggtttctccatgttggtcaggctggtctcgaactccctacgtcaggtggtccgtctgcctcagcctcccaaagtgctgggattacaggtgtgagccgccgcacccggcctctatcagcttttttatgtttgcaggctttttgtttttgctttattccactaggtttcccagatttagaagaaatctttcattgtccacttcctctatttcctttagatattcttatttctattttttttttacatttttctcagtaactaaaactgtctgcacatagaaaagaacctgtctaagttgtcattgaacaaaccaaatgatgtttgtgatcatttacttcatataaatgtgacattgcgttaaacaattagattgttggctttcacattagctccaattttgagtttaaatggaagacatcaggaaaataaataccaaggaaaacagaactatctgactttatcagttattgcctcttttcccagattttttcttaatttatagctcttctttttttacttttaagataactatctctgggtttcagatgttgctgttgctaaaaaggcgctctcaagcatacactgcgtcagatgatattttttattataatgtagattatcaaaacttaagcatatacttaaaatgtttcataattatagctgactttgtttctacaaaggtgaaatactaatgttatatgtttctttttaattttcaagttatatagattccttgctgttcctcatctgtgcttatcagaataacaaagaactcttgtctaaaggcttatacagaggacatgatgaagaattgatatcacattatagaagagaatgtttgctagtaagttgaatgcatatagtatgatcttatcattttgtctgacattgggcaagttttccagactcatatataagtgattgactccataaactctgaggggataagaacatgatgatgtctataaactggttctagtcccttcagatggaaaagtacactcagtactttattcttttctctttatgaatcccaagtactataggtgataaatgagaaatgttcttaaaatagcatcagtttgtttacatttctgtatttagatttcgtcatcacactaccactcctttttttggtgggagaggaagggatgcatagataagccttaaaaaatgttttatgtaagtctataagaatatgcaggctggcgcagcagctcatgcctgtaatcctagcactttggaaggctgaggctggtggatcacaaagtcaggagatcgagaccatcctggccaacgtggtgaaaccccatctcgactaaaatacacaaacacaaaaattagctggatatggtggtgtgcgcctgtagtctcaactactcaggaggctgaggcaggggaatcgcatgaacctgggaagtggaggttgccttgagccaagatcgcgccactgcattccatcctggcaaccaggtgacagagcaagactctgtctcaaaaaaacaagaatatacatagaatgtattagagtaatttgtttaacttaaaaaattgaattttcaggtacaagaatagtatagctgactttaaacatacatagaaccaaaacctgatggttcctctgaaaccttcaaaaaatggtataatgtttctcatcattttttgtagtaacccagccacatttggttatttgttttacataggaattgaaatgaaacctcgtcaagattactttagtgttcctttcagattttttcacgttgtatatttacaaagtgtcaggttctgagggatacaaacatgagtaagatgtacttcctgtcctcagaaaactcagtctggtaggagacataattgtttgttctggaataagtgccattatgagaaatatgcacaatgatatgcctgaaatatttgggaagaaccttaagagacaaggtaaacctcgtctggatcttgatggataaatagaagttttattcatgatagagaagggagaatattccagtacacaacagaaaatcaagataaattcactgtggctatccaggttatgaggaagtggggtaaggtggaagtgatgaagctgacaatacttgtcgatgtcagatgatgaagaaacttagatgacattcaaatgagtttgcaccagtgtaagtttgattaggtttggcataatgaggtttgttttcagaaaataattctggtaataataatagcattctagaggatgaacaggaaagaagtagattgaagtcaagaaccttagaggggaaagtcaagggacggagagtgaggacctcaactcatgtagtacggtaggtatgatggtgaaggaaatgaaatcggcatgtcatagctgttgggtgagtgggaagaaggaaatggaagagtcaaagctgccaaacttactagtttttcgtttaatattagggagtctaataggaggaacaaggttggctttgaacatgttttatttaagagatttccaggacattctttgattcagtgaacttaacattaaacttgtcattaaattttatatatcatttaatgcatacttccaaaaattgtagtaaatacttgaagatttatctcattttattctcttaacccctatggttggaagataaaataccctattattaatataaagaaagtgaagctaacagatttagctaatctgttcacgattggtgtattagtccgttctcacactgctataaagatactacacaagactgggtaatttataaaggaaagaggtttaactgactcacagttccacatggttggggaggcctcaggaaacttaaaatgatggcggaaggtgaaggggaagcaaggaccttcatcacatggtggcaggagagagaagtgcaagcagaggaaatgccagatgcttatgaaaccatcagatctcatgagactcactccctgtcacaagaacagcactggggaaactgtccctatgatctgatcacctcccaccaggtctcttcctcaacacctgggggttacaattcaagataagatttgggtggagacacaaagcctaaccatatcaattgggtaattgattcatggccaagttggacttaatagcacaaccatctttccaaaatcaaaataaattgcataagaattatgtggtgtaaatctaaatatataactttttttatttgaaattcagcttaaaagtcatgtttatcatgctgtaaacataagattttaaataagaacccttaaatattataggtcttatacctgtatttatctcttatgtttcttattgcatggatttctctgttctactagatcagtgatcagcacactatggcttgtgctccacctaccacttgtttttatagataagttttattgaaacatagccatgcacattcatttatatattgggtattattgtctttgtactacaatggcagagttgaatagttgcaacagaaacttcatggccttcaaagcctataatagtcctcgtctggcccttcacagaaaaagtttgccaatccttgtaccaaattgtaagctccatgagagttttctgtattaatcacttgagtgcccctgcatctgcagaaatttctggcacgtggtgttgactctgtaggaagtttttgaagggaaaagtgaattgattacctttatatttctgtatcaaggaatacaatagtatatattcagttgccattaatggagatgagtttttcaaaaattaatatggattctgaatttctttatttttaaaactattttgagtgcttatacaattttataatttggggaagttaatctctagagaagaaaaaatggcccctgtgttgatgatcggcataagccaaacatgactgaaaaacacaataatgttttctccaccgctgttgcttttgtttctgttgttgccatatgcatagctttttctaaagagagattttcagttctagataggttgagattgttttctctaaataccgtttgttctaatactgtttgtgaacatatttatgttgtcttccttattaatacttacagatccttaatttaaaaaggaaacaaaaacctattcttttttttttcctgcattgcattaagaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaacgtaagtttaaacaatggtagtaggcacctgagatgtccggattaaatgcagttagaattagatgttatttattcttgccattttttatattaaatacaatattaagtattaatattttcacattcacatgattactctttttccatattgatgaactaagctgtgtgcattgcagttgccatttatgtttttgtctccccaaaatggcaattatcttacctattagagtaagttaatattagtaaatcatgttgacaatgatcgtgtaataatttctatctttagttagatttaattgtttgtatttgcagcacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 2853 - DNA, 90130 bp, Homo sapiens
  source 1..90130: mol_type = genomic DNA
cccggatctcggagttacacgttctacggagcggggcgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcggtgagtgcggccacgggccggccccgcagcgcacccgaggccgcggctctgccgggcctgccgtctaggggccgcaggcggccggcgcgcggactcggggaggggcgagggcgagccgggcccggcgggctggggagggtacgcgatgaggcgggcgcgtgcgggagcggcggcggctcctttgtttcccgaggcccgacggccgggccagcgaaggagagggccgcgaggggcgggagtccgcggaggcctcgagcgcgtgggggcagcggcaggcggggaccctggccagctgcgtgcgcccttgccccgccctgccgtggccgggggctgtgcccgtccgtgttgcggggtcgcctgtggggcgggtgtccggcccccgaggggcggccgcacgtgtggcggggcccgcgccgcgcttctccgcagacagggcgggaagagcgccgctctccgggcgcagctttgtctgggctgcggggcgcgcggggctcctctcctccgccgaacccggcccgggtttcctttcccttctccgcaggctcgggcacctcgaaaccccgagaggcgctgggagctcgggcggcggaggtcggggtctttcatccgtcagggatggtgaagtttgaaaacaggctgcgggctgagaagctcggaggctgagccaacagctgctttggaggggactgctcgagtttgtttttcagaccttttgggttgtccgaaaatgcgttgggattcccagttcctgtgttgtgaaacacttattagatttatataaggcttttgagtagcttaagcgttttaactcctgctggcccccttggaagccccagtgccctctcattgtctgctctaagcgacttcttaggatcgcaccggccacacggctttgcttacttcctggtagggccctggtgccaccgctagtctttgtttattagctttgagatggtcactggtatcttgggttatattaatagcgtacaattcgaattgtgcacttcagaaatctgaagttcatttgaagaaatatagaaaaacggcaatggtatgatttagctgtgacatgtctcattgtgggccggagctgggaagatagtttagagaatgccttagcacttttgacagcttactacttaaatagtgattatgttcttggaaacaacatcggtaggtccacaaagaaaaatgtactctgggataaggaatagaaataactgcggtttcctggcgcgctcagacgtctgatgctttgcttgcctttgtaaagtcaggtatctttttctgcatgaagcctttgaaaattaacggttaattggtttcacagagcagtattgcagttcttttgtgaggatgcagaaacttgtgtaaattagcttttacctgtaaatctgtcgggatgttgagtatagaacaacaaataaggtgtatggcactgctttacaaattggttggtggtggtacattagctataactgtagccattgctgtggtgctataattgtaacttaatttttttcccaaaagaaatttgaagaaaaaaaaaaagaccaaagtaaacactaggagaagcctacctcacagggaatggtgggattgctcttgctcatctgtagtaaactacagaaagacaacatggacaattagcacacttctggcattttttaggtaaaatcacatcaaacttaaaaatggcttcactgggcacatacatctaaaaaatggaaaagaactgtgcaagtggcagatgccctcttgtgagtcagtcttgcctctgtcagtcagggagtccacttgactgtgaaaaagagatgcaggaaattgagcatctcttgaggaacttaataagttaaaatggagcataacgagatgtgctgataacaagaataaactagtatgtggggtgatttctgttcaaggggtaggatgacatctttgcatcttgcaacaaagtgtgtctgacatatagctttgcaagcctgggtctagtcacttacttggatttgtagaaccaataaagcgagtttcgcaactttgtgtgagtccacactctgaattgaacccattttatgtaggcctcccgtcttaacccgttggcatccatttgttgatataatctagcgttattgtattaagcttgatcttgttcttgcgtgcctgtcgtttcagtgattaaatgatgaatctgtgagtccttaactaactcattatcttggagtgttatatagtcgtattttttttctcccacactcttgattttattttatttttgtttttttcataggggaccaaaagggtagccgatgtgttgactaatactgtgactgggtattgaatctgattatgttcttattaaggaggggaaaatccctgttttggcactgggacaataaaagtaatgcccttgccttattttctttgcgagtttgcaattataccacggtaagacagccaagcaaattgcaaaatgccacaacattctaggttctaccagttagcagtacctaattggacaaatagttctattttctttgagtatcagtttccttatataatctgcaaagaaaagggtaatactttgcatttacttcacaggttgctgttaggatgaacaaggtaattttttgtgaaaactttgagaaacttgtatacactgttctagtaataggtggtattagaggtcagaacatctttgtaaagaggactctgaataattaaatatccaaagcccattaaatggggactagaacagactggctttatgctgaatgatgctttacagggagatacagaactcaacaagattacaagaagtaagaagtaattatacttcagaattagcatgagcttcttatccatggaaggcactgtgtgttgggttatataattgtgtatgacagtggttcttacactttttgatcttaggacccctttacactcttaaaaattgttgagcacctgaagagccttcgtgtagcttatatctgttgatgatgtttattagaaattaaaactgagaaaaacttaaaatatgtatttattaatatgcttacaaataataatagacccacacccataacataaattgacagtttatgtaaaatgtttttcaaaacaaaaatttagtgggaagaatggcattattttgcctttttgtaactctttgttcagctttatagaagacagctggattcttacattgcttctgcattcagtctcttgagatgtcacatcatgcagcctcaggaacaccccactgcatgcttgtgagagaatgactgtaaacaaaagtaacatcttaaatattatgtatgaaaattgttttgaccttctggatcccctgaatgggtcctggaaactttcaggggtccaggaccacactttgagaacccacttgtgtaagctatagttaacagttaaggatacctgctcatatcaaaataactttaaaaaattagagaaatccttaaggctaccaacgtttatgtttctgtagagacctgaggtttttgaaatgtattagctgggaaatagagcatgggctctagtagtcctttgctgccaaaaaagttaacagtctaatctagctgggggagagacaggaagctaactagttagaagatacatccatgtggtttaaggtaaatgttgaaaatagctatctcctaataacgtaaaggctgatttatgtctaattgttgcttaagggattctagtttaaaatgaaaaagttttaaataaaagggcattctctcaagctttttgttatgtgcacataccagatgttattttcagaagttggaggcttgggcattccttatttttgtgggtaaaagagtttaaccagtgggaaaaaacaaaaattgtttaaaaagatgccctgaatgcaagtgttttgataactaaggaaagccaaggaccaagcatttgaacttgagggtttgggttaaacagccagttaaattagagatatttagtaggataggcatgctaatttttccctgattaattcttcaatgagttgagagtgcctctttaagttttcagtacacacttgccttcatattactctacccaagaaaagtaagtgtagatcaagtaaatgttctgcaattttgcaccaaaaactgcagataattccacccaaaatactggagataaacccttttttaagagatccattcagtaggatgaggtgttgattattggttgtcagtggtaataaatttgtaatggactgatcaggttgtgataaagagaagaaatcaaccttgatggagtgatgggttattttgtatcgtatttctccacaacctacatttaacactcgtttgcccagtggactaaattttctaaatacaatcagtcatttccttgtcattaggtcaaatgcttttactgctttttagtaacattctatgatgtctttattaagtgcctaatacttaatagagcaattagtaaatatttgcctgataaataaaggaactatcacttagatgtgtctggcagggtctttatgttgaaaataaacgcagagtgaactttccccagaatgctttcactagcccgcactcccagtattttagtcagtaaacgttggctggattgtgagcaaatgaccatctgcagtgttgttatcacaatgaatttgtgttcttttggcagtctgtatttatagatgggcaggtggacaatttagttgtaaatgtggatggggtagttaaaaatcagtggacaggtgatacttttttcacattaattctaaaaagtagtatttgagttttatatatccttctgaagaatttaaacttttttggtaatatttataaagcttaagtcaaatgtctttctagtctttctgcagtattcctccccaaccccgtcccccagaatcttagagcaatctcagcttatttctagagtctctaaatgattgctcatggatgtgaaatgtgtgaaatttagaatgtgctccatgtatgtgttttgtttaaagaagcttcagtatagagattgagcctaacatttacttgttgtgaagaagttttgacacattgatgagaagttctttccctaataatatgcttaatagtgtatacagaacatccttcatggtctaagcagaagaaatgatggagttgggggaagaattcgaactctttggtgtggtttcctgttatttatcctcaaaataatttattctcattctttgcttgtacaccattagccttaggctcgtgtaacagcctcctttttcctcattgaaatgtatgtaatttccttctccactggaatataaaagattgattttggatccttcaagctagatttagaaatacttatgtttttatagtgtttgcagctcagtgagtagaccagtgagtaatttagtgtgtagctcagtgagtcatttaaattcctgttttaaaatttgagtccctcttccatcaggagctgattaacatgtacatttcccctaacctaacctgctcgttttttttctttttgagcttttctccccttcttgagcttgtttgtttgtttttaatatttttccttctttgaaaacaaaatgttagtctcctttgattaagctgcagtctctgacctacatacatacaggtttgtgttcaaccaaggcattgaaataaatagatttagtcggtagattatcattgtttgaagtggaaaaggtatgctgtttaacatattttgatattttatgtttattcattgcctctttagacaggagagcaattgcattctaggtgtgttaatagagctttcctggacagatggcttggaaggaagtactttgatgggttctcagtaggggctagtactttttggagggtgtgtttgtgattaagcttaccttgattgacagtttagaatgctgagaatagcattaacaacagtaacagcttgttcatcttacctagaattgtcttgtgccaagacccctcaagatgctctgagatttctgtgtagtggtttcttttgagaatgtaggtaagaataggtgtccttgagactgaaaagaaattcacctaaaattgttcattgtggttgtatcttaaaatctttggggtcgttgaatgaactttggcttagaaatttgtagagatcgtctttttaactgctgtgagtctgcagatgtgattatctatagtaattccagatgttttctcatctattagttttactgagtaggaagataactgagaacaacataaagtaacttcaaagcagtttgctagcatttaatcctgactaatttaattaattattcatccttgtagtttttcctattttattgattatgaaactgagacaaaggttacgagttgcccaagatgcttggggagtattaaagatagcccaaagcttaaactctaacactgttcagacttttagcttgctttttcttaaaaaaaaaaaaaaaagagtctttattttgttattcagtaacttaatgcttgacaatttaaaaaatacaaaatgtttggaacacatactttaaataattcctttgaagatttttgatatgaaaatatattttaagttccacatctcaaaaattacttattttaaaatttggtcttttgttacccccctcacccaatttaatattgaaagtgctggcaagttggaacaaggaattggtgatatagtttggaagaaacaactattttaaatgtcaaccttgttatactcagatctaatatttttataggccgaaattcatattgcattagttcagacataataaaccagcctcctcactatagctatggataaaatgcaattagcttttggttatttttaaaatgggtttcagttattgaagtctctccaccccccttattttttcattttgtttctgttagagaagattcttcttggaggtggtttgttgtagggtggaggaaggagagaattcttaaggtatagaattttgcatttgcttctggtagctcagagattatttgaaatctttgcttttagtcagtatactttgttgattccatttagttattctaagattttccaattgtatttcctgtaaaagttatagtctttagaccataaaaactaaaactagtaactgcagatctttttttttttttttttttttgagatggagtctcaccctgttccccaggctggagtgtgatggcacgatcttgtctcactgcaacctccgcctctcgggctcaagtaattctttgcctcagcctcctgagtggctgggattacagacgcacaccaccatacccggctaattttttgtatctttagtagagtcagggtttcactcaaattcctgacctcgtgatcctcctgccttggcctcccaaagtgctgggattacatgtgtgagcctccgtgcctagccagtaactgcagatcttaaaacagatttcccctcttcttcttcttcctcttcttcctcttcttcttcctcctcttcttcttcttcctcttcttcctcttcctcctcttcctcctcttcctcttcttcttctttcttctttcttctttctttttcttctttcttccttcttcttctttcttctttctttttctttcttctttcttccttctttttctttcttctttcttcttcttcggaatctcactctttggccaggctggagtgcagtggcacgatctcagctcaccgaaacctccactcccaggttcaagtgattctcctgcttcagcctcccaagtagttggaattacaggcagccaccaccatgcctggctaatttttgtgtttttagtagagacggggtttcactgtgttggccaggctggtcttgaactcctgaccttgtgatccacctgcctcggcctcccaaaatactgggattacaggtgtgagccactgcaccaggcctccccctttcttaagatacaaggaagtgtatcttttcagtgtgtgctctttatggatgtatacaatgcagatgaatttaggaaggcaatttcagattttgaaaactgttgaaattaaacttgaacattgaaaaatcaaatttgcagttgtcttaagtgtttgcattagttagatgcttcacaattaataaatactagctaatataattttataagaccctttgaagagggaattgtgagtttatttttaagataagccaggttatatcaaagatattgtaaccaactagattttatttggagactttgtactctgctttagaatccagtagctctatcagtgtgagctgtttccattcttgagtagaagttttctcctgttattttttctttgttctagctgggtttaagacagccttctttgtagaaattgttggcctgtttatccttcacccaccctgaagacacttaattttatggactgttcttgtactgcctcatcaccagaaaaagcaggctggaaattaactgtcatattcccgcaggtttaatttaactgattataagaaagtacagttattgttctaccttctttaaatctttgtccttgatgaccaagctcaggtttttatttttgcttatttatttattttttggaaatggagtctcactctgtcacccagtctggagtgcagtggtgcagtcatagctcgttacagcctggaactcgcgggcttaagtgatccttccacttcagcctcccaagtagctgggactccaggcatgtgccaccacgctcagctaatttttaaatttttttgtagagatagggtctcgatgttacccaggtcttgaacttctgactctgagtgatctttccacctcagcctcccaaagtgctgggattacagatatgagccaccagtctgggtgggttttcttttttaaataatagatttaaattgttcattactttgttttgaacatttgttgcacaatgccggagtaatattttgattaaagtttttgaatatcaagttgaaatttctagaaaacaaatttctgacttggaatgtttccctgagataatcgatggatgacatgttagaaaaatgttctactatattaggcatttaaaaaataactgtataatatagagactgtgggagcaacaatggtacaaattgctggttgagcaaattttaattttagttgcacacagtaaaatgttctttggtttcattaagattaactcttatttccatgtgaattattttggatattaatagtgagatgctttagcattggagaaattgctttataaaaactgaaggatcagacttcaccttaagtgtatgaagtagctgccagacctcaacattcgtgccatgagaatttaattctgagagcttaaatgcgttagtttcattttatttgctttgaatgttttgtttatatatagttttttttagagcctcatttaaaaaatatatgtatttctagtttttttcttcgaatatataatacagatttttgggaaaatgtgggtcatgtttgaaaattctatcgattgtaaaaaaaaattccgactcttggttttggttaaataattagaacagctatttagaaaaactgaaatagttaatggttttggagtttgcaggtgcctgttttctgaaatattgattatctatccctcgggcagagtatacgtatttgccaagtttgtatttcttttttctatttcttcaaaataagtcccgttgattttaaaagaataaagagtttcccagtaagtacaagtgtggtactttttccccctccactttgtactttagtgttaacctttattacataaccacagagaatgaggaagagaattgtacaatgcagatattaagcctattgttctccaaggaaagtctttgatgttaagaggtccctaaacctcttaattattttatttacttgtgagagggggtgcttccttaaatatatacgagtcttttcttatattgcatacacttgcaactattattttgaaataatagttgagtggtgtttacatttatgacctgattcatgtcttttgaagtgccaccactgtttcaccatggacttgcttactcaggttgttggcaacagcatggaattgcatcagatcttgctgtattaaataaatgaagatattagatgtcagaatttttaagtagttcatggcttttgtttttattttctatatgatcagcttcatagggaaagttatttttgaaacaatttgagctcctaataattttttgaagctatttgtgtctggtcttccaaaggcaaaaatggcccattttgactctgatttagtaatctcctttggctttagtggtttttatccttcctcccactatcctttcccctcgtttagaggtaggaggagcccagttccagtatttaaaatgaagatcaagagtggcataatagcttcattaggtgtttttcaccaaaataggtctgaataagtctgaatttgtggtagaaggaaccataacaaatttgtttagtgcattacagtttttgagaatatgttgtttcacacacattgtttctatatgttgtttccatttcatggtgaaagcataaggaatccatttaaaaatagagtaaaatgctacagccagttgggggttgggggcagccccgtggaccagaatttgcctctgtgtgggaagtcagcaggaccagatgcccctctcttctttggctctgtaggtatctggatctcttaacatatagatgacaagttttggccagctttgaaattacatttgctagtggaggacacatatcattaactctgcagtgggaataaggaattcagtaggtgcctgaccccaaatgataaactgctattctaatttttatgctgtgtaatatattttagactttttaataaaaaagataaaaattgagcaatttcatgaattgttatgttacatcaatttaccatatgaagattaattcatgttttcagaacagtaatacacatttctgaaatatacagagacaggtaatagtatcaaagggcttaaaatagaattttagtcttcctcgcctccactctcagtcctgctgtccacagacaatctctgtaggctctatttagcattctctctcatatttacctgcataattctaaccaatgctctgttatttcttaatttgtcatttttaggtattattccttgatatcttgctgtggtaaatgaagacttcagtgtttgcaccacttgcccttcagtctctccatttcccaatataattagattacatattttggttactatagtgattcatttttctttcttgtccaacattttattttttcttgagtcaataattgcctcttttaaaaattgcttagtttaccttagacacattttctcttaaatgttcctttaaacctgtcaaaggtctgtgaatattattttttaacccattcaacggattagataatctccaagcactaactcttttctaaaatcctttccagagccctctgacctctgctgtcatttgaaatagttctccaggctggacagtttttatcgtgtgattccctctgttgttctcttataatattagatcccttatttcttggatcccatgtcttgtttttcttggtttatttcattgttttgctggagtacatcaagctcctttctcacaggaggtaatttttttttctctaattgcatggcacattaagggaggtaaatttttgagcctttgcaagtctgacatttttattttacctttatacttgattgcttggctgaatagaaaatattagtaagaaaataattttcctttagagttttaaaggcattgttggtttgtttctaggctcccagagttgctgttgagaaacctgatgccttcctgatttcctcctccacatatgtccttttattctttttcctataattctttaaggtattcttttcatcctctgtattctgaaatttcaaaatatggctgggcatgggtagttttttttttattttatttttaataggaagtgaagggatttttttatgtataggttcacatccttgagttaaaagacatttttttgtactataaatttgatagtgtgctcctccccccatacttatatcccccaatttattcttttttttctttctggaactcttattagttggatgttgggtgtcctgagtgtagtctctgattttcttatttctttgccttttggttctagtttctggtatatttccttgatttttttttttattatattatactttaagttttagggtacatgtgcacaatgtgcaggtaagttatatatgtatacatgtgccatgttggtgtgctgcacccattaactcgtcattaggcttatttaacattaggtatatctcctaatgctatccctccccactccccccaatttccttgatattttttcttccattccttctgttgaattttgatcattgtatttaaaaattttaagagctctttctcatttcccaatcattcctttttcacatatcctcttgctattgttttgcagtatcttctcttaccactccagcagttcagagtatgttggttttgaagttttgctgtgctccctgtatggtttctatttctcctgggttcctctttttctttttaaaatgattctttcagattggaggttttctataaagatctgttttgtctttgtcttttcatataacagtgaactttttcatgtaaaaagctttgtaactgggtggggcttgtccacagtgggcttcactgtgaggtggggagcaagtcaccttcattggaggaagacactcatatctgtgctgagaattttttctggtaccattgagtttttcggttttccctctgggaggtgggcacctggccactgatgttctgagatcagattgcagaagttccatgactcagttgtccttagagtccctagtctccttgtgttcagtcctgtccttacctgctgtctgctgtgtccctatacctagagctcctcccatctgcattcttcctggctgacactcaggccatagcttcctctgcactactaagattgttattgctcccctaacttctttctcacttacaaaaagctgttgaaatcttttgtctgctttggttacctcacactgttctctttatctttgtgggtttgtatctgtttttttcctttattgtcatttaagtgggtcttaggtgggagaagagctaagtagaatttgccacgtttagtttagtgtccatttttaaatgtatatcatttgtaatcctgtttttagggcacagtgttttgccctatcagaaatggatcttattagttactcagagttaaatcattgaactgaaattttacattaatctatttgaataaaaatttatattcagatttaccttctctgataaatagaacaaaatattgttgctgttatcagagtcagcagagaaaataggcaagccagggggttcgaccttgcttggaaagtcagatcacaagccaggctttggataggtatatgcctgtgaaagaaagttgtaaggtcattgggactactgcagttaatgcattgtaatacttttattggactagctcatcattcattaatgaaggcaagttagtgccaggtttataggatttttggctctgtacattggtaatttaaccttctcccttgtgttttagtttttaaaaagtatgatcttaattggaagtaaaggacacagatttttaatctcagaatttaaaaagacttttgattttgatataattttatactcagagaaacactgctaagaatagtacatacaaagaacttccgtatacttagatttgccagtcgttcacattttgcctcatttgttttatcatgtatatatttactctctgtttatatatttccccttattaatttacagatataacactcctttatccatagttttgtttttccccaagaacaggtctcttttttttttgggacggagtcttgctccgttgcccaggctggagtgcagtggcgtgatctcggctcactgcaagctccgcctcccaggttcacagcattctcctgcctcagcctcctgagtagctgggactactggcactcaccaccacgcccggctaattttttgtatttttagtagatatggggtttcaccgtgttaaccaggatggtctggatctcttgacctcatgatctgcccgcctcagcatcccaaagtgctgggattacaagcgtgagccaccgcgcctggccgggtctttcttttcaatcagcagagaatattggtcaaatcaggacagttgatactgatagaatgctgttacctaatgcacattccatgttcagatttcctcaattgtcccaacaatggccttcatagctattactcctttctgtttacctccccagccaccctggatctaatccaggatcatgtgttatatttagttgtcatagctctttagttttctttcatctccaatagttcctcagcctttgtttttcatgtcttggcttttggctttttttttttctattctaacatcataatgtcttgttatttttgaagagttcatttcagttattttataaaatgttcttcagtttgagttttcagaggtttcttcatggttagattcaggtaatgcatttttggtaggaataccacaaaagtaatgttgtgtcttctcaggcatcatatcaagagttggtctgtcttgtttttggtgatactaactttgattactttattaaggtaatatttggtaggttaatcagctataaagttactattttctcctttgctattaagaagtaatttgtgggaaatgtttttagattatgtatatacctcgtttcttaccaaagttttacccagtagtttcacatccattgatgattcttgcctgaatcagttattagtaggatgattgcaaggtgatgattttctgactcgtaattcttttacatgttagttggcattctgctataagaaagaactttctcccctgcttactattaatttgcttacttatcttaataagcactcggtttttttttattctaaggtactcatcattatttattttgaggctcaaattagcttatatttagctggtgggagcacccttaagctgtgatttgggcacgcgccgtcattctttgagccctttttactttctcgcacaagatgttccaggctcatcttgtacttagcctgttgcagccttggaattagccatttctccaagtagccctcattctttttggctgggaataatgtttataaactaagatctctcagcacagtagagctgagaaatataaataaataagcatatctacatctgtttatgtctgtgtgtatttgtgtgtttatcaccatgattttatactgatacctacaatttcattcaacaccacaagcctagtcttgcccctttccatatttgtaacacctttctccaacagtaagaactggttcccattatctacaatgagtgtgtactcatttgcacaattctataatcagagaaaatagttccagaattgctaacccataccattgtaaagaaaaccccttataactcaagttcaaatttgtttacagttctttttgtctgtatactgaaaacataaaaagtactatgttaaaaagctatttggtttagttttagtctcccttttaatacacttatttaacataaagtttgttcatttgtttgtttgatttctgttttagatttttttttttttttttttttttttttgagatggagttttgctcttgtccccaggccggagtgcaatgatgcaatctcggctcactgcagcctccgcctcccaggttcaatcgattctcctgcctcagcctcccgagtggctgggattacaggcgtgggccaccatgtccggccaatttttgtatttttagtagagacagggtttcaccatgttggcaggctggtcttgaactcctgacctcaagtgatctgctcaccttggcctcccaaagtgctaggattacaggcatgagccaccatgcctggccccattttaagatttttaaaatctcatccttactgattttattttgctttttgagtatataaaacattatcatggttccaaaagttaaaactacacaaaaagctgtgctaagcaatgtcactacctaatgccggccgctcactcctacccaccccctgtagacaaccaatttcattaatttctgattgatctttcctgtgtttctttttgtaaagaaaagcaggtgggtattttctttttttccctcacaaaagatagcaaactagatacattcttttggactttttttttttttcatttagctgtatatcctggatgtcactccatgtttgtaggaattttccttattctcttttttaaaacagcttctagtactccatctgtggatgtgcgacagtgaattcaacccatctcctatatgtgggcatttaggttgtttccaatatttgtagttacaaataatgcagcagttaatacccttgtacaaagatatttttgtattatcaggtatcttcagggaagaacacacaaaaaaattaactttttaattgtgtgagcagcaatatgtaagataatacttcaagctatttgtctgcctactccacacttccactgtggtcttagaaatgtatccaaggctgttgaagtgaaatacttatctatcgtaattatttttctgttgggaaaccttgaaattagagagctggaagtagccttggggacatttttagtcaagtagtagccgatcataggccctgggtcagggttcattttaagcagttaactgttccttgtacacactcatcagtgcttttctgtcagctcggctcagaccagctgtttcggatacttctctcttccatttaatttaattcacaagaggttccttcatgttgaactgttgagtggccactccctggagttatagaatggcagtaggacaagacaattatacatgggatagaaataaggatttcagcatctgttttctctgataggcctcagaggattgatggttatgaactgtagatcgtcagaggaatggcatcttggattcccagatgctgctgctggtctcctccggtgatttgtttatttgagacaaaatcttgctttgttgcccaggctggagtgcagtggcgctatcttagctcacagcagcccttaccttccacgctcaagttattttcccgttgtagaggcgaggtctcactatattgcccaggctgatctggaactcctggtctcaggcgatcctcctgccttggcctcccaaagtgttgggattacaggcatgagccactgtgcccagtcctctcaggcgattaatgacttctagtcttttgttccagctagtgaacattggagtagaagggagacgtcctcctgcattgctagataaccacgtaaaaggttggctagcatagcttcccatcagaggggccacaagtggattacatatgtgttgaaataaatgatcccctcagcctagaggtggctgtgctcccagacaaatcatttctggctgtgagaagcctcttcagttaatgtgcatgtgtcatacagatattttctatgcgtgccctgacatgggaaaggttgggaaagtaggctaaagcacagtctcaaaattagcctctaaggatgttgctaaaccaaggatattgctccttaaagagaaccaggtaatagagtgaagaggaattgaattatttagggtagaggttaaaacctacttgtccataaagataagctgataaccatatcttaaatctggtgtgatatgaaattcttactcacttctttgctaaaacaaagttagaaattaaaatgtatttctaagtgacttggcttgtaaccccattttattggatattggaatatagaacagttcacattaaagaacttagcatctttgttcatttgaattttgacattttattcattgctatactgataatgtactggcagtgcactaaatgaagtagataccaagggtatattatggttgatgagattagtgaaccaggatttaatgtcttttctgaatacttctgagtttgatgtattctaataaagttttgacacttgagttgcttctgtacttaaatgttttacctgagtggcattctattatctaaaccttatctgttaaaatgtgcttctaaaatgcatttttcctgaagtattttacattagatacgtaaaatttaatgattctgacatttaaggtggttataacagttacatcaattttgaaataagcttattaaaattgagtatttggtgttttgaatataatttaatttaattctggtgtaggaggattttgagggaatggaactgacattcactgagtgctttccgttgattaggccctgtgctgtgtgcactttatgtagtttatctcatgaaatctttaccatagccatgtgaggtagaaggtgggatttgacccatttcacagagaggaggcaggctctggaacgaacttagcgtaaggtcatagaataaaatagtagagctacaactttaagacagttggttctgaagcccgtgcttgatacaagtcacatgacctgtatcatatttattttgagtctgcagtggaacaaattcctacaaaggcaactcattctgtttggtacatttttgtataaaagagggaaggaattcttctcgaagggttcaagggcaggtgataaaggaatttggctagttcagctaaaacaatgtggagcagagtttcctggtcactgtgccccttcctttttaggtcagttgtggaacaatttgctaggaattttgtgagaaaattgtgagtagttccagcttacaaaggcctgggatcaggcattgctgggcatgatggggatcaagtcatgctggctgaggaatatgtcagaactcttggggtaaagagaaatagaagcagaatgagtaatgttctcaagtcttgtaattatttagaagcatttttccaagttcaaccttcagtaaagcctggggtttcctagaatgcttattaagtaacataatccaaagaagcaaaaggaaggaaggataaggatttgtgccttttaatgaagacaaaaggaatttctgccactgtttatggcactttcttaagaatctttacctagaatttgggatttctatggaaatagtgcttttgaaaatttgaaggttttaaacttacttgttactgagttattgttaggaatgatgtttgtgctcaagaattaggttgtcctgagatagaggtggcacatctagatttgagttattaaaatattgatgtgatacacaaagatttagtccaaaggacagtggcagcttagttgaagataaatatcaagtctttactctcactacttctgttgtagagggagtagtatagtcattggatagctttgaatcctactgggtaaaaccttctgaagtttcttttgcatcctcacttttcctaaacaacaggtcagtcattccagtgagttgtttggtgggtgtggatgatgctgcatcactgatactgctccctctgttaagtggtggtctggttatctgttgctgcatgacaaacagccatacatcctagaagcctaaagcaaccatttcattttgcttataattttgtgggccaagaattcaggaagaacttgcctgggattgcatcaggtggagaacgtggactcacagagttaccagacgtgtgttaagaagacactttggaggaggatgttctggagtcttcttaactcacctgtctggtacctctgtgctccttggtgtctctctgtcccccagtggtgtcataatctccccagtctccctgcacatggtttgggcttctctcagcatgttggtctctgggtaattagacttcttacatggcggctggctctcccaagagcaagcatttcaagcaatagcaagagggagctgtggatttcataaggcctggagttgcaggttgacatagaatcacttctgccatattcagtgcgttggggcagtcacagagcctgcccagattcggagaatgaggacatagaccctgtctctccatgggaagaatgtcaaagaatttgtggccatctttaatctaccacaaggccattaagcaaaaaggagagggttgttacaagaaatgctgaactgactttaccagcaaatgtaagcctactttatataatgattcagaagagactgattgtcaggaataagaaagggatagaggcaaaagagagcccccagaaggaggaaagtggaaaaatttttcatgggaaagtggaaaggcaaccaagataaactttgcttcataattttatctttcctgccttggacctgaattcagtcttggttctgtgatcttgcccttgagtcccaggtggccacttctgaccactttggatttggtgctcatgcctggtctcctccccagtatcaggacctctggttggcttcccaagctctatattggtcacccctttgaccctaagtatctcctgttgccctttatgagaactctcctgttgccctgttccctgggaacctaaccatcctctttcagaatgagcagcattgttggggctggggagacatcagacactgattttggctgccctcggactgcctgggcaccttggcagttgcttcatgtagcttgattccttcttttctggattacattatggctcagttcttgctctctttttgtgactttaccaactcctccccctaataatttcaagggactcaagttatagatagaagagacttctgaaatttcagcatagaataggcttgtgaacatgcagttcagagaggatttatagtgtacagaagattttatgtcttgcttttaagcatctaaaaatgtttcatttggaaggtaagttaggtccgtctggaatatatttttacttatatgtactggaatgtttatagaatttttatgatgatactgccctatcctccagttttaagaggaataacagttttactattgatactttcacgatgtatgtgtgtgttttaataactgctgcaaaatttcaaaattttcattgattataattttacaaatccatagagctataatcttggattttgatttaactttccactcatgcttgaaaatttagaataagttcattttattaggactttataataccagtatctttaaatttaaaacactttaaatttaatttttattataaaagaaataatgctgtttgaaaaacttttaacagtatagtggctcctatccccatgttattccttttacatagctgataacagctacttccagtctttaaaaaatttatatgccggtatgtagtacatacatagactcagaaacacatagcatgttatctttttaaaacaaaagttttagtttcctggacgactgctttgcaacagtcagtgccttgaaacactctatgagtttaatttccagccctatcacttagtaatttagcaagttacagtactgctctgtgcctcagtttcctcttctgtaaaacagaccaaatgatggtctgtacctcattggattgtagaagattaattagcacctgtatatagcacacagtatgtactatataaatgttaactaaatgaaaatgaacttgcttaaaaaacatatcctagatgtttccttatgggttgctaatatttttagagtgttgcactttaaaaattgtgtaggcgggtggttcttgagtttcactgttgtagcagcatgtttgtctgtaatgatcttgaacagtgattccacatacttcccacacccttgttgcagtgagttgctgttactgatgggcaatgtgtttgtgtctcagggatgatgggaggcaagaaaaaacttgaaaaccattggtttagaaaattatactacattagcagttaatctttttgttaagccttttaagagacttaggcagaaagtagagttggaaggattttatttatgggggatgatgatatgattgtttcatctaacttttgccagtccttatgttctttaaattattttactttgagacagggtcttgctttgtcgcccagactggagtgcagtggtgtgatctcgactcactgcagccttgacttcctgggctcacgggattctcccgcctcagcctccggagcagcagggaccacaggtgtgcaccaccatgcccgcctaatctttttttatttttagtagatatggggtttccctgtgttgcccgggctggtcttgaactcctgggctcaagcaatcctcccaccttggcctcccaaagtgctgggattacaggtgtgagccactgtgcccagcatgttctttgaataattttataatttagaggggacatgatcatcacctactcttcattttacactaaggaaatagacccagaatggtagtgatgttctctcttctgtagctagtaatggtagagccagaactagaatcccggtcatctgatcctcatctttctgaattcttgagaagaaaaagagccttctctcccagttgaaacagctgtgaataatggatgcactataaatggcttacctgtcagtgccatgtgcttaaactattctgtgtagagacagtgatgaagttgtgtcataagcggtcatgtatgatgttttgtccaaaaatttagaattccagacttgttggtaggcctcgaatatcaaatatcctctattatgagattctctgtatgcatactaacaggatattgaagatcagtggctatgtagaaataacatattcagtgtggatgtgcttttgttttaagaactccttttcttgtgaacacaacctgaaaagatgcatggattaattaggcctctataggcacagaactccctggtttctgctccggtctctcttgataaagggccatctgcccttccgtatagcacggactaaaccacttttggcctctaggtcacttagatgcctttgtgtgccttcggttctcatctggttttcaggagagttaaatgtttaagtggttttaggaggaagacttgagtctgagacatgttttagaggctggggctcttcccaccctctccatggcccagcatatgtgatagcttctaccttctggagaatggctctagctcaggagaggatagagcttcttcatctcctccatgcaaaggagccctcctgccatcttgaagagcttgaggctgaggtgagaacagggacagaggaagattctgaagccgtagctgaagaggaggcagtgaaaggagcctagtgagtatcagcctctggactgagaagtgagacactgcagtcagggttggaagaatccaagtaaaccgaagaaatttgctggaggacggggtatcttggtttgaggaaattttacaatctgagtaaaagatgagtttcacttatgagactcccagtcacaccgctatggccaagtgtgagaaataaattgcatggcttccttttccctgacatcaccttgaagtgtaattggatgtattaaagagcccttataaattcccagacttaactttttaagccttcacaagtgtctatccttatcaccctttctctcatgtaccagcatttaagactaaaaaaataaacactttggtttaacatttttatgttttgctaaatagatactatattcagagcctaaaaatatttttattactgtgtggttttattgtgtgggtatcagtatgtgtgtgtatatgagtatttcagctatattatgtttcatttagggctttacagacgaccctggaaacctttaatactgtttccatgggaaatgtgtttatcctgcaggtaaacttttgaatctcatctatctataaattgaaactaccttttataataagatagtccccctaaaggtgattaaaataaatggttttaagattatctgtagtattcttttatttgtacaattacctgttctcttcttaacaataattgagagtttaatttaaagccagtgtttttcagtctattttatatttgtcctgggtacattaaaggttcttaatttggatgaagcatgtataaacagagtgaatattccccaaagcaatgccatttattggcttcagaatccctcataataccctatcctctgtatctttctagccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcaggtagtaaagtggtttttttttttttcttttttttgagatatattaaaaggcacagtccatagtcacttgtttccaatgattttggaagtcagtactttattcccttttactttctctccttatcattacgtatctgtctgtctaattgatgcacaattcacataacataaagttaaccatcttaaagtgaacaattcagtggcgtttagtacatccacaattgttttacaagtaccatctctatctagttccgaaacattttcataaccccaaaataaactctataccaattaaacagttacttcccattctcttgaccccctcagtcttagagttttttggttttttaaaatgtgttattgaattgagaaattaaaaaaaattaaagccttgtgagatagttgatattataagactagctttataataccctgttctaaatgcaggaacatgaagaaatgtgttcatgcaccttgagtggggaaaaggagatcaccaaattgtgtgtactgtgtgtaggtttacaaccctaaagtgaggaagaaaggaacacttggtaggaaacatacccaaagcaaagtcacagggattctgctccagatttctttttcctcgtacaaaggagggacaaaaatcctccataattaaaaaaatatcctgggtagttaaaaacttgggcctaggccaggtgcagaggctcatacctataatctgggcactttgggaggctgaggcagggaggattgcttgagctaagggattcaagaccagtctaggcaacatagtgagaccctgtctctaccaaaaagaaaaacagaaaattagccaggcgtggtggcagatgcctgtagtccctgctactctggaggctgaggtgggaggatcaattgagcctgggaggcagaggttgtagtgagctgtgatcatgccactgcaatccagcctgggcgacagagtgagaccctttctcaaaacaaaacaaaaacacaaccttgggcctaaacttactattgtaacgtaattatttcaggataatattaacctataagagtttttttctcccagatttgagttaccgtcatccttccttccctccctccctgcctccctccctccctccttccctcccttccttccttccttcattccttacatccatctttttttttttttttcctgaggcacagtttgctctgtcacccaaactagagtgcagtagtgcagtcatatctcactgcagcttcaccttcctgggctcaattgatcctcccacgtggctgagactgtaggcacgtgccaccacacccggctaatttttgtattttttgtagagatggagtttcaccattttaccaaagctggtctcgaactcctggactcaagcaatctgcctgcctcggcctcccaaagtgttgggactacaggcacgtaccagtgcacctggccccaaagttcttaatatttactaagagaaaaaagctttactggagaaacaaaatattcataatatctcagtactccaaatcatacctcaaaccatgaatagctgttcaagtaagctgtgtactagtttactttttattttgtaagatacattttattgggctttctcttcaaactgtaaaaacatcatattctcattgctgtaaggcaaacaccataggggagtacaaataaaaagccagcagtctccctcacaataagtcttcccaagtacctgcctaacagagttgttttagcagtttggtaggtattcttccgcacctttctgtcatgtggtttacgtgcacatgtaacaaaattagacccagttgagtaaaaaatgccttcagtgccttcaaggatggccctcatactgaatgtaaatatgcgaatgcactaagaaaagggaaggcctttggcaactagaaggggatttcaccactcaaagctttcatgttcaaaactaaagttctgtactggccaaactgtagagtccctcaggcagtaatcactgtgctctcctattctcacctcctgtcccctcctctcatgcaaatataggatgaacatagtcaaagatttatttaactcattaatgagggaaccagtagtaagatggtaaagctggctccaagagtatttgggaactgagtgtgtatagacagtgaagaaaaaaacattgaaataaaattggtaggttagatacaaaactggttaatatcctacagggtagtataattgtaacctttggagtctgctggacagaaattatgtaaaaactccattacctgtaatttcatagaatttgggtcctggtcaagtaagcaggtcagtggtactataattaactatctttgggaggagctattaaacagtgtttcagtgtacgctgaaagggcttacagttctccattcaccttatttccagtttcggttaatttttttttaacagtgagaaaggcctgttgtgatacgggattgggcaagagaaatgtaggtagagatcagatcttggaagagatgggtatcctaaactaagaaatttaaactttctcttccacaaatatttattgagcatctacaacgtgctaggtggttactatgatcctgtgtggttgtgctgcagtgctcctcccatgcctctaggaggctgactagtggctcccaaggggctgtattaggaagtcacctgggaagctactttgcgcaaaatatacatgttctttgtacttccttccccacgccaatgtagataaccttgagtagaacataggtgttttcaaaaagctttccaggtgattttgatatccctcccttttaaatatcattgttacttatataggacttattaaaaaatgaatgagtagacagcaagcaaaattttaatcaatatttcatttccataccttcttgccttccccaccactataatacatcaactaaaatcattaatgtcttgattataccatcagcaagaattatgtgcagttgtcatatattttatgcaactaagaattactttgggaaaactaggctcagatttcctaattgtaaccttatgttgtgcctcttagtaaataaactgaaagaattgtcatttgtagtggtctatgacctacatggcaatgacatgtgattaaatgactagacttaaaaaatgttttttaataggaaaatagactgtcgttaacttgtcagagactgtagcaaaagggaataagtaataaaggagacaagtgtatatgtgtttaacgtggttaagctatttgggttgagtcagcaattaaaatgagccgctgttgtggacatgcatttaaattcttttcagtataacttaattaggcagccattttgtgtaaatgcattcacaaagcacggatttgcaacttcagcattcctacatagccatggaatttataacttaatcacaggaaaatggggagaaattgggaaataacatgatgcaattggtatattgtgtatttttctttttattagtgtgccggtccaacaaaagcccttgggtctgtttgacttgttcaagtgtccactgtggaaggtaggtgacatacttattacttcactgacctatttgctttttaaaatttgtctttaagctttatgtcagagttttattgatttggatttagtaccattgttaatcataatgcataattccctgtagggcttccttctccagttgaatccctttgttctgtgatacaactggggaaaacatctaggggagaaaaactcttcgtattgatactcagaagaattagtttgatgaccaagacaatctgctaataatatttgagtggaaagatgagctaagggaattcttgaagtacaaatttacctaatggttgttttttaaaccttttattagggtaaaatttaagcacacacaaacatagagatggtataattgaaccccatgtcccattcacccagcaattatcaacacatggcaatcttttttcacctattacctaccccatccccacctctactgacttttgtatcaaatcccaggtatgatatcattcttctgggaaagaaaaaaacccttaaaatatttacagataaacgaattccttttgaaaatgatctcattgtggagttcattattaattcctaagatataccaaatgtttcattgttccattaaaatactactttctatggacaacatcttctacctcaccccaccccagtttaaacctgagcatttcttcccagttcttggcctcaaaataatattatttaaatagtaactcttctagcacaaactcaagtatattgtctgtggttttttgcctggtagcagcacatttatttccactgctcttctagcttagaaaatctactttgaatttactttagaagttaatagcttagcagtaaggaaatgagaaatcatactgagtcccataggctgaaatctatattgtatttatccagaatatttccccattgttatttttaaatcctcattgcatgaagagagcatctttctttgttcagtgaagttttgatttttcacattttgagtcctggaattgagtattttttccatgtgcacttaagagtacctttggaaaatgttaactgcatttcttaattgtggctgttgtggttttgaaatctctaggatttggggaacctgaaaatactttgtacagataacttttttttaaaaaagaagaaaagtagaagcacttaaattctgcagttgaagagacagattcctctcctagattttgagaggtgagaattataatgcaataaaatttatgtagttctgttctccagaagtctcgtagtgctctacaacctaaatcttgatggtcatgtgccaatcaaaagacctgacaaactcaaaaattagagattaatgttcttaaacaacaaactaaaataggttttggaaaaataaatggaaaaatttctagcctctgcaggtggactgttgtcaattgcaaacaagcttaaatttagaaatttgacatagttttggagaaatgtgatgaagtagattaaacagaaaattcagaatagcctgaatttggatctccattttacatagctgattggttaatattcttttatcatgtaatcccaggtgttgattgccaaatttattgattttttggtaattttagactgcttgtctttagggaaatcgtaaagtgaatattcttcccactaggaaacatagtttatcaatagcatatatgggttataaattctgctggtcttcatgacaccatcccatttaagttatttttcaaatttttgtgattgttattagaaatttgtgacatatgtagtgaaatttttcctcttgtgctgtagaccaaaatgtctagttaaaatccaaaactagatgagggaaatatttaatttcctgttagctagtttatacaaaactgttaacctcttcgactaatatatttaggtatcaggcaaaacattgctaatcttaatatcagtattcctacttcttagtttatctctgatatgcaccggaactatttaaacatctagtacatttagaaactacagcattgtagttaaatggactatgtaaagatgatgagttctcaaaaatgtgcaagtggtaatgtgcttattcagtattattactgtagcaatgaattactgttgtttttcatggtttagtattataaatatatatgataagaataggtgattaagattaagtattgaacctatatgataccttagagtttgccttttatttgtttatttatttatttatttatttatttacttattggacagagtctcactctgtcacccaggctgcagtggagtggggtgatctcggctcactgcaacctctgcctcctgggttcaagtgattctcatgcctcagcctcccaagtagtgggattacaggcatgtgccaccaaccatggctaattgttgtatttttagtagagatggggtttcaccatgttggccaggcaagtttcaaactcctgacctcaagtgatctgcctgccttagcctcccaaagtgttgagattacaggcgtgagccactgcacccagccttacattttattaaatagcgtttcttgacctatacagttacatgttatcttgaaatatgtgctaaatgtgcccaccttctaagcaattgttgtttggattctgaatgagtagtagttaagcacagaaagaagaatgctaataaaatgattgctaacattcatttgttatgaactatggattatgtaatcacctaacaacccatgagacacaaagtactattacgtccattttacaaatgagaaaacaagtacagagaggttaaataattcatccaagctctcatggccaggatgtgataaagcctaattttgaatccaggcagtctagtttttgagcttatcctcttaatcattatttgactctaaaattcattttagtacagttttatgaacagaggactcaggtatatgcaaaagtgtaaagtacagggaaaaaatggagaaagaacgtgatcacattccaagttgaggttaatagtgccttgaatgtgcccagttttcctgggtagaggggctaggtttgaagttgatccttcccagttacggtaactctcctacttcctccaaggtaagtgtttttcctggtgcagttaaggtgcctcatgatgaaaatgtcatctaactctctgcatctgtttattttggtaccatttaaccaacatttgttttgactgagttttcaagtaggccttgccttccacacattggctgctttctaggaactgggaaatgttgcttcttaagggtcttcacgttggtggttagtgacagaattgtgcagtctctagacgaaggtgtagatggatttgggtgtacaccatgtgcatatggagccttatttcagtttcattgtgcctgctgtaatactaaatctgagttggaatgtgttacacaatttttatgaacataatcaacttttgattatctttgtccatgtagagaaatagcagtttttgtaagcttaaggtgatttgtgttttgtttggattatttctaaacaaacatgtttccatatgagaggagctgattattcaggcattcaaataaaagactggaagctatattggtgagagatggaacattgtcctgtttctctgactctcacactttatgttaagcagcaacttgagcagagtctatggccctgtgggaagtggctgagtaatttacttaacagagcttgtctttgataatagcccaagttgggggttagtggtctgagagaaaaaaaaaaaaagctatagtgaaagcagcagcaaaggagtttataaataatatctatggtactgaaaccaatttgcatagattatgcctttccttgcctgagcctactcttgtatataattaaaagttgactatagtatttggttgcaaaaaaggagcataggcgggtggatcatgaggtcaggagatcaagaccatcctggctaacatgatgaaatcccatctctattaaaaatacaaaaaaaaaaaattagctgggtgtgatggtgggcgcctgtagtcccagctactcgggaggctgaggcaggagaatggtgtgaacctaggaggtggagcttgcagtgagccaagatcgtgccactgcactccagcctgggcaacagagcgagactccgtctcaaaaaaaaaaaagagcatattttaagtattcagtataataaatcactacatgattgactgctgttataggatttctttattttgatttgattaatatttaatttcatcatttcctactcctttaatttccaaagcaatatttaaagtaaattttcatttggtttttgtaaggtatgtgaatggccatgcaaaaaaacattatgaagatgcacaagtacctttaaccaaccataagaaatcagaaaagcaagataaagttcagcacacagtatgtatggattgcagtagctacagtacatactggtaagttaacattttctggaaatgagatttcttactgtgtgcaagtgtgctctcctcccctcccttccctcagtctctaagccagttactactgctgttacctccttttacaactgttaggattcacggaggactggagccattgggaacgcctatctttattcattcagattttactttgcattgttcctttcaacttctaggcctccttttctctcccacctcccgttcctcatccatcctagcttcaaggaaatagatctatttctttgttattataatttctttttcttgtgttattttaaattgaagaacaatgtgataacccatgttcaaaataactcaacaaacccatgttcctcctgtccctggtccagttaacatttttgtcatataatcttaaaaattttaactgctttgtttaaaaaaaaattattctgacagtctcccttctcccagtgcagttccacgctcctcttctactcccccaaaggtgaatgtcaagaatttggtacgtagctttccaggctattttttcttttttttgagacagagtttcgctcttgctgcccaggctggagtgcaatggcgcaatatcggctcacctcaatgtctgcctcccgggttcaagcaactctcctgcctcagcctcccaagtagctgggattacaagcatgtgccgccatgcccagctaattttgtatttttagtagagacggagtttcaccatgttggtcaggttggtctcgtactcctgacctcaggtgatttgcctgcctcggcctcctaaagtgctgggattaacaggcatgagccaccgcttccagtgctattttttttttttttagtatcctttaaaaagaggttggcaacaggttctgttccctctttgtaatataatattcatgtctatttcatataaatgacaaagtaggtatctatttttgtgactacttagaactaggttatttaggttgtgagtgatgcttaatgatccatatccatttggttatgctcagaaagtatattctgcagttttaactttggtgtgaagcaaatttctttctgtgactagtaaattatgatgaacaattcttgttttaatcagctttcccttgattcagaaggttgttgacattaaaggaggggatataagccatttaaaggatcactttggagatattttttattgtcagacagcccttgaatgttacatgaaggcattactgggtagagatggggatttagagaagtccagataacaattttaatttactttctactgaaatggtgtgagaatcctttccacattgtccttagtcgataattgtatgataggaaggtgcccatcaaaaggaagaagaaagggtcagtggtttgccaggtcttttactttttttttttttttttgaaacagtcttgctctgtcgcccaggctggagtgcagtggccgatctccgctcactgcaagctctgcctcctgggttcaagccattctcctgcctcagcctcctgagtagctgggactataggcacctgccaccactcccggctaatttttttgtatttttagtagagacagggtttcaccgtgttagccaggatggtctcaatctcttgacctcatgacccgcctgcctcggcctcccaaagggtcttttacatttttacaggttcaacaccattaaattttggctattgaatagacatcttaagggttattcattcagatcactactgtttttagtgatcctttgtgtggaagatgtccagacctggagagagagaagctagaggtaggtgaagatttcagtagaaatgaaaatcttcccaagatttttacacaaaggttagtgctcagtttattgttatttgctgttgtgaaacacacctaccaaagttaagcattagccaggcagttaaagcgtttgcattcccctttccctcaggttttctttttttttttcgccctttccctcaggaaacttatatactagagtgatgtggctacgtaatttgcagaactgtgtgtttctgtgtgtttgtatttctgctttagacaacagaaattaatataattcttgaagtatctgtctcacattgtcatgggtcacatcatcctatagtaccagatactgagaacattgatttttgattttcagttagcaatgtgagtgaattgcttaatggaggactttggaaatacaattaaatcgctgtgtgctataacaagtttgccattgttttcttgctgttggtaagattctgaggaaactaactgttaaagaaaattttaagaattatcttaatggaatggaattatattcaaggccctttaaaaatgtagattatatattttaatatctttatacattgtattttaggggcatattttattaactagaaatgggaattgaattggttttatttcgctatggtctgctaaagtatatgtcgtttcatggtggaattggaattaaatggaaaatcttgaaccttggggagtatacactatgatggagtcttcttggccgattgccaggcttttgtgtgaagttgtacagagctgcaagtgtgtggacacccagagctgctgaattcaggaagggagctgcagctggtcacattgtcggctcacttgtgggttttagaataaaatgctagggaatcaccccgtagcattacactgatggcctaaaagaaatctgtgatagttgtaaattgacgaagatgcagtttaaattaacattcctcccacacctcactgtgatgaagaaacagatttcctatttctgtgtggagtgtgtgcatgtgttgtttcctcgtgcccgttagtaattttacttcaatttattaattttccttgtacactaatttcttgtggttagactgaatgattgatttcagaggtaaaacattggtgcattaggtttaacatgtttgattataaatatcttgactaaagtcaaagccttttttgcagtgtgctctgtgccctagagaagttataacatactctgaggcttgcagttcttctttccctgctttccccttgccaatagtccctgccctgtcctatgtttgcaatcctttatgaagttatcactgaactcttctctttccccagctccagttgtagctgaatgtaatctttcctgaactcacagctcttggaatacttataatttcatgctgcatgttagttatttgtaaatgtccttggagactgcagataccatatctcagatctttgtatttttccctagtatgcagtgtctggtgcagagtaggtgacatacgtttgaaagactgaattttgttaactgtctttcagaaatggggaaggttacatcagatctataatactgtgtcccctgatcatcttgaaggactaaagagccacgtaacatttttcctgcagacaacttaaatcatgatataggtgaactacttcatttccctcccaagatggacacccttgtagagcagtgcccctccaccttgatgtaaacaggagcccagagaggaagcatgcattaaccaggcagaacaatataaatcaggttactgttcattaagagagaaagcagtgcgaaaaggaatgattctgatttgacacaaacccacttcttaaggagataagcacattaacttgaaaatgaaaggtaaattaagatttcgatgaaaataaaaatcttcccaagatttcacacaagagctagtgtttagtttactgtttgttaggtaatatttcatttgctcccatcccaatttccctcccttaaccaatacaaatggaattgtatgtggtgtacattattgtgattgagaagaaacaaagattaaaattaggaactttggtttttttatggaggtagacctttgtatttaatagatttaaaatactgaaccaataatttttgacatctgacatagtcttgtcaacttcgatatccttatcaataatagctgaatttttgagaatgaagaattatgaaaggaatattaaaagtatattccttcagggcaggtaatgttttaaagcatcctttcaaatgaagaaatattgtgaaatatgaatcagttgtctagaaaagaggcttgaatttcagattttaaacacttgtaataaatggcaattttaattaaaatgaacataaagctttatttgtgagtttaaatagataatgaatcatttcctacagcagttgtgattaaaaattttaaaaaaggaaaatattttgttgatgttcttataaacgatttggacgcaaattttcaatgtaaaaaattagacaacagggagagttttgtttatttaaaaacaatattttgaagtttaagaagaaactttctaatagagataatcttaaaacataaaaggctcttccttaagataagctggtacttgtctgcttttaacaaaggatatgggtttgctctgcaggtattcttctaattttccataattggcttatttgatggcaatacatcagagtttagtaagagaatttaaaaatgctcttgcttcctaagcaaattcttttagattttaacctttctcagtttgaaataggtgaagtcactagaatatcagcttgctttttcttttcagtattactgtcatttataataaaaccagatgtcaaatttgcccgtaaatatcaaaatgtcttagaagtgaatgaaaaggagctggtgaaacttaatgaaggatctgtcatgtgtcaggggtgtttgttgcataagaggttttatttatttatttatttttggtattagtgttatgcatggcttactgtataaagatagctttgttgccagtaaattaaaggacttgtttctttactgttgcataaaaaatgttttatttgtatgattattcctccttgtttcagatgagtgaagaatggtttgctttgggaatattttcttagttcttcaaggacatgatgtggaagtcatgacttgagtaacttcaatagcactaacaacaggaattgaaaaaaacttagaattttaaagctgagaaagaggtagagatttttctctgtcttgggtatgacatatatgttattcagtatggtagcaattgagcaattgaatgtggctagtgtgaagaattaagtgttttttattttaattaatatttaaatagcaccatgtgactgctagctactattggacagtgcagcctcaaactattaaaatttaacattaagtatattaatgttataaactttcaaaaccttaagatagaaatctaacagaaactccaaaaacaaaataagccaattttactaaataaaatactgtagttggaaataactataacttaaagcaaatctaacccagtaagctatcaaaaagaaaaattatataattaccaagtagagttaatttcacctgagttctatgaacatattcattattaaaggaaacctcaaattattgtcccattggaagcaaaatatacatttataaatagccatttctcgttttaaaaaactaataacattgaaataaacagaaacttaagctcttctagtttgccaaaaaccagaaagcaaacatcatatactaaatgatgaaatgccaaagccatttccattatatcagaaacgagactaatacttcctgtcatcatttacatgattgtcactattattaagcattgttttggtagttctagccattgcagtaagacagtagacagaaagtcaaataattggcataaatattggaaacaaaaaattatttctactttgaaatgatacaatagaatagctggaaagcccagggggactctagtagaaaacagcaatgaggattaaatgtaagacactttggaaagctgatgtgtgagaaatgtacacaaactaatagctttctctttattagtagtcatcagttgaaaatggaaatgaccaagcaaaaatattcaacagaatgacaaaactattggttacacctaggaataaatgtgttaaagaaaggtacagagtgaaggtaatgacccttatgaagaaaacttgatattataaaaagtagtccttttctccctcagtttttgtcttcaaaatgtttacttgggacagatcgtggtttacatgatggtcctcaaacatattgtgaacaacattaaaaaaaaaagacacattttactcaataagtaacattttttgagaagctactatgtgctagggacctagtttttagtgcagtggtctccaaaataatgtactggcagtatgggaagagcgtttagaacactgtacctttttatttgggaggagaaaagaaacctttgtcaaatatttaacacctgctgccagaggtctgtagatttgatgattgtgtgccatgagttacacacagactcctaaatcagtttcacctgtggtgtcctcattctgtttactttgagcattttgcattctatatctgcttagttatatggatttattcgtcccatataatatgtgtagccacatggacacatgttctaaaaggttttaaattctgcaagatagtgacgatgatgtaaacacaagaaaagggcaaatggatacattttcctactctgtgctcatcaaacatattacaggataaaattattggctatctaataaaaacacagactaataagacctgataagttggacaaaatgtttaaaaattaacatgaagatgataggaagtatgaatctatattcactgtcattaatgtcaaacctttaccttatggtatattgtactttgagaaattatggccaggcatggtggctcacacctataatcctagcactttgggaggctgagacaggaggatctcttgagcccaggagttcgagaccagcctgggcaacacagggagacactgtctttaaaaaaaaaaaaaaaggaaattagtttaataatagtatgaagatattgtgaatagcaagacatttaatatagtttatttcatctctagctcattctttaaaaattattcttttttgtaatatataatttagatttaattgtatatataatttattaatacaaatatatacatatatatatagaatatatatagagagggtagtggatactcagttttgtggtttattttttaacttgattaggaagctgatgaaaatagcttgaaggcttcttttgtaaccaaatgcaggtctggatgctcactgcttgtagagtccagttaatatgagtgaggtctggtagaaagaaagtaactttattaaccaaaactagtgaaaggggaagtagctggatttcaatccaaagttattgttttgactttagtagactagtgttttgtcttttagaattagagggggcaagtagtgcagggcaaaaacaggaaggaaacgagtgtttctaaagttagaattttttaaaggaagtaaacctacattaaattttaggacaagaaaacgattgagccatgctgtgtgttttcatttttggagaatgggggaagaatgtaaagatggagatgaccgaatgaggaatattgttttgccattaaataagtgaatagtgcgaaatggaaaataccgaggggtaagagagttcatggtatatgggatgaaagcttaactctaaaactagagcaggtaacactgaagtgaaagggaagattgggagggaaggggtaggagataagaatatctaagcaaggctgacattgtggggaccatcaaatactatacttagttcagttacagatagctatggaattgaaagtttctcagggaaaagggaaaaagatgtaccaaaggaaataaccaaagtatagaaaagaatgttctttgaaatgaagagaaaaaagatgagtttttgagagtgtatagaaagaaaagtagcaaggttttaggcaaggttaaatactagaagttagaaataaatcaaaatctaaaaaggcatatataaagtataagtgtaatgagaaaattgagcagtttcatttttgttgtttattagtgtcaacagaatttgaaataattttcaagctgattttattcattgtttacctccttaattatataatagaaataagtagcttgtgtttcttatgaaaatttacctgctacttgatgtatcttttttcagtgcacggtagtaaaatcagttgtatatatcctgtctaacatcagtatgcatattatactatactgtacatttaattaggagtttattagctgttggcttaaatgagtttaaaactactttatgatcacatttggctcaatgaatttggatttgagactaatctttacatacccaagatgataatgttacttgtctgtcttagaagtaaagacaccaatattcttcttaccttccttttttatatcctatttccttatctaacatctctaatatgtaccctagtacaattttcaagtattttgtttttttttaatgttcagtgtacttactttttcgtaaatactgctttctttctattaaatatagtccttatctgacaaaaagtccgtcagaagtagagcttatctttaggccaggcacggtagctcacaactgtaatcccagcacattgggaggctaaggcgggcggatggctttgagcccaagagttcgagactagcctgagcaacatggcgaaaacccatctctactaaaaatacaaaaactagctgggcatggtggcacgtgtctgtagtctcagctactcgggaggctgaggtaggagtatggcttgagcccaggagacggaggttacagtgagttgagatcacgccattgcactccagcctgggtgacagagccagaccttgtctcaaaaaaaaaaaaaaaaaaaaaaaaacagtagagctcatcttttcttgaagagtcatttaaaatcagtaagtaaaaacttgcttaggtataaattttatagcctaaaacttggtcatataatgtaggtagttcctgacttctgtttattacatgaagtcctgtgtatatgaagatgctgagcctggacctcctctcctagaggccagtcagattatctgaatcctgcctaggcctctcctgtcagtttctcagtgccagtagtatataaataagaaaggagaaatcgagctttttcaaatactatggatttcagctacattttgggaaacatgtatttctacctagaacgtttaactgtgttttgtaacatttatttcaaagcaggatatgcattctaggcttcagaggaccaatctacacgtttttgaaacacaacctatgagttacgtacttttttgtaccacttattctggcataatcttcttgaagggaaaattaagaagagtgactaaatttttttcccagtgtctgaggtatgcataattctgaccaaaaagcttcaatacaactgtagcgaatcaagaaaagatttttagaacttttaaatccatctgtttgcctttattttattttattttattttttgtgagatggagtcttgctctgtcgcccaggctggaatgcagtggcctgatctcagctcactgcaagctccacctcccgggttcacgccattctcctgcctcagcctcccgagtagctgggactacaggtgcccgccaccatgcccggctaattttttgggtggggggtatttttagtagagacggggtttcaccatgttagccaggatggtctcagtctcctgacctcgtgatctgcccaccttggactcccaaagtgatgggattacaggcgtgagccaccgcgtccagccaatctgtttgcctttttaaacaccaatattagtgggacaatttccagtttgaaagctgtgtctcatctgaagactaaagcaacccggtaacatttacattttcatttatttgccacctttgctacttattttcttttgacctctgaccacagaggaaaaagaaatcaaaccaggggaatctaggtagctagagaggaatgtgctgtgaggctagttacacagaggaaggaaactaacatttactaatcctctgccacgttgacaggcactctcaccttagaagttttgacctgtggaagcagctgttttccttaaagaatagcggtaacaacaatcatagtaatatatacaacttgtataatatgaaattcaaacagtagaaaaacgaaagttacattcttgaaataaatgtccctcttagtgactgactataggaacacctagaattggctcttgagaaatagagatagttgtaaaaacctaaaaaaaaaatttttaaaccagtgaaaaacaaatccagccaaaataaaattgagttatggccgggcatagtggctcagtcttgtaatcctagcattttggaaggctgaggtgggaggattgcttgagctcaggaatttgagaccagccagggcaacatagtgagaccctgccactacaaaagtaaaaaaaaatagccaggcatggtcgctcatgcgtgtagtcacagctacttggtaggctgaggcaggaggatcgcttgagtccaggaggtcaaggctgcagtgagctgtgatctgtgatagcattgctgcagagcaagaccctgtctcaatagagagagagagagagagagagggagggagggagggagggagagagagagagagagagagagagagagagagagagaggcatagagagaggcatagagagagagagagagagagggagggagggagagagagagagagaggcatagagagagagagagagagagagagagagaggcatagagagaggcatatagtggctcatgcctgtaagcccagcactttgggaagcagagttaaacaattagccaagcatggtagcgtgcctgcagtcccaactacttgggaggctgaggtgggaggatcacttgagccagggagacggaggttgcagtgagctgagatggggccactgcaatccagcctgggtgacagaatgagaccctgtctcaaaaaaataaatatagttacaaaaaactaaaaaaaaatcttagagacagggtctctgtcacccagctggagtgtagtgatgtgatcacagctcactgcagcctccaactcctgagttcaagtgatcttcccacctcagcctcccaaggagctgggaggcattacaggtgcacaccatcatgcttggctatttatttatttattattttatttttgctttgttttttttggggggggacagagtctcactctgttgcccaggctggagtgcagtagcacgatctcagcttactgcagcctccgcctcctaggttcaagcgattctcctgcctcagcttcccgagtagctgggattacaggcacacgctacaactcctggctaatttttgtatttttttagtagagacagggtttcaccatgttggtcaggctgatcgcgaactcctgacctcaggtgatccacccaccttggcctcccaaagtgctgggattataggcgtgagccaccttgcccagggaattttttattttttaattttcataaagatggagtcttgctatgttgcccaggctggcctaaaattgagttcttttttctttctttttttgagacaagagtctgactttattgcctagtggagtggcatgatctctgctcactgcaacctctgtctcccgggttcaggcaattctcatgcctcaacctcctgagtagctgggattacagacacatgccaccacgcccgactataaaattgagttcttatagttcaataaagttaatttattatctctttatgctagtattatagaattttggagcaggtagtatcttagattccctacattagcagtgttatataaaagagaaataattcaagtcacatatgtaatttaaaatattttagtagccatattaaaaaagcaaaaagaaacaggtgaaattacttttgattgtacatttttttaacccagtatatcagaaatactgtgtcaacatgtaatcaatgtaaaattattagagatagtttgcacttttttatatgaaatccttgaaatccattgtgtattttacaattttaagtacatctcaactcgtgaagttttgataaaaaatatttgatctgtatttagattcataaaaattgcagttaaaaaagtagattcacactgttttaaacattgttttccaataaatggagtaccaaacagtttttctccagtatttgtatctgtattgagaaaaattactcttttaagaataattgatttgactcagaagaagtgcagcactgtcaaaatatccatgcaggttaataagtccactaacacttgtgaaaacttcttattatcaacgtcaaattcagaggggcatcatataaatcgaaaatcaactctaagtttatccaaatcaacaaagcgtttgttgtattttttttcataggttttgcagccactttacacagtgctgggctgctgcatgttaattcatgttgaaaaatgtgtacgatcattgatttgtattataaaaatcttcaattttaacgtaaattgttatacctgtctagctaggtcatgaataagctttttctctccttggatcttcaaatctagctaattgatatgcattgtgatataggggtaacaatgtaaatcacactgagatttctaaaaatctattcctggtttactctttgattgtcgaatattggcaagcatttcttttgttttgagaaaatctgaattagagttaacagaattgtaaatctttgcaaaactcttccttgactcaagcaaccaacattagctaataatgtggtcattaaattcactgtcttctatttcttttaacagttccataaactggtgatgatttagagcatttgtgcatatgtactgaacaatttttgggtctttttgagacgtagtctagctcttttgccaggctggagtgcactggagtgcagtggcatgatctcagctcactgcaacctccgcctccttggttcaagcgattctcctgcctcagcctcctgagtagctggaactacaggcgtgtgccaccacgccaagctaatttttgtatttttagaagagagagggtttcaccatgttggccagaatggtcttgatctctttaccttgtgatccacccagctcggcctcccaaagtgctgggattacagggataagccaccatgcccggcctgaacaattttaatagctgcttccatgatacagtctgccttagggcacaaatatttgcattgtgtttcccacagcagaaaaaataagagaaataaatccaacaaatactgatgttggaacactgtcttgctggaaactgacttttttatatctagctgagagttacagatgtagagaattcaaaaatatctacaacataagatcagtttttaaatttaaggctgcaaatagatgaagacatttctctgtaaatttgaaggtcatttgagacaaatatacccatagtattaattaggcattatctcttctaaaattcatctaaagctaaaaatacttgtaacttttcaaatgctgacttaattggtctttaatattgttagaagggacttttattcactgacagttgcttggtgtctcaaagatttttcactttccgtaaaatatctttttaacttttttcctcataatttaaaaatataatttccttaactgaaataatttaatttttcatctcatcaccttaaaattgttttctacattgaacaagaatctgaactagtcaggcgcggtggctcacacctgtaatctcagcactttgggaggctgaggtgggaggatcgcttgaggccaggaatttgagaccaggctgggaaacagaataccctggctgtatttttaaaaaataaagaaaaaaataatccaagctgttttatagctggccacttacaagctcaagttctgtaaaatcttcaggaatgtttttgttttacatttaattctgatttcactgattgtgactaattttatcaattattttttgactgaagccagttcatattaaattgaaatgcatttgctgaaaatgtctcttaactgttgtttattatcttaaaactctttttttacccagcagctttttaactttgctctgctgcagcaaatcgcaattgccattctttgtgaaatttgtgacataccttgttgagtcttttttcttttcatttgattctttctcagcagtatacctgcatttgaaagtaaaaatttttctatttttaatttttaagctaaaaaaatttaattataaaataattaaaataagtattttaatttaattgccaattatgatttacataggtcaccataactcatggtatctgcataaaatgttcaaataaacaattacaatgctacattgttgcatagaaaaatcatagaaaaatcacttgaactgactcattctgttgatacaaactagattggtgatacgcttttgggtaatgctagaaatgacatgtttacccagctgtgcactcccacatatcttgcacaatttaataataaaagcaaaagacaatcctaccaaactataacattgtgcttaatggtaaaagattttacactgcttcagttattaagaatttatattaattaaaagttttaaaaataaaaattgtattcctcagttgcagtagccacatttgcacagctctggagtctagatcaacttactttggtgataaaagggtagagaggcaaagctgctggacccaactggcctggaagaacagagcaagtccgtaaatgagtctgtactttaacaaacgtaattttatgaccaaggctgacttcatgttataccagaaaggattaccttaataagaaataaatcagttatttaatttactttgaaataatttatttgtttaaacaaccacttatttgtggcagttagaggttcagttttcaattagatattaatggcatcgtgtaaatatagaaaaagtgatctgagtttgctcttaagacttcactttccagataaatgctagcatttcgagttttggacactgaggattgttttattcaaactacatgcataaatttatgcaaacataaaataaaaatgtaagcagaaattcgagtagagtagcaatacaatttcattcttcagtgaatgcttaaggtttatagaggtaccaaatgccctaagcccaaatttacagacaaagtagatcttatcctcttaatatttatgccgagaaggagcaaaaaattaaaacttttcactaatttaatttctttatgtagttgttataggaccaatgaagaattttttctcctgctggtagtactttgataatagaaaatggtccaggatataaaagactgcttttgctctttgtggaaatgttgggaattgactttagacgctcggagaatatgttagagaaatcttgattgactgcctgggtgatcagttaatgagagtgtgtgttaaataattacatatataacattgtagtgacagttttgagaagcattcacttaaaattttcatttctctgaataaaagacacaagcatgcttttttgtgtaatcttctaaaattacttttccccacccctttctctctctttctttctccctctttttaataaaatggttttcagatatgtttttggaatctgctagagatgacctaatttttactaactgctgtgctttcaaagttttgtttgctcagaatggcagtgttatttttattattctttgatagtaataacaaatggtttcatgcaaagcatattcaaaataatatcttagtgccagcttgtaaattgtttttgttaaaattggccttatcccaggaaaaaattaaatgctaatgtgaacaagttaaagtttatattatgtgtgatttcttacattatttgctttttgacttataaaacacacagagtatcggtttttaaatatagcttaaatatttttcttcaaagcacttatcagttgcctgaatgatatagccactattttatacttttgttttgtagtgcctcagagtgaaagagcattcttctcagctcatctgaattcaagctattttaattaaattatgtttaaaatgtgcagctttaactttagtttttctattcagatatccctacaggttaattacctcttccctgcttttcacttaaatctctccttcccccaattccccattaatttgggttgggaagtgtcaacttaaagctttaggcttaatgctacatgaaaagactcggtgctttttatttcattttccatgtattaggcaccactaaaaagaatgtaacacatgtagcagcttatttcattttcaaaggaggaattgaagagcttttgagtaaaaaacgtgaaaagaagctcatgttcattgcctacgtggcttttaaaaaagactcttgaaaaacattccattgtgaattccaggtcctctttaaacttaccaccagcagtaactgcctgcagagccatgtgatcatcttggcaacagccagaccttttagtgatttcattactgtggtttcctcaagctctttacacacattgattaatattttccttgcagttatcgctgtgatgattttgtggttaatgacaccaagctgggactggtacagaaagtcagagaacacttacagaacttggaaaagtaagtaataggcctttggaaaaagaagggcctaagaatggggttgaggagtcttttagaatttttgagtggggtttttgttgatgagtttaataacttcatgtttataatatgattgaaatgttaataaaataaaccttggctttggatagctaaaacttggcccatagttaatggtcatagctgtgcatttattttatttaatatttgtcataaaccatatccaaggtcccaagagcctctttaaaaaatattacccaacaatttataagctactcaatttattttgagggtacaagaaaagggcagaaaaaggtgtgaaatcatcatagagttacttttgataatagaaaacccctgtcaaatgtattatgaggtctactaggaagcactatgatttatgcatcatttttaagggaaattaggtttaatgaacatattgtccactttgcatctatacagtggcacaggatcctagtttcttccttgcttgttaggggcagttaaatatcagttgacattacaaggagctatgaatactttgtcatcataaagaaatgaaactatttatatgtgaacagacttttattggtatagtcaaatagttagataaaactcactggacccgaaattgaagcaataaacagaaacccagctagccatgcctttgaagctacagtggatagaagcatggctctggaatgactgctgactcaagtgaaatctctgtacatcacaccaaatcattaagcgccatctaatttattttggcagttgatgtgtagaaggtattgtgaaaacatccacaaagcaggagtcccttagcaaacttaagtgtaaagcccatagaatgtttgaaaattgcatactgaaaagaaataacctaacttctttgagggcagtactgtgtagtgtttgttaaaaccacagacattatgtatgtctcattgactaactagatgataaagccaatactggaagaataatgatttctttaaatctaaaccaattaaagtacttcaggtttaagtacttcttggtttgtcatcttttggctctttttcagagtacttctcttctaatttgatgagtcctatctaggattagagacagatacacacagatccaaaatatttaattttctctgaaactgttcacaataaacatgaagtctgagattcctgaaggaatgtatgtagtatcactctttggtgtggtgatgtccttcaccctctcagtctgaaataatcagaactaagtcaaagggaaaagagggcatttgagaacctgcatgcatttatacagttaaaaaatcttttctttccattgatcacttcatcagatgaaaggtgtcacagaccacctgtctacatgtctgcttggctccatgaaaaatctaccttacagcccatttcctatgttgaaaaacattacctagattcatttttgtgttttgcaaacattggtttaatctgtagtggaatttagaaactacgatcatatttgtgttttacttaactttcgactattccgcatgccccgtggagcagcactgtccagcagaactttctgcagtgacagaaatgttctccatccactctaatatggtaacactagccatacttgaaaagtggctagtgcaactgagacactgaattttaaacttcaagtttaattaatttaaatagccacatggagtgagtggctactatattagatagcatggatctagaagattctgcattttgagagtcactgaggataaaatttagtaacttacatttttaaaaggtgaaatgccttatttatataggttacaactgaaaatgaactcttaggcattgtcataaagagcatatatactatgcttgtggtttaccttccccacttcacagaatttgtgaaggaatagttgaacactatagagtatggaattggtctcttcatcttgtggctaccagtactgtaagagagagacacacagttctgaagaacattttgaggtttgaagcaactgtcactagttctgatgtttcaaagacataattcatgtggaaattctgtaagaaaaaaataattatttactttggatgaactgggtacttttagaaggtgggagagaattggcggccttaaaagtctgtgttgtttaaccataatttttacttcctttagattaatttgcctgagacataaaattttaaagtgaccttttgaaaatagaaataactttctgataaattttaagcaaaatatttcttacatcaagaaaaattttgagtgattttaattcagaatttcctcactaataaggatgtgttttagaatgtcctttggagcgtagctgcatctaatgaatgtacatgtgcctgtattcctgtaacttatttatcattcctcaaactcagatcatatcatcatctattaagacaaatgagcaaaacatggcatctttattgaaattaagaaagaaatagcatatggagacttactgttaaatttcagaacagtagtatcagaccagggttttccttttcttgtgaggaatgaaccttctggtctgtgaagcttcgcagtcagtcagactgtgagagtggtggtggggagtgtcccacgggctgcatcttcccggccagctttgccaggagcagtgtccagcccacctctgctggaggagcaatggggatttccaaggaagtagagctcctcggttaacttcaaatacgtgtgggccccagtaggcctgacgaagcagtcagggaggtctccatgccctaggtgttgagggcagctggagtttattctttcacctgtggtgtagcatgcatatattaataactttttcactatctgtttgtgttttaatagctcagctttcacagctgacaggcataagaaaagaaaacttttggaaaactcaacactaaacagcaagttattaaaagtaaatgtaagtaattaaaatttattcaaatataagagttagttgagatttaatcactgttttgttacaactctaacatgtaatgttacctgttacagacttttataaatgtgtgtcttggatttggagtattttacacaatgtttgccacctgtactgtcgattgttgccgtgaccccagtgagtccatctgtcagcaccttcttcccatcagcgttactgctgtgctcctcttccctagaaaacagttcactcttaatacttgctcacactccttcgtcatcagaaaacccagcctttgtttttaagactaagtctttagcttcaggcggcttttcctttttttgagatggagtcccactccgtagcccaggctggagtacagtggcgcagtctcggctcactggaacctctgcctcccaggctgaagtgattctcctgccacagcctcccaagggggtgggacaacaggtgtacaccaccacgcctggctaatttttgtacttttattttgtttttgtttttgttttttttttttgagatggagtctcactctgtcacccaggctggagtgcagtggcacaatcttggcccattgcaacctcagcctcctgggttcaagcaattctcctgcctcaacctcccaagtagctgggattacaggcacacgccaccacgcccggctaactttttctgttttagtagagacggagtttcaccgtgttgctcaggctggtctcgaactcctgagctcaggcaatccacccacctcagcttcccaaagtgctaggagtacaggcatgagccaccacacccagcctttttgtatttttagtagagacggagtttcgccatgttggcggcctgtcttgaggcgcctggcctcaggcagcttttcaagattcatatcccattgttaggaaaacgtgtattggtcgtttatgtatggcttagagttaaaagtttggggacaaaaatacttggggtgtatatatttatattttttccatttctcttagtttttatagaatcttaaaaaggcattaagtcttaaatgttattttaaggatttcctgttttttgcattgtgtactccatggtactcattaatggtgatttcctcataagctttcaataagatacttctatttagaacaatcccaggatcagaaacagccttctaaaaatatccagacatttatacagagactagagagtttgtttgaaatattcattggacagaaaaggaccaattccaaattggcttggtgctagatttcagaggcctttccttagctttgatgtttgaaacagttggccttcccttggcattactgatggcctcttcttgcaccacttacagggaagcaccactgccatttgtgccacaggccttcggaatttggggaacacatgtttcatgaatgccatccttcagtcactcaggtaacgctacagtcagagcttaagtgtctgacattaaaggttaagagcacgggctctggctccctatctcgtctgccactaactctagtcatatggtttggagcaagataccttaatttcctgtgcttttgtttcctcatcagtaaaattggggacagtagttcctacctcatggggtagttgggaagattgaataatgtaatttgtctaaagtacttagagcagtgtcctgcagtgaatagttgtttgcggttatttccggttgctttttgaataggctagaactgaggtcagcaaactttttctgtgaaaggcctgatagtaaacattttagtatttcaggctacagtctctctcagatatcccccacccccccgctctttattaaaacaacactttagggccaggtgcagtggctcaggcctgtaatcccaccagcactttgggaggctgaggcgggcagatcacctaaagtcaggagtttgagaccagcctggccaacatagtgaaaccccatctctactaaaaatacaaaaattagctgggcgtggtggcatgcgcctctagtcccagctgcttgggaggctgaggcaggagaatcgcttgaacccaggaggtggaagttgcagtgagccaagatggcgccactacactccagcctgggtgacaaagcgagaccctgtctcaaaaataaataaattaattaattaattaaataaaacaacactttaaaaatttaaaactcgctttaagagctgcctggtggagggctagatttggcctgtgggctacagtttgcagacccctgggttacagagagccttgttcagagagcttatttcagtcattagttaagttttaacccatttatgtcagaggttgcaatttttctgtatgaaaaatcagacgttggtgatgacctcgatcagtaagatataaataactcccagaagcttagcgttccaataatggaacactaggcataaatgggttaatcaaggtcataagatgagatgtcttcaaaatatgagacaagtagtaaaaataaaatagtcaacaaggctgacttaagttttgtagaataaattattttgaaagttgcatacttttagattttaatgagacatcaaaggccagaataaatgatcttcccaaggttacattgctgataagaagcagaaggcatatttgatctctcctggaaggcactgcctcttagcttatctcttcttgctcaaagaggaaattataattactactgaattctccttaggattctgtatagtgtatcaaaataatatggtcggtttcatggtttgtttttatttgaggaaattattgaataactggaaacaagcaaccgaaaagaaagaaatggtgactacctatagctggagggagaattggggatttttttgaaaagagattttgttttcagctctttgttttttgtttttgtttttttacaaagtcatctgtctatactgttttcttagagagaaggaaaaatcataatgaagaatctgaatgcaagagattgcactgagtacagtttaaatgagacaattgaaaaatggcagtttcaaaatgtatatgtaggcttcatcaactttctttacagtcctattcttttctttttaaaatatttttcccttccttttaaaatagtaacattgagcagttttgctgttatttcaaagaactgcccgccgtggagttaaggaatgggaaaacagcaggaaggcggacataccacaccaggagccaaggggataacaatgtgtgagttataagagtatgtcctttctggctttgagttacaaaacaaattactttcactggtggtttccattgtactaagtgagctaacaggcacatgccttaaaaaaaatcttctaaaaattgtgtttaaatatctagttagcaatcttaataattgttggaattccggccgggtgtggtggctcacgcctgttatcccagcactttgggatgctgaggcgggtggatcacctgaggtcagtcaagaccagcctggtcaacatggtgaaaccccatctctactaaatatacaaaaattagccgggcatggtggcgggtacctgtaatcccagctactcgggaggctgaggcaggagaatcgcttgaacccaagaggcagaggttgcggtgagccgagatcgcgccactgccctccagcctaggtgacagggcgagactccatctcaaaaaaaaaaaaaaaaattgttgggattcctttatttaccgtaacaggagggataaatttagcattctacttattgactctgcagatttgggcattctagaattggcatctagatatgaagtgcagttctaggtgtagatgactatgaatctcattagtccatgtgagttgatttgtccgacagtgttaggtaaacctgtcttggatactgaaattaatttgtagtcaacagattagttgtgggggaataaagtcaatttttggttgatacggagagggggggaagaaaacggacaagtgctcattaagaaccaatcctgtatcctcatttggtgtagacctcccttatttgtggttcagaagatctttcattatgacaattgtagtgagcacatttttcataactttacagctctttttcagaaggactgtgactcgtactccttatatatttaatgttttctctgtctgcctcctccacttccacacactcccattctcactcattctgaaggggtgatcagacactttcctgccttggtggctgagggagagtaggactgaacatgtcagaataatgggcagtagggcgagagtcacagtgcagggaaactggaaagccaggcgtggagcagggctggaatgacgtcactacaagtggtgtttgaagggagtttccctcacagcagcatctaggatgagttgagcagcatctaggatgagttgaaagtgcctgcattcaaggaggctttgcactctacagtaatcaggtcagaggggacagcagtgaaacagtagaaaaaatacatgtgtatgagttaagagaagagttagtagtacttgatgcattcatgtcatgcagggttgagttgcaggctgtagaaattgcctttggctgatttaggcagcaaaggaatttactgcagggctattggtgagctaatcatactgggtgagtgaaaaatcaggtctggagtccgaggcagcagcaccgcagtcacagtcaccccacagaactgtcctgtaaggccaccactgcctctggtgcccagcgcagcagcagagttcctgttgccagcactgctggagatgggtgctggcggacacagccatgctgctgccctgcactccggatggtgctctttgccccccctgctaccagagaggatttggtgccatcccttcttctttgtgtcactaactcctgcttcggatgggcaaagcccaggctgtgtacctgtgctctgactgcaagggagcctgagaaggcgagtgtctggctgtttagcttcggaagtgggaggcaaactcttaaaagtagggattctccaacataggaagagggttcaagtactaggaagtcaaaaatatgatttgtattccagggacctatgtgattgtgagggttgagaaagaagatattgagattctctgagataccaatcaagtatccgaaaatatggtgcttatgttgacagctatggaagttgaagttgagttggatcagtttagccacaggtgtagaaaaccaaaattaagtgacttaaacatccatggtttgtttcctcacataaaagtcagaggctgtctgtctagggtggtttgacaaagccatcgggctcctcctggctttcttttccaccaacctccagaggccctatccatccacatagtcccccatggtgctggggctccccaactccgtcctcattcctagcaggaagaaggaaaggattattataggactactctttctttttaagacatttcccagaatttggacacactcagttttttattgggagagtttatatgcccaggaaaaaaatgagcgttctattcatatgcgagaagagtgtggatattgggtgataggagaggtgtacagagagcagtagatgctggagccggtcagtgcacatagaggtgaaagtgacaagaggacctcccgcagaaaattcctgctggaaactggagaagtttaaataaaaatagtcatgagaaaatctgacttttggagttgagagtcactggtggagagctgagtggtgaaggttagtgacacaggctggagtctgggggtgctagtgagtggcaagaaggacaaggcaggagggggagaaagaaagccgaatgcttgttttgcattttgaaaatgtacattcttaagtcatttggcctataactcacccagtgctgtatggtttgcttgcgtgttttaactcaaagtgtacaaacatggcggtgcatgggcacactcagagttaaccatatggttacaaattagctttgtcagaattactgctacttttatgggtttttgagatgctcttatgtatctttcagactttcttcagaaaagaccaaatcctttttaagtgttcatttcctatatattaggcattttagatgggtggacgctgtgttgaaattgtagcctctcactaatctgagggcactgtcctttcctcttttgcaggtctttggtagaagagtttagaaagacactctgtgctttatggcaaggcagccagactgcatttagcccagagtccttattttatgttgtttggaagattatgccaaactttaggtaagtattatatgaagatatttttaaacattaatattagtgtttatactgttcctgaaataattcctaatgaagtggttgtattctaaatattctaaatacttaagactggtttggtgtttttttctttttaagaagaagagctgaaattgaatacatctgactaaacacatgtgtttatttaaataatagactatagaaatgtctttaacaagaggtggggtattttgttgctataaacataaagcccttataaataacttatgcgcactaggaaaacatactggacaaaatttccttaattctttcacaatgtagaataattaccatcacacactgtcttgttattccagctaaaaaaattaataagatcagtagaagtgcatggtattatatgaactgttcggagctgagttcggcagctctgggaaggctgtggtcaagcgcctgggatgcactctccagaaggcagctgtgccacatcccggtgtggccagagagctgctgtggtgcccatgctttctgtctcacctcgcttgagcaaaatacacctctgctgtacacctagctgtcagaggaatcctgccttttctcgtaggtctgtcatccctgtagggattcgggtgatagcagctttgaggcactacaggtgtttgacagcagccttggccaccttctgccgattttacccttctgaagcaagtcatggttcttactagttatgattttggcacctaatatacatcccttctacttttctttaaaaaaaattcatgctgtagtaaacttagtcatctatcttgccctattgcctaaaaagatgtagttaatatagataaatatttaaaaggtaattaacttcaaaggactttaaattgttgccttgctaaaaagtctagtcttgaggatctgacatgagtaactagtgttaaccctagtcttggttttgaaagaaactccttttatgtatcatactatttaaatctcctgtcaggaaaaacataagaatttgagaatgtcttgactttaagaaggaaaggcaggaatgacagttaagttaccactgtccaggtctggacctaataaaaaaatttctaacataaatcacctagtagactcttgatagaagtttagtctttgtgttttattattatataataatagtttacatttattgaatgcctactgtgtgccacccactgggtattttttatctggtcttcattaaaaaacaagcaagaacaaaattccagccaagcaggaaatattgcccccattttagaggagacaaaactgagacagagaggagaagcgacttgtttaagtttatacatctcgtggggtaatgaccaaaattagagtccaggtgtttgtggagttggctaataatagatttgttgacaatgatttgcccacataccttgaacaaggcccgttaactaatttgatactgttttccttgatccccatggtgaccaagatccctcattcttgaaagcttagaaacattatcatattttatacagtagaaatctgcttttcctgtaaatctttccacatctctgtcctttctagcttctgtagcccaactgtgagcatgatgtagtttttagctgtttaatttccacattggaatattcctactgatgaaggaataaggtaaccaggctgacgaatgtagcatgtggagtctctggggaagatttcagatcatacatgaactcttaaatttcttgaatggctgatgagaatagggtgcttttgtattcttagctgggcttgctcttagttctgcagtaattgagattgttccccatttttatgtaatcaaagaacagtttttctcttggtcagatctagatcttgagattatatcatggataaagctttagtgcaggtcactgcacaatgcccaggtgtgaggcagggaggtggggcttgctttttacagctcttaccctgtgaggtatgcaggtaagattcttataacatgcctgtgtgtaagtgcatgaatcttgatttatgtttatttataatcccaaagaaattttttttaggtttaaaaagcccattttccttgattaacacatgacagacagtgtctagagaacttgatcctttgggatgaaatatgaggactctgaaatacaaacatgcgtgtagaagtagaaacatctttcatctattaaatacacaaatatatatacatacacacacccccaaaacacacacaccctcaatgtaatcagcagctttggatagagaaatcattaagcctattctttcttttttttccccactgaaactaaaagccagttacctagcagggaaaattttcttgaagttttgaccttttccaacatacatatgtacttaccacacttcttatgatttcttagtatgttcagctctttctatccttttgcttttcataaaaatactttaaagtgtattttcttaaataggcaaaaacatatgtggttcaaaattcaaaaggtaacaaaagaatatgcagtgaatgttttattctgttccctagccattcattctgttttctggaagcaaccatagttactagagttttgtgtatcctttcagatattctgtgtgcatatacagacaagtgtgtgtgtgtgtttatgtcatttttaatgtaattggtgatgtatcatctttttttccccactttgagatgattcatattagtatacaaatagcttcctcagaccattttacagttgtatcataatttgtgtccaagtcccctcccagtggctttatggactgtttctagtctttgctgttctaaacagtgctgcagtgagtagtattttacatacatgtgcaggtatctaagagagaaagtgccgggctcaaggaaatgttcttctgtaattttgatagtcttttctgctagcctttgtcactccttgcttttcttaacacagctctgtcttgctgctttgctgtctctgtatgtcatgtgcttctgcccacaggatttgccttgtggtccctatctctttgtctaggatcccggttaaagctaacactcttcaggaaagtctcttgatgattcaaatcaggtctttctgtacaacctgatttaatatatttgtcttgacttcccaagatggaactttatttttttaaatcagttcttgttataattaatgtttaaaatgatgggtaaataatcattggcacataattcttatatttgcttgctcttctcaggtttatagacaatgtaaaggatttttgtagacaaaaaatagatctttgcctgtgatgctttttttttttttaattttattttttatttgagtctcgctttgtagccgagactggagtgcagtggcatgatctgggctcactgcaggatcctctgcttcctgggttcaagtgattctcctgcctcagcctctcaagtagctgggactacaggtgcgtgccaccatacctggctaatttttttgtatttttaatagagacgggatttcactatgttggctaggctggtctcaaactcctgacctcgtgatccacccgtcttggcctcccaaagtgctgggattacagttgtgacccaccgtgcctggccacgtgtgatactttaattaaagttttatttaacaatagtctttttgggatatttgtgaaaagattttaaaatactatgctattgatatttgatatttaaaccattttcactgtagccaagaattttgctattgtatttgtgtgtttgtaaacactaattcatttttgtcagttttgttttctggtgtttttgttttgaggaaactcagtcatgattgttgccaaatactgagtaggaatacatttaacttattttcgttttgcagatattttggccaaaacaacaactttagaattctttttttaatgtcaaggatattttaaatatgagcagaacctaaaattctaacatatcttaggtattttagattatacatatgtatatctctttctacatacaatatatacagattatatactggcactgccaagacacagaaaatagtaatgtgcaggcatgtcatagttaagtatgtggtgggaacacatgagtccttttatgtgcctatattctgggatgttaatttcattatttggaacgtctgcttttcacactcaagcaggtgcaaactaacgttttatttgatttttttcgagacagtctcgctctgttgcccaggctggagtgcaatggcacagtgcaacctccgcctcccaggttcaagttattcttctgcctcagcctcccgagtagctgggattacaggtgtgtaccaccatgcctggctaatttttttttttttttttttttttgagacggagtctcgctctgttgcccgggctggagtgcagtggcacgatctcggctcactgcaagctccacctcccaggttcacaccattctcctgcctcagcctcccgagtagctgggactacaggcgcctgcaaccacgcccggctaattttttgtatttttagtggagacggggtttcaccgtgttagccaggatggtctcgatctcctgacctcatgatctgcctgcctcagcctcccaaagtgctgggattacaggcgtgagccaccgtgcctggcctaatttttgtattttttgatagatggggttttgccatgttggccaggctggtctcaaactcctgacctcaggtgatccgtctgcctcagcctcccaaagtgctgggatttgaggcgtgagccaccacacccggcttgatcattttttattggaacatttatttgtctttaagatttggggaaatttggtttgtagtcattgtgccaaaaccttgtgaagagacagttgccgcgtgttcctgtacactgtgcttcagcagtgttcggaatggatggttcaagaccttctaggctttctgtgtttgcagtgtgctctctcccccagtgatttgtcacagcatcctcatgacagatttaggagaagggggtaatctttgtctgacgtgacaaatgagagaaggaacagtgttaaaattggagccatagttggctgggtatggtggctcatgcctgtaatcccagcactttgggaggccgaggcgggcggatcacgagtcaggagatcgagaccatcctggtcaacatggtgaaaccccgtctctaccaaaaatacaaaaattagctgggcgtggtggcacgtgcctgtaatcccagctactctggagctgagtgaggcaggagaatcccttgaaccagggagtcggaggttgcagtgagccaagatagcaccgttgcactccagcctgacgacagagcgagactccatctaaaaaaaaaaaaaaaaaaaattggagccagttatttgcctctgttttcttttctcctgtacttccggtctgtcacagggacactagttcttcataaatgcatttcctcactaattctcaaacagctgtttgggtgacattgctgaaatgtgtatacaaaacataaacacagcacccaaatgtgaggactgtttcctttaacatgattataaaacaagagaaactgaagttgactacagagtcaattctgaagcccagtcatacaactagaaaatgattgaaaagataactgaaatttgttgaatttaatatgctaaataaaatattaaggctttcagataagtcaatgaagttatacatttaaatgtttagaaagagaattgtaaatgtctgtttagtaagaattagaaaaagttccagtctgagcagcagggagtgttccctggtaaatttcacaagttgaaatagactcataacctacctttatagaatagctgagtgttccgtgatctcatgtagtttaaagaagatgtgtttgtaatggtataggaaacatagaaaataatgcattttgatataagaaaatcacggtatggttggacacatacattaatgtacacgaggcacattgttttttaaaatgggatgggcttgtgttgacttgatgaaaatgcaaattggtatagctataaggtgctggttttcatgatacattttaggaaaatgatgacttagatattaggttattttggggagagaatgaaatttttttgtaagtgatagaatttcagatactaaaactactaatcttacctttgagtcatgaaaataatggatattgtattaaataagtttaaggtacctccttagatatacaaaggaactaccaactttgaatgcttttggctgaattttaacatttttattgatgagccttagaagaaatacttgaacacatatattgatatttagttgccagctagtttagaaaaagctacagtgaaatgccagagtaacttctgactttaagttccaaagttccattggttagggagattgttttcataatttataatttccaggaaaaggggaaaatatatattgacagaaactctggttggaagaaattttatggaaccgttgcctggaagagtagtgggagttttgaatcttaagatgacaccagaaaaacttaatgatttagattaattaaagagaccttccatgctggcaaaatgcagacagaagttttttttattttagttttataaaagtactttatatagcaatgctttctttatttcatccaagtaacttcccagaccttccacctgttccagtttcattttgtctgcctttgttcctgttcactgtcattgatctatatattcgtataagaatttcatatagtttcctgtctgactatactgtaagaagtaacctaagaatatgttgttatataaattcaagttttaggatagagcataactgtatatgagccaatgcatttttaaaaagtatttaactctttcagtaaagtgtttcttcctttcaggcagtgtttaaaaattagtatctttcaatctaaggagtcattaataattttaaattcccctttcttatagtagtggttcacacctggttttctagtgagggtaagaggtgaagctatgacattggagcatcttctagagaggttatgtgggcagggagaagagtcagagtccaccaggaaacaaaggtgtagtcccatctctgttactctcttgctgtaggacgttggggaagtcacataccaccccgccacctccacaatttcctcacctctgaagtgaggagatcattgcaaatccaattagctccaatattttttggttttcaaacctatcttaaacagtagaattcattcttgaagagaaattctgtcacctgtggagctttcgggcatgaaggtgaggaagcctggctgtgcttgtgagcacggggctgccgtccttttccacgccttggcctcttgctggtgtggctgggcacaaagagccctccacccggccttataagtgactgtttgtttgctttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcatgtaagatttagttgccttctgttttttaggagggcctcagacatttcttttggtgttaattatgtgttagatttataacggaaggtagaggggtttcttggacatttgctggaacttttcgtgcccttgaactttgtgacccagtgaactagcacatacctcttgcttctagaccagaggcatcttgtatttgcatcctgatttagttctgactgtgattaattggtatagattattttaaattttgaaaaaatagaaaatatttgtacagttcagcatttagaagatttcctccaaatatactgaatgataggcaggagacttaattttcatataccaaaataatatttgttcactaaaaacaaaagcttaaaacattttgaatgtgaactttcctaaagcttcattatggacttgaactttcctaaagtttatctgttctttaatgaaatcgaggcatttgtaagttctcagaagtttttcttgcctctcaatatgaataaaacaaagcttttggattgctttcccatgtactagcagcccccaagtatacactgagatcaggacacttattttgcttgaagaagggaagatttaatgttattttagcctggattttggtcagttgcagcctcctttgttcaaatgttttgaaaagtttcatcagtattgagcttcatgggagagatttacaagaagacaaactccccccaaacagagagaaaacagtaagtaacatataggtgtcattgtattgcctggcagtccataaatcggatgtggtaggactacttctttttaatggcaaaacaggcttatagctaaccaagcagtgttagaaaagggcaaccaatgtgaattgccatacttctcaaaatgattgtccctctaggtcctagtagctgtgattccaattagaatccaatatagaaagggaaggacctgtgacctgggagaattgttcttcctgctagcaccaaattaaaaagtattaaatgaaaaattctgttttgtattttatcatggcatattcatccacaaaggatattgaactgggcactatcatggataggctgtgtgaggtgagagagggtatatgtctttatgattttacatgatgcctgggcaccctgtggaatcacactgtgtaatactcagaatgttcttttagtgcctcatgagttttcaggattaatctatcccttttcatgacattttaaagattaggattgcaagttttattactgagttagggacagaaaccaaacattatcaaatattaaaaattcagatttccttcagtgcattggaaaagccatttcaggatctaagaatatttgctacaactagaaaaaggtatcttgtgcaatgtctttgttgacttgtgcacacacacacctacccctactgaaggtgaaggtgaggacggtggtatggaagaaataagtggcagatgtgatctttatagcacataggaaatcattagtgccagctaaaggaccctagaatcataagagcctatccaataagtattcaatatttaaacagttgtggttataataaatgaaactcatttttaatattaagtcatggtatatatgaaacttaatattaaacatgtcaggcagctaaaatcttgatgagtatccatttcccagaggaagtgattacaaggaagaactacattgagtctaaatgtaattcttaatgaagcagtttccattttaattaaaggcaaacttgtatgtgaacatcagcatgaaagggtcagttagagtcccttcattttcagcagggttttgtttttttttttgctatgtccttttttagtgacacagatattaaacctaaagctgaaatggccactaggtcctacagctcccaatccttcttccccaatgccatcttttaaaaaaaaatttaagacaatatgtcttacaaacagtactttaaaaagtaataataaagttacagcctatttattttgtcagtaaaggaaggaagccttttcctagaaaaggaatcaaacttttcaaatagaattgctcgagtaggttttgtcatcattgcagtaggtttaacttaaagtggcctagaaaatacacttcagtgtttaggagtaattgattcaagtgacagaaactaccttatattgctattagcaaaaaagagcgtgtattggctcaagtaactccgtaagtgcacgaaggctaatagacaagtgttcatgtagtactattaatgatagcaaacaattgaaagagctgtgttaagaacagatattcaggccagaccagcagtatgaccttggactaacttaacctcagcgtcctcatctacaacatggggctaacagtagctactttacaggtgtgttgtgaagattaattgattgactagatggaaagaatgtgcttggaatggagcctgcgtgtagtaagtgctattataagtgcctactactcctggtctcactggtacgctttctcagtagttcttgcttccattgtatgtccatactctgacacacagtggggctgtcaggaagaatgaggtacctgtttaagatacacacttagggaaaaacataaaagtaagaagcaggtgtaatctgacttcatactaataaaatagtggcaaacactttaagtgctttatttttggtaagtgctcttctaaaagcacttcacatacacaactctctcatctacacactgagcctctgtggtgggtactcttcctgtattcctgttttatatctgatggagcagaggcataaaaaggttaaataacattagggcaggtggttttgaaaatcgttcttaaaacagtatattcttcatctccacaaggaaattatttgcaatattaagtgagctttttaaaaagtgttctccgcagtaatatccagaattttcaattgtgaagtcttacttccagcagtaattactaaatctgtattaaattcctttacttccttttccccaaatctgacagatggctgtataaaaactctaaaactatctcagatcaaggatgttcaaagtcaagtaattgtgagagttccctgtaatgtaagaggccttgcaaagattccaatacaaggcagtttcatccttttgaggcctaacttggggaggaaatggaaggagtcatgttgccctgtgcagagtcatgcatgtgatctgtgttatgatagcaaatggccagtgttagttactcttggggaaagtagtgggattggatgagggcattgggggaggccagtgtagcttaaaccttttatttagtatgtgtctgtatggttttgaaatttttatattattttttaacttagaaataaatgacttaaatattccctcaaaggcagtcatctgtaggggctttaacaaatatttgtagttttttaaatgtcaaagagatggcttcttactgagatattttcctgtgtggtgattttgtttagaaatggagcatctactgttgtcacggctatattcggaggcattctccaaaatgaggttaactgcctcatatgtgggacagaatctagaaagtttgatccattcctaggtaagatatatgtggcatgtggatatataatattttattaaaataaatttaatgtttccttcaaaaaataagtgtaaagagaaatctagaaatacatcagtttgtgaaattattttgaatggacatatatgcctttaacagctctctgtttacctctctctccttttaagacctttcattagatattccaagtcagttcagaagtaagcgctctaagaatcaagaaaatggaccagtttgttcgttacgaggtaaagatacttgaatgttctaaaaatttttttctttaaataattgaatagattgataagcttcatctatatgtggtatctttaattaatatctttaatgaatctgtgttgtaacttaacaaaagtcaaacttgaatgtcttttcctactccccaaaatgttattgaataagaatgtgtgccataagatattgtgtgaagcataaaatatttctcacctttttcttctttgaaatactgactttaaaatagaaggtctgtagcaaaagtttttctgaccaaatgaaacagaagttattctgtggttatcccactagcatctataggaagaaagaatactcagcagagttttataaattatagtattacgtattctgttgcctaatagtttgagaaatctatggatgatacaactgctgcttaagcctgaggccctgcttttaagactgttaaaattcacatgtatttagggagatttgaacatattttttgcttgatgagtactagctactgtaatcaaggcagaagaccttatttaaaattttatcctagaccataagtgtacagacaggtcacaattaaaatgactaattgttcttgctagttatataaagaagctaggatagaccaaagaggccgagtctgtattttatcagaaactctacactgaagctaacagtttctactctgatttgtatgttcactaaaagtaatgctcttttctcttctctattttagggagtattgtcatgatggtttttttttttttttttttttacaaaacaaactgcactgtccaatatgataaccacgagtcatgtagctattaaaattaaattaattaaaatttaaaattctgttgcttaatcacacttgaaccacatgtgctcaggaaccacatgtggctagtagggggctcctgcattagacagcactaccctaggatcagattatcctagtagaaataaaacttttgttggagaagggctaggcttctctgtgctactggcattctatgtaatgtgaggcatttggcttattagaagcagcagaggtctcagacacttgtagcactgttgctcaggtcgtttctagaaatctgtcagatgatatgtgggatgactagactacactccagtaaggaaccagagcaactctgtatatgaaacattttgtagatgctcttagtttgttccttacctacacaaccagtgttgattgtctccttaacaggaatacagaagaaaaagccccactccacttctctgcaaaatatatggctctagtatgtgtctccaaaactgtttttggcctgtttgagattaagaaaatatcacagtatgcttgatattgtcaaatgtcacacattttctctttatatctagggcatgtgagtacatgctaacttaaccataaatatctgaatatctggttatttacagtggaagtcagtgagaattaaattaaaggaattagcctcaaactgtatcattttataaactcttcaataagaacagtaataatcacattagtttaaaaactgttcctcgctataaatacatggatatatatctgaacaatactttttttttttttttttttgagaccgagtcttgctctgtcgcccaggctggagtgcagtggcgcgatcttggctcactgtaacctccgcctcccaggttcaagtgattctcctggctcagcctcctgagtagctgggactacaggcgtatgccaccacacctggctaatttttgtatttttagtagagacgaggttttgccatgttggctaggctggtcttaaacgcctaacctcaagtgatccacaccccttggcttcctaaagtgctgggattacaggcatgagccaccgcacccagcctgaacagtactttctgatgtttaacaaaacttagtaaatccagatgatctttggctagaagactcagagacactagtttgtttaggcttctttccttgcttccttccttttttctatgttgtttccctcattctgagttggttctatatgtagttcttattgactttcataacatttcagttacgacttatcccagaatagtttaatatcaagcagagtctcacttctcgagcccatccaggaggagagtgcatgacacagcttatagatggctgatttttccccaaacaagaaaagtggcaagtggcatctgccttgcatcccacggagtatttttcttggcacagaatccttgaaatctgatgtgactggtattagcttcagggggcccagaccatcccaagtagtttagggtttggctggaaacatgtttcctgtattctcagctggctttcgtttgaatcctcaggcttgatttttatttaagagcttattgtcggctttaaaaagtcgatgacagggtctggtacctcctcactgtgtttttgttgaccacccttatcattaagggcacttctcttcttggacatccagaatgtcatggacttcagttgactgatacacctttctttatttactggagatggagacttgtgattacctagtatgtcttctacgtgctttgagtccacctggcaagaactacttgtgtactttttggatttgtaattgttaagcttagttttcctttagaaaggaaaagtgatggtgagaaagacccatcttaaataacttaagtaacttttgaaattaactaaaaatacgcatattgcaaaaggcattaaataaccccagttctaaaacctgacagataccatgaaaaagaaaatgtagtttgatctcacttatattatagatcgaagaatcctaaataaagtattagcaaatacaactcagcagtgtactaaaacaataatattcagagatcaaataggactgatttaatactagaaatataattaggtgaaaacaaatcaaaatgccctaataggccaaatgcctaggcacagtggcttatgcctgtagtcccagcactttggaaggctaaggtgggagcattgcttgaccccaggagtttgagaccagcctgggcaacatagtgagaccctgtctgtacaaagaaaagaaggccgggcgtggtggctcacgcctgtaatcccagcactgtgggaggccaaggcaggcggatcatgaggtcagatcgagaccatcctggccaacatggtgaaaccccgtctctactaaaaatacaaaaattagctgggcatggtggggagtacctgtaaccccagctatttgggaggctgacccaggagaatagcttgaaccagggagtcagaggttgcagtgagctgaaatcgtgcaaccgcactccagcctggtgacagagcgagactccgtctcaaaataaataaataaaataataagaaaaattaactgggcatggtggtatatgcctataatcccagcttcttgggaggcttaggcaaggaggatcacttgagcccaggagttggaggctgcattgagcctgcactgctcctgtactctaggcctgggtgagagagtgagaccctgcctcaaaaaaaaaaaaaaaaaagtccaaatagatactgataaaatcccaaatatattactgattaaaaggagaagaaaggggtgggtgcagtgtagtcccagcactttgggaggccaagacgggcagatcacttgaggctaggagttcgagaccagccctggccaacatggagaaaccccatctctactaaaaatacaaaaattagccaggtacggtggcatgtgcctgtagtcccagctcctcgggaggccaaggcagaataatggcttgaaccggggagggaggttgcagtgagccgagatcgtgccactgcactccagcctggacaacacagtgacactctgtctcaaaaacaaagaaaagaaaaaacttttattaggaatagaaatgttaacttggccaggcgtggtggctgaagcctgtaatcccagcactttgggaggccgaggcgggtggatcacgaggtcaggagatagagaccatcctggctaacacggtgaaaccccgtctctactaaaaatacaaaaaaaaaaaaaattagctgggcatggtggcaggcatctgtagtcccacctactcaggaggctgaggcaggagaatggtgtgaacccgggaggcagagcttgcagtgagccgagacggcgccactgcactctagcctgggcgacagagcaagactccgtctcagaaaaaaaaaaaaaaagaagaaaaaaaaaagaaatgttaacttgatgacaattattcattaaaagctatcagtgatcatcatagttaatggtgaagcactgatgattttccagtaaggccaggaataagccaggaggcctactgaaatattgctcagatgtcttctggaggaacaaggcaataaactaggaaaagaaataagaataaattatagaatgaccaaattattaacatttgcaggcagattgattatatacctagaacatttcaggataatcagttggaaaattacgagaaatattaacaactattgccatggagagtgagactaggcaggaggacacctgcttttctagaagccctcaatttttaaaaaatcaaacacaagtaatactttgataaatatattataaacatggagctaaaaagttcaggcaaaaagccagctggctttctgtatgtagcaaaataatctattcacagtagcaataaaaactcaaaagtacttaataaatttaataaggaatatgcaatactttaataaaacattataaaaggacagataaagcctgaataaaaagagccacatcatattcttggatgggaagacccaatatggtagaaatgtccattttctcccaaattactccctacatttattctgatttattcaaaaattcctctgtacgcagaaattctcaagaagagctaaagaagtttctaaaatgaaagtaaggtagaaacatagcagtgggataggaaatgtcctagaactactaatatagagcaggtgctaatgtaaaatatttatgcaaatttacaatatgccaaagaatgtcaaatcagtgggacgaataagaaattaggcaataaatggtgttagtgtaaatgaaaattaatttgggaaaacattaatttcctccctgcctcatatcctttccctgattaatttgaggtttcaatatttaaatgtgaaacataaaaccacaggacactataggaaagcatctttattatgatcttgtcataggggagagctttctaagccagaacctataatgggaaacgtttcataaatttaattgagcaatggtaaaagaccataaacaaagtggaaaagagatgataaacttgagacaaatatttggacatatatgaaaaaggtgacttgggcagagtacatgagtaagatataaatgatcattataacatctaaaaagtgttaatcctcacttatattcaagaaaatgtaagtaaaacaagattggtgaaaagggtaaagatggatgtcagtggaagaggacactcgtgttgttgttataagtctaaattggcatggttgtttttggaggtagtgatcaccatttttaataggcatttccttagacatactaatttcacttacaagggtggacaatagtatgtgtaaaagattttaaacactttgttattgaaaaaaatcaaacaatttaaatgtccaccagtagggcactggtttaataaattgcattatgtggcaattaagaaagataaagttgaccagtaactatgccatagaaacatagctacaaaatattgtgtagtaaaaaactgtccatggaaatatgtgtgtggaataattccatttgtgtaagataaaaaacatttatatgagtgttaaaattcttaaacagcatacactgtgctgttcacagtgattatctcagggaagtgggattcaggagggaaatggaactatgaattatttttttcatttgttttaaccgatgtgtgtcacctttataatacctatttgggggatagtaaaaaatgcatattaacttaatgtatacttccaaactactgctttgctaaattaaatttatatagtatataaagttgacctaataactaacttcaacaaaccagctttatttcctgctttccatagagatgctgttttaacagtttatatcatgtggaagactgacggttgtgaaatacatgccctgaaatctttgagaatcttaagagtttcagaaagtggtgcatatatatatgaatatataatatatatatgaatatataatatatatgcatatatacttattttaatatttatataaatatatattttttcttttaggaaatgcagtaaagtacaaatgaaatattaagcagcttcctcagatccttactgaaatgtgaacactggatagctagtagactctttttgagatggagtcttgctctgtcacccaggctggagtgcagtggcacaatcttggctcactgcaacctccacttcccaggttcaagcgattctcctgcctcagcctcccgagtagctgggattgcaggcacgagccaccatgcccagctaatttttgtacttaatagagatggggttcaccatgttggccaggctggtctcagactcctgacctcgagtgatctgcctgcctcggcctcccaaaatgctgggatgacaggcgtgagccaccgtgcctggctgctaatagactctttacaggccatataattcacttccacatgtgagctctgaggtgaaattcacactcatgctgctgcaaaatattaaactgaggtacatttcagggtcattcaggcttttcaaatagttaaaatagcagttgccaaatctgtgaatgttaagggtatgttgtatctagatagtcttccccttaaagaaatatatttccatgtgtttatatgtatgtttgtgttggtttttgtgtgtgtgtgtgtgtgtgtgtgtgtgtgtgtgtgtgtgtgtgtgtgtgtgtgtttagatggagtcttgctctgttgcccaggctagagtgcagcggtgcaatcttggctcactgcaacctctgcctccgggttcaagcgattcttctgcctaagcctcctgagtagctgggactacaggtgtgcagccaccacacccggctaattttttttttttttttttttttggatttttggtatagacagggtttcaccatattggtctggtctcaaactcctgacctcatgatccacctgcctcggcctcccaaagtgctgggattacaggtgtgagccactgtgcccggcccatatgtttgttttttaaaagacagggtctcactctgttgcccaggctagagtgcagtggtgggatcatggctcactgcagcttcaacctcttagtctgaggtgatcctcccacctcagtctcctgggactacaggcacatgctgcaatgcttgtgttttttgtattttttgtagacacagggtttcacccttttgcccaggctggtcttgaattcctaggctcaaatgatcctccacctcagcctcccaaagtgctgggattacaggcgtgagccactatgcctggcctgtatgttttaataatggttttctttatacatatgtttattgaagaatttggagaaaactcaaaaaagtaaaaagaggaacatatacatcccttataagcttatcattcagacatactgtagttcagaaattttatgtttagaaactgtgatttaaaagttgatttttagggccgggtatggtggctcatgtctgtgatcccagcactctgggaggctaaggattacaaataggcattaggtttctggggatgctcaggtaactttttaaaacccatgaagagatgacagtggtagtggagattgttctctactaatccaactagggtttactataatagcactttcttaggggaactccccaggaggccctactgggcacaccagtctccttaccttctgctttggctgtgatcctgaggatgtccccacctcttggcaggcagtaccaaaagggagaacagagaggggttctcaaggcagttagggccaccattttttaaactgagggtttgaaaaaccaggctcagcttatattgcctctttatgaatcatcttatgggcctgacctgatcatgtctattcctttttggtatctcatgtggtcttagaagaaaaggactaactttccattatcttgtgcataaatcagcagggagaccactacatggtcaccttgtaagtttaagcaactcaaaaaggcagggaggaagaaaatgttggaaagcaagaagatgctggaagatgctgggagaaggcataaagagcctcctttgcattggagagaagatgaggacaggaaggaaggctgcgagaggtgctttggtttcagaaaaggagcagggtgatggcaggggctttgcctggcaggtagaaggaacaagagagcagtctagtatttatgtgcatttcacataaatgcagatgagttactgtgaaatgttgatagattctttcagtaatctcagtgctcctcagggtatcaaattcctgaaattaaagcttctaaacagttactaaaggagatttagaataccacctgccaactcagtagtagccctctgaatgaccccatgcttccacacacggggagaccccttcagaaagtgggtctgtacaggttaaatataggggggggaaaaaggcttctctgctgttgaggcatttctgcttctcagtgttgtgtggctaggtagcacaggcaacaatgtcttgctggtgaatcataaaccatctggctaatgggatggagaggctggagtgacagtatttcagagtcatactctccctgccttcttatttgcctgtgaaagtttcaagcagacattgtcaattaaaaaaaatgagctaggcacagtgtggctcatgcctgtaatctcagctactggggaggattgcttgagcccaggagtttgaggcttcagtgagctattttatactccagcctgcatgacagaggaagaagaccttgtctcttaaaacaattttttaaaaaattgtggtaaaatatacatagaataaaatgtaacattttaagtgtcttaagtgtgtaattcagtggcattaagcacacccaaaatattatacaaccattactacttgtaaaaatttttgtcatcctaaacagaaactctgtacccattaaacagtaactcattacttttcctctcttgttcccagtaactcttattgtatcctctatgaatttgtctattctaggcacctcatataagtggaatcatactatatttatccttttgtgattggcttaacttagtgtatattcaggggtcatccatgttgtaagcatgtctcagaatttacttcctttttgaggcttaatattctctggtatgtatagactacattctgtttatccattcatctgttgacgacacttgggtttttcccaccttttggctattataaataatgctgctatgaacactggtgtagaagtatctgagttcctgcttccagttcttttgggtatatacctaagagtggaatcgctgaatcataattctgtttaactttcggaagtactgccaaacttttccacagtggctgtaccattttacattcccaccagcaaggtacaacggttttgtttttttttttttttttttttttgagatggagtctcgctctgtcgcgcaggctggagtgcagtggcatgatctcagctcgctgcaacctccacctcccaggttcacgccattctcctgcctcagcctccctagtagctgggactacaggcacccgccaccatgcccggctaattttttgtatttttagtagagatggggtttcactgtgttagccatgatggtctcgatcctcctgacctcgtgatctacccgcctcggcctcccaaagtgctgggattacaggtgtgaggcaccgcacccagccggtacaaaggttttaatttctccacttgctagctaacacgttattttctgcttttgtttttgtcttttaaataacagccatcctagtaactgtgaagtagtatctcactatggttttgatttgcatttccctagtaattgtgatgttgagcatctttttatgtgtctgttggtcatttgtgcctctttggagaaaagtctattaaagtcctttccccatttttgaatcagtttgttgctgagttttaggagttcttcatatattgtggccattaatcccttatccagatacataatttgcaaatatttttctcccattctgtggttctctttatagtatccctcaatacacaattttttaattttgataaagttcagcttatctattttttcttttgttgcctgtgctttgggtgtcatatcaaaatcattgccaaatctaatgtcatgaagcttttcccctacattttcttctaagagttttatagttttaagacttatgtttaagacctttgatctatttaaatttttgtatatggtgtaagagtccaacttaattcttctgcatgttgatacctagtttccccagcaccatcttttgaaaagattgtcctttccccattgagtagtcttgtcattcttgtcaaaaatcagttgactatatagtaagagtttttttcattggtctgtatgtctgtccttatgccagtgccatcctgttttgattactatacctttgtagtaagttttaaaattgaaagtatgagtcctataactttgttgttctttttcaaaattgttttggctattcaggattccttgagagtccatgtgagtttcaggatgggttttctatttctgcagaaatttctattgggattttgagaagaattgcattggatctgtagattgctttgggtagtaataatcatgttaacaacatcaagtcttccagtctatgaatgcaggatgtctttaaaaatttctttcagcaatgttttgtagttttcaggtataagtcttttgtctccttaaatgtattcctaagtactttattctttttgatgctactataaatggaattatgttaatttcgtttttggaaatacctaacaatgaatacattgttagtgtatagaaatgcagctaatttttgtgtgttgattttgtatcctgtcttttcattcccttgacagtatcttttacagagcaaaaatttttaattttaatgaagtccaacttataaatccttctttcatggattgtgcctttggtgttgcatctaaaaagccattgccaaatgcaaggtcatctggattttttcctatgttatcttctaaaagttttataccttcagtccactttatttgtttttgtggagggtataaaagtctgtgtctagaattttttttttttttttggcatgtgaatgtctttcaattttgttcttcttcaatgttgtatttgctattcttggtcttttgccattccataataaactttagagtaattttgtcaccatccacaaaataatttactggtttgagattgcactgaatctatagatgaagttgacatcaatatagaataaaactgacatcaatagtgagtcttcctatccatgaatacaggatgtctttatgtcttttaaaatttctttcagcaacattttatagctttcaggtagttaactttttaactgtagggttttacatgagatcatgtgatctgtcagcagagataattatactttttccttttcattttggatgcttttttcttgcctgattgctttagctaaaacttccaatattatgttgaacagaagtggcaaaagtgagcatccttgtcttcctgatcttggaggcaaagctttcagtctttcaccattgagtgtgatattcactgtgggttttcatatatggcctttgtcatgttgaagttctccttttttctagtttgagtgttcaaatgatgattttaaatgtggaaaattctgtgtttcctttccttatttcttattctccctatgacccccgctgtccccgccaaggccatagctttttacatgatgtaacaaatacttgctgaagaaagcacccatgacttcagctgcagagctcacaagcaccatagtgatcagtctgaagggattattagtgccagccagccagtctgctgtgtagtcagtgctctttctttgtagccagagatgtaggacttgggaggctcctgagaacagcatcactctatttgcaagtttggttgtaatgtctgagacttgcttcaggaattgtaatgtcaaaatataatacatcctttcccaggaaccatcactgacataaaatagcaggttgagcaggttggcaatgtagtatttgtgggaaattgaggaaagaatggttaactgtccactggaggttgagaaagtctcaaagaagtgagaattgaattgagttgcagggaggcgagaattgagttgtagggaggcaggcataggaatgtgccttctaggtactaggatcaggcaacaaaggcatattcaagactgtctagtcctctgccacaccttgcctccactaactttccctgaaggggcgctgtctgctactgtcgcggacacaaaggctgactatggcttggaaacttgagtacagagacaagagcgcttttctgtacacagctaggtttctgcttgctacccaactttaatatattatttaaagatacatacatgttctataaagacaaatgacataaaagtcaggataatggctacttctgggcagaggaaggggaattatctttggtaagaagcacatggccacacaggttgtccactgcacaactctaggagaggccgtgcacagagaccctggctccttgagtactcgagaaaatccaagtgtggggtccataggcattcatattttttctacagaataacgtgtattttatatagatttatgaatatctgattgcatcaggaattggcacaggggccaaagagtaaatacagtaagtcttcatttaatgtcatcagtaggttcttggaaactgcaagtttaaagcaaaatgacatacagcaggtcctccaataatagtttcctttaacgtttagttataacattgatgagaaaaaagtggtttatcgttgcttcacataaggtcacaattttcaagaacctgtcatgatattaagtgaagatttacagtgttttaggctttgcaccacataaggtctctgccccagtgactcagtttggtgtagtgtaaaagcagccagacaataatgtaaacaagtgggcatggctctgttccaatgaaactttatttacaaaaccaggtggctggctggatgttttaggactgtagtttactaaaccccaggttacacaattacatctttaaatgaaaaaaaatgtagctgtgatttatctaggaactgagagtacagcgtctggacagagaaggttgatagtgtagccttctgtgatctatgtttatttttaaattatctaaatttgacttttttttatgagtttggagctttgtcctgtataatgtaacatattgacagaaaactacaattgaaactttaaattcatcaggaaaccattttatcagaattatccagatgaattatcattaatagtaaaaccaacacaattgatcatcaccagatgtcaggcatgatgccaggtgctctacacattatttctcttccttataatagttcttcaaagtaggtattattttttgtctccagtttgcaattgagaaaggttaacttttctaaggtcgtatagctaataaagctgagattttaaacctgggtcttttttctacagtacattgcctctacaaaaggcatcttgttttaatgctgccaaaatcaatttgtttagattgtcttcgcagttttaccgacttagaagaacttgatgagacagagttatatatgtgccataaatgcaaaaagaaacaaaagtccacaaaaaagttttggattcaaaaactacccaaggtgagtgttgaattttgagttatgaagcaatttcaatgggaaagtgcttgactgctaagaccatgtctataactttacactatgtgaactgttctgtatttttctctaggattttcagtaaaagctaaaccccttacagaatgaatgcataaggtatgcatggaagaatgattgatagggcagctaaaatgttatttactgaactgatagtagtatcaaactttgactgaaaggtaaattaggtgttcacaatctttgaccgcatctctgtcctccaggtgctatgcttacatttgaaaagatttcattggacagcatatttaagaaataaagttgatacatacgtagaatttccactgagaggcctagacatgaaatgctacttactagaggtaaggtggttacctttttagcatggtgaaaaaatggctcttcagtaagattgtcatcacatggagagggtagaggtcatcgagatactgatgtcattgaccactgctccttcttccttgttctgtagcctgagaacagtggcccggagagctgcctgtatgacctcgccgctgtggtggtgcaccatggttccgggtgagtacaacagccagcttctggtgggtgggaatacctggtggccagcccaatgacctgcagttttgtaccactcttgctagttcttcctaaaaaatggattcagataaagtaggtgaaatttccttcagttttggtgcggaagagtactcctcagatgatgttgtgaaggcttaagggaaggtaaataaaagtgaaatgaagaatggttcatttgaacccagtatttacgacccagtctttatttgtccacaaactccaaagttgcttattcgtttaccaactgaaatttaaatggggcaaaaggggaaattacttggaataacttactccatatcatctactttaaagactcattttaagtcttgttaaaaaacattaattttttcccctgaaagtttgtatgaggggtctaaccttctggtttttggtttgagagtggctattttaccttcaaacttaagactactatatgtgggcagacgactatccatgttgaaaatccttttcccgcagagctgtgataaagtaacgtctacactcacatagtgttatgaatgacaagtctgattctcactactttacaggcacctggcttttttctccttggagtgtattcctgcttggtagttggtagggacacttttaatttggtgccttcagctcatgaaactctctatactgtaggtctgaaatcatttgttctctgtacccctattatatgcatagtgaatttcctggatctcccttccacatgtcttaaatactctaatgatttctgtctgtgtttctaaagactgccatggcctacttttccaaatcaccaatttgggtttcatctgtatccaaataaaagataagctcctccataaaatatttatattaaatcagtcacatttttctgacaactttttcgtaacagcctattcttgttttatgattgcactatctttttgaaactattagcactaatttaaaaatgtaaagttctcttaggttttctgcattcaattcctcagggttgattgccttgcttgttcttcccggtatttctttcccctcaaaaatgtgattttgtaggcgtgcaaaaggcttgtttttaaaatttggttttggtggtttatttggaatcatagtaaatgatgagatggatctttattatttaaatagggttttcctggcacctacaaaggtctgttctagctgcaggccttccgtctgacttggaggactgactccagggttgtgtgtgtgagtgggtgggtcatgctgatagggtagagcccctgatgaccacggtgtcagggaagggtgcccttctttgttaagcttagttttttcctaagattctgatgggaaaacctggtacctagttttccatgtttccgtaggctttgacctgtgcttgttaggttgcgagttcctcatctctgttttctccattagtccagggccatctgctttgtgttctagcaaaccctcgatttctggtcagtttggaggaaggtaaaaacattaatttaacaagcatcttaaatcaaaagtctaggatgtattcttattaaaatttaaatctaacattatatagttgtacaggtctttttgtgatttctgaggttcttttttcctttggtcttttgcctttacagggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgttttgttttttgggggtttttggagacaagagtctctctctgttgcccaggctggagtgcagtggcacgatctcagctcattgcaacctcggcctcccgagtagcaattctcctgcctcaacctcctgagtagctgggattacaggtgcccaccactacacctggctaattttttttttgtatttttagtaaagacgggggtttaccatgttggctagggtggtctcaacctccctcctgacctcaggtgatccgcctgcctcagcctcccaaagtgctgagattacaggcgtgagccatcacgcccagacagttttgtttttaaaaaacagatttaactcaaagattcaaatttggaaccagaatcccatttaaagaaagcagttgtggtttctacaagtgttctaagacagtcctgtggtggttttttttttttcttttttttggttgggggcggtgggggttggtagacatagcctaccaattctccacaagggacaaaatgtatcttgtgttaagccaacgagactttctggcaattttttttttttttttttaatggagtcttactctgtccctcaggctggagtgcagtgtggcatgatcacagctcactgtagcctcaacctcccaggctcaagcgatcctcccacttcagcctcgaagtagctggcaccaccacacccagctaatttttaatatttttactagagatggggtttcaccacgttgcccaggctggtcttgcactcctgggctcaagtgatccacccaccttggcttcccaaggtgctagcattacaggcatgagccaccacgcccagcctgttctattaaaaacatcttgacctttttttttttttaagtttatgatataaaaacagtctggtggctttccctcaggttggatatctgaagttgtgggagcagatgtagctccatttccattttaatattaactggataaatcccacatcttcccagaacacatctgctaaacactttaacatgacaaggagcaaattacaattatgtgtaaacttatatcatccagtacaatggcccctagccacatgtgactgaaatttaaattagaaactcagtgccttcagtcacactagccacatttcaagtgctcagcacccacatacggcgtaggacaatgctggtctaaattttcactccaaagaataaaactttgccatcatgtttaggtcttacaactttgagtcctaaaagataatagggagatgtgtgcttaaattaatttacaatgctaaattatattaggttaaactgtatgaaaccctgctatttgatgagttctgatctacaaaaatgacagctccacctgatctgatgtatcacacattaacatcacatctaattcaacctgaaatgtgagtctcctttgatcttgcaaagtatctcctatgaatccgggctcttttgcttagaaggtagacagctgtaacctctaacattgatacttcgatcttcagtctctctgaatgggcagctgttaaacagtaaaggcctgggcagagttgatggtgaaaaaaagctgtatttttataccaaatggaacttcagcaacacgttggactactttgtcgggcagagtggtcttcagacaggtgatgctgttggcttaagagatgaacacgtcttctctctgaatttgtttttattggttggttttacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttccttttga

SEQ ID NO: 2854 - DNA, 90130 bp, Homo sapiens; identical to SEQ ID NO: 2853
  source 1..90130: mol_type = genomic DNA

SEQ ID NO: 2855 - DNA, 90130 bp, Homo sapiens; identical to SEQ ID NO: 2853
  source 1..90130: mol_type = genomic DNA

SEQ ID NO: 2856 - DNA, 90130 bp, Homo sapiens; identical to SEQ ID NO: 2853
  source 1..90130: mol_type = genomic DNA

SEQ ID NO: 2857 - DNA, 84699 bp, Homo sapiens
  source 1..84699: mol_type = genomic DNA
ctctcagggcgacagttacaggcaaagaagaggaagtggtagcactagctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccaggtgagccctccgcgggcaggtgtgctgagggttggagacgggggtcctccccggggctgacagtcgaggggctgacgtgctgctccacctctgggcctgcaaaggagagggaatatgcttacaggtccagggctggcccagggggtggtcacaatctgagattctggggtggcctccccaagcttaacaggctccctgtgtgggttcacgggccctgagttggcccgcatctgggctgagaactggcaaactaggggttaactctctcaagccccaggcgcctctactgtggttcatgcccccagatgggaccaaccagaggtctcgggggagctccccagaacccccagggtggccattgggttacctgaggctttggactcctttgacccccagagtctggatgtgggggaggagcctccgccaacatcttcccccacatgtgtctcctcctcccgggccctgggccccttccttccccttacatcttccttccccttggcttcctgcctgggcctggggcagcatggggcaggtggggggctgcagccccagggatctgagcttcctccctgcatccatctcagaggagatagtaaggcagggcccagtcctgggctcagagagtgggtcctgaggtcttggtgcttggaagagctgcattttctcggcagggatttctgcaggggcccaggctggaggggtggtggtggatttgactgtggctgtatgagactggctcaggaaatatattcaaatccctatttgaatgtggttgggtgggcgtgtgatgtggctgcattatgttgctgtagcatcatgtctggttccccagggctgctgggtgggaacgggggacggggcggggctggtggagtcccatctcctctgggatgaaaggagatacagccctatcctggggcctgggggacacagtcctgccctgaggtctgaggggacagctcccatctggtcctcaggctggccctgcagatgaagagctgggaggataagttaatggagatgggcccatgggggttcctggcgggtggttttcaggggcagggccattggtggaagagatccatgcgcctttactccttctgtttattttatttatttatttatttttttgagacggagtctcactctgtcacgcaggctggagtgcaatggcaccatctcggctcattgcaagctccgcctcccaggttcacgtcattctcctgcctcagcctcccgagtagctgggactacaggcgcccgccaccacgcctggctaattttttgtatttttagtagagacaggggtttcaccgtgttagccaggatggtctcgatctcccgacctcatgatccgcccacctcggcctcccaaagtgctgggattacaggtgtgagccaccgcgcccagcctttttttttttttttttttttttttaaagacagggtctcactctgtcgcccaggctggaggcagtggtgcgatctcagctcactgcaaccttagcctctcaggatcaagcaattctcctgcctcagcctcctgagtagctgggattacaggcgcccaccaccacacctggctaatttttgtatttttagtagagacagggtttcactatgttggccaggctagtcttgaactcctgacctcaaatgatccacccacctcggccttccaaagtgctggaattacaggtgtgagccactgtgcccggctgctccttctgtttttttttatcttatcttttattttttgagatggagtcttgctctgttgcccaggctggaatgcggtggtgcaatcttggctcactgcaccctccacttcctgggttcaagtggttctcctgtcccagcctcccaagtagctgcgactacaggcacacatcaccatgcctgcctaattttttttttttttttgtatttttagtagagatggggttttcccatgttgaccaagctggccttgaactcctgacctcaggtgatctgaccacctcggcctctcgaaaggctgggattacaggcatgagccaccatgcccggcccttctgtttctttagtgccaggggattacactgtcctcagctgggacagggcttcctgaaaggagaaggcactccccccaccaacctaagcatccatcctctggccacagcccatcccagctttgcctacatttgcttaatcttctggtttctagggcatgaggaagtagtcatgggatctgttaggccccatctgttagacctggcagggagtcaagctctctgtgatgcttcaatagcagctaatgggaaagtggatagacttaaggatgaacttccattcttgtgtatgtcttagctaaagctagtttttggatgaaggacgagggtgcatgatgctaatccctgggagagcagctgcactccaaatacagtcctaatcctctgtaacagggaacaacgggaacccagatggggtcaggctttatgcaagaggggacatttgtgctggggttttgaagagtaaataggagtttttctcattgttctggcttcctgtgcccagctgtatcaggctccaggctgggcatcggtgtacccagaccctttccctcttcgagggggcacattcctgcccctacccattttgttgccctttgaagcccggccgtgtgtctggtatgtagtggggacgtgtgagggaaggtaagaggtcttgacaagaagccagaggaagctgccacaggaacaacctctctgggtttctgggtgcctaactgtccacagattgaagcagagctgtgaatgccccatgggatgtgaaagggtagagggaaaaaggaaaggtgctcctgtggaggaaatggcataaataaaggtgtgcaggctggaatgagaattcttcccagtttctgtcatttctcttcggagtccttctcttttttctcagttgtttcttgggaagagggtggaaagaacatattcatccatccgttcatccacccatccactcattcatccactcatctatccctccaattatccatccatctacccatccatccatccatttatccatccatccatccatccatccatccatccatccatccatccatctgctcatccattcatccatctgctcatctatccacccatccatccatccatccatccatccatccatccactcctccatccatctgctcatccatttatccatccactcatctatccatccatccatccatccatctgctcatccattcatctatccactcatccatccatccatccatccatccatccatccatccatctgctcatccattcatccatccactcatctatccatccatccatccatccatccatccatctacccatccacccacccatctatccatccatccatccatccatccatccatccatccatccacccacccatccacccacccatccatccatccattcatccattcatccatccactcatctatccatccatcctctcatccatccatccatccatccatccatccatccattcaaccacccactcattcacccactcatccgtccatccactcatccatccatccatccatccatccactcatttatccatctatcagtctatccatccatctacttttccatccatgtatccacccatccacccacccacccattcacctatccacccacccatctatccatggatccatccatccactaatctgtcttttttatttatttgtttatttatttacggcgtctcactctgtcacccaggctggagtgcaggggcatgatctcggctcactgcaacgtctgcttcctaggttcaagcaattctcctgcctcagcctcctgagtagctgggactacaggcacccgccaccacgcccggctaattttatatttttagtagagatggggtttcaccatattggccaggctggtcttgaactcctgaccttgtgatccactcgcctcagccttccaaagtgctgggattacaggtgtgagccatacgcccggcccatccattcatctatctatcatccacctgcccacccacccatccatccatctactcatccatccatccatccatccatccacccatcccatccatccatccactcatccacccgtctactcatctatccattcatctacccatccatccattcattcatccatccatttatctgtttaactatccatccatccatccatccatccatccatccatccatccatccatccatccagcaatgacaaggtctgccaggccctgttcttggtgctggggacagtgggaatagcacacacacacaaaaacccctgttgttgaggagcctgcattctagtgggggaggctgacagtgaagaaataagacaatgtataagtcatcaggaggtggtatgtactgctctggagaaaacaaagtggaacagggtatgaggggggcactttgacgaggagggctagtggtaaggtgacattgcagcagagacctggggaaaattaaggaatgaatcatgtggatctggggaaatggtgttccagacagtggttactgccagtgcaaaggccctgaggtaggagccagtcagtgcctgtatgttcagggcagtgactggcccagctggtgggaatggtgcaggaggtcaggttggatgaatctccaagcggctggtccccttgagatctgaggcccagggagagaatgataccatcatgagaagccacagctatactgagacacccaactctcaattatgaattttgttttttttaaatgagacagagccttgctgtctcccaggatggagtgcagtggcatggtcccaactcactgcagcctccacctcccaggttcaagcaattctcctgcagcagcctcctgagtatctgggattacaggcgcctgccaccacgcctggctaatttctgttgcccaggctggagtacagtggcatgatcttggctcactgcaacctcctcctcccgggttcaagcgattctcctgtctcagcctcctgagtagctggggctacagatgcgtgccaccatgcctggctaatttctgtatttttagtagagacagggtttcagcatgttggccaggctggtctcgaactcctgaccttaagtgacccacatgcctcggcctcccaaagtgttaggattgcaggcgttaagccaccacgcccagacaccactgtgctcttgaagtccaaaatctgggctgcggagatggaacttgaaggccaagagactggagaggaaagaacagatggttggaaagatccaccaggacatgggagctggttagacctaggatgtgggcagctgctggggccaagatgatgttaagttccccagccccagtgaatagtggggagagggtgggacagttagagtagggggtggactggggagtgggttgggtggtggctttggagagccacacctgggttcaaattctggtaccaccacttcctggtttcacctctctgagcttcagtttctccatctgtgaaacatagataaaaatggcaccttttaaggctgggcggtggctcacgcctgtggtcccagctacccgagaggctaagtggggaggatcacttaagcctgggctgcagtgagctgtgatggcaccactgcattccagcctgggcaacagagagagactttgtctcaaaaaacaaaacaaaacaaaacaaaacccaattttgcctgggtgtggtggctcgtgcctgtaatcccagcactttgggaggctgaggtgggagaattgcttgagttcaggaattcaaagcctggtaacatagtgagaccccgtctctactttttttttttttttcttaagagacagagttttgctctgtcagccaggctggagtgcagtggtatgatcacagctcactgcagcctcgaactcctgtactcaagcagtcctcctgcctcagcctcccgagtagctgggactacaggtgtgcaccggcatacctgggtgatttttttgtttgtctgtctgttttctgagacagggtctcaatctgtcacccaagctggagtatagtggtatgatcacagctcactgcagcctcgaactcctgtgctcaagcagtcctcctgcctcagcctcctgagtagctgggactacaggtgtgcaccagcaatacctggctaattttttattttttgtagagatggggttttgctatgatgcccaggctggtcttgaactcctggcctcaagcaattcctcccgccttggctttccaaagtgctgggattacaggcatgagccactgcacccggccagaatagaggttcttatctccatcctcccataacaggaaagatgacacatgccacccactgctctatgcttgctttcctcactaatcaccttggcagtctttccaagtcagtctgtagagattataattattctttataacatgactgcgtattccatttatttcaagaaagacttacattttgctcgccctgtgctagacattagtctaaaccagggaggggcctggctggatgcagtggttcaggcctgtaatcccagcactttgggaggccgaggcgggaggattgcttgggtacaggagttagaggccagcctgggcaacagagtgtgacctcgtctctataaaaatgaaaaataaaactaaaataaagctgggggctgggtgcggtggctcatgcctataatcctagcactttggcttacaggtgtgagccaccgtgcctggcccaattatagcttctaaaaaataataaaaggccgggcacggtgactcacacctgtaattccagcactttgggaggccgaggcgggcggatcacaaggtcaggagatcgagaccatcctggctaacacggtgaaaccccgtctctactaaaaatacaaaaaattagccgggcgtggttgcgggcgcctgtagtcccagctactcgggaggctgaagcaggagaatggcatgaacctgggaggcggagcttgcagtgagccgagatcaggccactgcactccagcctgggcgacagagcaagactctgtcttaaaataataataataataataataataataataataataataataataacctcatccatgaatcattttccagctcctctgctgtgtgatcttgggcacattagtaaacctctctgtttcctggtttctcatctgtaaaatgaggatgctaaatccctatttacagcatcattgtgggggataagtgtattattataaagaacctagaaaagtgtttagctgcatatgcagttgtgtgttgcttaataaaaggaatctgttctgagaaatgcgtagttagatgatttcacagttgtgtgaacatcagagtacatttacataaacctagagggtacagcatactgcacacctgggctatatggtataacctattgctcctagctacaaacccgtacagcatgggactgcactgaatacttaccattgcattaaaagattgccttctccttttctttcttttttcttttttttttttttttgggacggagtctcactctattcctcaggctggagtgcaatgacgtgatctcagctcactggaacctccacctcctgggttcaagagattctcctgcctcagcctcccgagtagctgggattacaggcacgtgccaccacatccggctaatttttttgtatttttagtagagacagggtttcaccatgttgaccaggctggtcttgaactcctgacctcagatgatctgcccgcctcagcctcccaaagtgctgggattacacgtgatagccaccatgcccaggcgatttcttatcatttataccatattttatacaaagatttcttatctttcttttgagacagagtctcactctgtcacccaggctggagtgcattggcacgatctctgctcactgcaacctccacttcttgggttcaagtgatcctcctgcctcagcctcctgagcagctgggactacagatgcacaccaccaagcccaccattttttaaagtagagatgggggtctcaccatgttgcccaggctggtctcaaactcctggcctcaagagaccctcccacctcggcctcccaaagtgctgggatgataatcgtgaatcatcgtgctccacccagtcctcgtgtttttatttttcaaattttaagacgttttattttgtcaaccgaagtgctagccaatctttgtgtttttgatagatattgccaaattgttatccgtctgggattgtttccatatgaattatttcaattataccaccacatgccagaggactggcttctctgccgcctccccgacagacggttctgttgccaagattctggagttttgccagctggatgggaaatcagtggagctcattaaggctcagtttacattttctcttattctgagtgaagctgagcctctttccttatgtttaagagctatttatattttcttcctgtgatacaatctctgttcatatcacttgcttactattgttgcactttctagaactactgaccttttctcttactgattttttttttttttttgaggctgagtctttctctgttgtacaggctgcagtgtagtggcgcaatctcagctcactgcaacctccgcctcccaggttcaagtgattctcgtgcctcagcctcacaagtagctgagattacaggtgtgcgccaagatgcccagctaatttttgtatttttagtagagacagggtttcgccatgttggcctggccggtctcaaactcctgacctcgagtgatccacccgtcttggcctcccaaagtgctgggattacaggcatctcttactgatttttaggagctctttatatataggttgacttaaattgcaagtcaggtatttgctagctttgtggtcttggagaaaaaaataattacttaacctattggatccctgattgtcttatctataaaacaggaaatctataaaatgagaatgttggccgtgcacatggctcactcttgtaatcccagcacttcgggaggctgaggtgggggatcacctgaggtcaggagttcaagaccagcctgtccaacatggcgaaagcccaactctactacaaatacaataattagccgggtgtgctggtgggcacctgtaatcccagctactcaggagactgaggcagaagaatcccttgaacccaggaggcggaggttgtagtgagccaagattgcaccactgcactccagcctaggcaacagagtgagactccatctaaaataaataaataaataaataaataaaaataaaaataaaataaaataaaatggaaatgttgacagtacctttatttcagagttgtgtaaggattaaacatgataaggtaaatgaaattcccagcatggcaattaacatatagtgagtgctaaatgaacgagagtcattatttttgttaatttaattccattgagtcccagctgcctgtaggcaatggtatataagtcagggtacgtatgttaactgctgtaacaaattgcatcattttgccaggcacaatggctcacgcctataatcccaacactttgggaagccaaggcaaggctaatcgcttgaggccaggagtttgagactagcttgggcaacatacaagatccccatctctacaaaatatatatatatattagcagagcatggtggtgtgtgcctatggtcccggctacctaggacgctgaggcaggaggatcacttgagcccaggaattggaggctgcagtgagctatagatcgcgccgctgcagtccagcccgggtgacagagtgagatcctgtctcggaagaaaaaaaaaaaaggccaggtgcagtggctcacgcctgtaatcccagcaccttgggaggccaaggcaggtggatcatgaggtcaggagtttgaaaccagcctgaccaatatggggaaatccggtttctactaaaaatacataaattagccaggcgtggtggtgtatgcctgtagtcccagctactcaggaggctgaggcaggagaatggcttgaacctgggaggtggaggctacagtgagctgagatcatgccactgcactccagcctggtgacagagcgagactccgtctcaaaaaaaacaaaaacaaaaacaaacaaaaccaaaccctcaaaacacaaaaccaaattacatgacttcagtgatagtgagactttacttcttattgatgtcacaattcagtttgggtcaatgtcaggggttgggggaggagggctctatgttatagagtctctctagggccgaggctccatcatctcatggtcttagcttcccgaaggcccttggagtcttttctactggggaaagagcgctatgaaagaatttcccaggccaggcctggaagtggcgccatcacctccatcctttttttttttttttttttttgagacggagttttgcccttttcctccaggctggagtgcaatggcgcgatctctgttcagtgcatcacggcaacctccgcctcccaggttcaagtgattctcctgcctcagcctcccaagtagctgggattacaggcatgcaccatcacacctggctaattttgtaggggtttctccatgttagtcagggtggtctcgaactcctgacctcgggtgatccactcgcctcggcctcccaaagtgctgggattacaggcgtgagccaccatgccctgcctccattcttgttattggccagaacttggtcacatggctccatttaactacgagggagactaggaatgtggttaaactggagctggggataaaaaggagataggttggttggacgcaaagaagtcactgccgtagaacctcagggtaatgcctcactggctccagaaatgcaggtatggagcgggtttcaggaatgcaggtctagggccaggcatggtggctcatgcctgtaatctcagcactttgagaggccgagacaggaggattgcttgaggctaggaattcgagaccagcctgggcaacataccaaggtcccgtctctacaaaaaataaaaaaataagcccggcatggtggtgcacgcctatagtctcagctactcaggaagttgaggcaggaggatcgcttgagcccaggagtttgatgctgcagtgagctatgattgtgctaccactgtactccagactggacaaaagagtaagaccctgtctctaaatatatctatgcaggtctgtggaaatctcaatgggatgtagaataagaaggacctgagccaaggccatgggggaggaattcagctggggatgagggagctgggtgatagcaacttcagcaaaatgggttgggctgattggaaaacctcctcttaccttgcctgctagggccaacaggaggggcatctaggagggtcagcacttggcaccatccctttccattccattctgttccttttttttttttttttttgagacagagtttcactctctctcccaggctggagtgcagtggcacaatcttggctcacggcagcctccgcctcccgggttcaagcgattctcctgcctcagcctcctgagtagctgggattacaggcaagtgccaccacacctagctgatttttgtatttttagtagagacggggtttcaccatgttggccaagctggtctccaactcctggcctcaagtgatctacccgcctcggcctcccaaagtgctgggattacagacgtgagccaccatgcccagcctccattctattctattcactgacctcctctcttggtccagtgctgggaaatgtcacctttcaggactttcacagagatgctagaaatctctgtcccttccctactcacagcccttccctggttccccactgcccttggtgaaaaagacaaaatcctcactgtagcccacaagggcttatgcatttggcctctgtccatctctcagcccttccctgctccctctctacccattgctctctgcaccgcagccaaatcggccacccagcacaatccagcctcagggcctttgcactggctcttccttcttcagggatttctcttccctcaggtatacacggtgagtgttctcttatctccttcaggtttctctttctctctctctctgtcttttttcggagaagggggtcttgctctattgcccaggctggagtgcagtggtgttatcatagctcactgcagcctccaacttctgggctcaagtgatcctctcgcctctgcctcccaaagtgctcggatacagacatgagccacttcacctttttcttttttctttgttttaacggggtctctgtctattgtccaggctggagtgcagtgacatgatctcagctcactgcaacctctgcctcttggattcaagtgattctcctgcctcagcctcccaagtagctgggattacaggcatgtgccaccatgcctggctaatttctgtatttttagtagagacggagtttcaccatgttggccaggctggtctcaaactcctgacttcaggtgatctgcccgcctcagcctttcaaagtgctgggattactgatgtgagccactgcacatggtcagtggccaggtttctttctttctttctttcttttttttttttttttgagatagagtcttgctctatcgcccaggctggagtgcagtggcacgatctcagctcaccgcaacctctgcctcctgggcccaaatgattctcctgcctcagccttccgagtagccaggattatagggacgcaccaccacacccagctaatttttgtatttttagtagagatggggtttcaccatgttggccagctggtcttgaactcatgacttcaagtgatccgcccgtctcggcctcccaaagtgctgggattacaggtaatgagccaccgcgcccagcccagatttcttatctgagagatcttccactgtttctagatataaaatcatagatttcgccctcccaacttcccattctctttcatgttttatttttctccatagcacttagtgctctctgacctgtcatagtttttacttatttgcttattacctgttttccacactcaaatgtcaaggcaaggatttttgtctattttacgtcccccagtgctttagaacaccacctggcacatagtacggaatcaattaatttattcatttatcatatgaatatatgattctaattgcttcattcattcgcttaacacaggggctggcaaatgataactcatgggcccaagctgcctcgtgttttaaaaattatcttagcttgtatctgtagtcccagctacccgggaggctgagatgggaggatcgcttgagcccaggagtttgaggctgcagtgaactatgatcctgccactgcactccagcctgggcaacacagcaagcccgtccctgtaaaataaattaatttaaaaaattaaaaatgaaaattatggctgggtgcagtggctcacgcctgtaatcttaagacattgggaggctgaggcaggaggatcacttgagcccaaaagtttgagatcagcctgggcatcctggcaaaaccccatctctataaaaaatataaaaattacctgggtgtgatggtgtgcgcctatagtcccagctactcaagaggctgaggtggaaggatcacttcagcctgggagatggaggttgcagtgaaccacgattgcaccactgcactctagcctgagcaacagagacagggtctcaaaacaaaatgaaacaaaacaaaataaaaattattttatttatttacttttcttggtattgatttgacgtttactatttttatattttattattattatttttggtattccgcatattcagaaaaacttctctagtaacaatctatataaaaatgatccctgaaagtagagtcttactgccttattttgaaaataaaatttaaccaatacacggtcaggcccatttgttgacacgctgtctatttttttttttttttgagatggagtcttgctctgtcatccaggctggagtgcagtggccttcaggtctggctggatccaggggctcaggcaatatctcaggacacctcctccccacccttggtctttccatctctctctctctattttttgtttgtttgcttttttgtgttttgagacagggtctcactctgtcaccaaggctggagtgcagtggtgcgatcttggctcactgcaacctccatctcttggcctccagtgatcttcccacctcagcctcctgagtagttgggactacaggtgcacaccacaatgccaggctaatttttgtatttttagtagagatggggtttcaccaagttggcaaggctggtcttgaactcctgacctcaagcaatcttccccgccttggcctccaaaaatgctgggattgcaggcgtgagtcaccgcacccagccctccatctcttaactctgctttcttgtgggtgttttcctccatcctcaatcattcttttccctcatggaggcagatgagggtgaccaactactccagatttatttatttatttatttatttatttatttatttatttaaagtctaagttttgctctgtcacacaggctggagtgcaatggcatagtcatagctccctgcagcctcaaacttctgggctcaggagattctcctacctcagcttcccaagtagttgggactaataggtgtgcgtcaccatgcccaactgtttttttaatgttttaaaaacattaaaacacagccagacatggtggctcacacctgtaatcccagcactttgggaggccgaggcaggtggatcacgaggtcaggagatcgagaccatcctggctaacacggtgaaaccccgtctctactaaaaaatacaaaaaattagccgggtgtggtgacgggcacctgtagtcccagctacttgggaggctgaggcaggagaatggcgtgaacctgggaggtggagctggcagtgagccgagatcccgccactgcactccagcctgggtgacagagcaagactccgtctcaaaaacaaacaaacaaacaaaaaaacattaaaacattcaatggagatggacctcactgtgttgctcaggctgatatggaacttctggcctcaaatgatccttctgcctcagcctcccaaagctcttagattacaggaatgagccaccacatccagcctgctctaaatttatattctcatcactctgagttcgatggaaaataggggggttggctttctggtcactgaagccaaggtcctagcattatccttcgttgaacatgattctttttattttattattattattattattattattattattattattttgagactgagtcttgctctgttgcccaggctggagtgcagtggcacaatctcggctcagtgcaacctccacctcctgggttcaagtaattcttgtgcctcagcctccctagtagctgggattacagacaggtaggtgccaccacacctggctaatttttgtatttttagtagagacggggtttcaccagattggccaggctggtcttgaatgacctcacgtgatctgcccacctcggcctccccaagtgctgggattacaggtgtgagccactgcacctggctgtttgaacatgattctttttttgtggaggtgggaggtggctggtcacatgtctatttctgaaccggctgctgtggccaggagaataccatgctctgatgggccaggccagggtcatgtgcctattccttgagttgaggttggggtggcttccacagaggaaactgaggaactgttacctcagaagggtaaataagatgtcaggaggcaatcagtgtttatatgggcagtgacttctaaatttaagccagaatttctgattctcagtcctgttgacatgtggggccggatcattttctgtcctgggagctgccctgtgtattctaaaatgcttagcagtatgcttggactctatccatttcacacaagtagcacctctcctcagtatctccagacattgccaaatgtcccctgggaggcagaatcgccctgggggcgggcaaaccagttttggagggagtgagcttgctgtcttggggaaaatccaaagagatctgatgattactggctgagaacagcaaagaagagattgagggcttctttgaattagaatatttattttaatttctttctttctctctcctttcttcttttttttttttgacagagtctcactctgtcgcccaggctggagtgcagtggcgcgatctcgtctcactgcaagctccacctcccaggttcacgccattctcctgcctcagcctcccgagtagctgggactataggtgcccaccaccatgcccagctaattttttatattttcgtagagatggggtttcaccgtgttagccaggatggtctcaatttcctgacttcatgatccacctgccttggcctcccaaagtgctgggatttcaggcatgagccaccgcacccggctctttcctttcttttctgttctgctttcttttcttttctttccctccttccttccttccttcctttctgatggagtctctctctgtcactcagactggactacagtggtgtgatcttggctcactgcaacctccgcatcatgggttcgagtgattctcctgccttggcctccagagtggctgggtttataggcatgtgccaccatatccggctaatttttgtattttttagtagagaaggggttttgccatcttggccaggctggtctggaactcctgacctcaagtgacctgcctgccttggcctcccaaagtgctggattacaggcatgagccactgcacctggccttattttttatttaatgatggggagaggccagacgtggtggctcatgcctgtaatctcagcaccttgggatgctgaggcgggtggatctccaacatggtgaaaccccatctctactaaaaatacaaaaaaattagccggccatggtggcaggcgcctgtaatcccagctactcgagaggctgaggcagaagaatcacttaagcccaggaggtggaggttgcagtgagctgagatcgtgcaagtgcactccagcctgggtgagagagtgagactctgtctcaaaaataaaataaaataaaataaatgctggggagaggaagaggggaggaagactcatttgatgttattttatcatcagtgataagggctacactgattgctggggttacagcacaggacataatggacacagttaatacttttctgagttcatgccctcttgagggagggggtggtgtttttgttccttgtggcttttgtaacaaagaaccacggatcggatgtcttagaacaaaggacatttattctctcataatcctagaggccagaggtctgaactcaaggtgtctgcagagctgtgctccctctgggggctccaaaggagaatctttctctgcctattcctgcttctgggggctccagatgatccaggacaggcgagcccctagattggggcttagccctggagggttcttggcttcacccaggaaagaattcaagggcaagctggtggtgttagcaagttttattgaagcaaccatgcagagcagcagcagaggtactgttccttgcagagcagggctaccccattggcagtgagcccagagtagcagctcagaggcagtgctgcaggcatatttatcccgttttaattatatgcaaatcaaggggtggattatgcagagatttctagaaataaagtggtaacttctgagttgtcaggtctttgccatggaagggggcatcagcttctgggtgttgccatggcaatggtaaactgacatagcactggtggccatgttttatggagaggcacttttgcctcttccctgtttcagctagtcctcaatctggtccagtgtctgagccccacctccagagtcgagtcctgcctcctatttcacatgcatccttggattgtgactccatctttacatggttttctcctatgtctgtctgtgtgtctcttacaaggacacttgttattggatttagggcccacctggatgatcccagatggcctgggtgggtcttaaatatctcctcatcttgaagtccttgagatacctcctcatcttgaagtccttgagttatctcctcatcttgaggtccttgagatatctcctcatctcgaggtcctcaagctatctcttcatcttgaggtccttgagatacctcctcatcttaaggtccttgagttatttcctcatctcgaggtccttgagataactcctcattttgaggtccttgagatacttcctcatcttgaggtccttgagctagctcctcatctcgaggtccttgagctatctcatctcaaggtccttgagctagctccttatcctggggtccttgagctacctcctcgtctcaaggtccttgagatatctcctcattttgaggtccttgagctatgtcctcatctcaaggtccctgagacatcgccccatctcaagatccttaccttacatcttacaaagtcgttttctccaaaaaatgttcacaggtcaccttcacagcttccagggatttgacctggatacatctttagagggggccagacccattccagacagtaaacaaatagacaaaacgctggcacattgtaataaatgtcacagatgaaacaaacccagggatcaaggggaagaagaagaggagggcatgctttctggagggtggtcaaggaaagctgagagctgcaggaggaggagccagctctgggaagcatgaggcagagagggcaaagactgtgcaaatgccctaaggtgagaagaatcagaatgaaggagcttctggaaggaagggagtgagtggagggagagtggtaaagaatgaggtttgggaggaaggtacttacctagaatggctatggggatgtgtgtggaacttaagggggggatgggaaatccttggagcatttaagcagatcaattgtttaaagaggtccctgaccaggtgtggtggctcatgcctgcaatcccagtgttttgggaggttgaggcaggaagatcacttgaggccaagggtttgaaaccatcctgggcaacatagtgagatcccacctctacaaaaaacaaaaaaagaagagagatctggaaaaagaaggttgatgaaggcatccccatgagaagtgatggtggcctcgactgggagttgggagtcatggatccagctcacattttcattgaggaggaagggtggaggtggatgaaaagaggaggcaggtctcatattccaggaaggcaagaattaaaaaaaaaaaggaatgaaatgaaatgaaaagaggaggcagggtggtgtctaggtttacagcttagggacttgcgtgaattagggtatcttctactgtagtaggaagactaggggaggaacaggtcttggggagtttgatcaagcaagggaaggaaggcagtacagcataatggctagcacatggttcttttttctgttttgttttgttttgtttgtttttgtagagacagggtctcactatgttgcccaggctgctcttgacatcctgggctcaggtgatcctcccatcccagcctcagtgctgggattacagggcatgagctaccatgcatgtccggtgcatggttcttaactaaggggtggtgtggggcagcagtgggggcgaggggagtgactctgtcctcccaggggacatttggcaatgcctggagacagtttcagttatcactactggagggcttggtgtgttattgatatctattggatagaggccagagatgcttctgagtgtcttccaatgcccaggacaggcccctctcccaccaaatgtcaacagcgctgagaccgagggactcagtgctaggcacatggactccagttgtgtggggggtccaggttccagtcacagctgtgggatcttgggcaagttatcaaatgcttcaagaaaggaccatatatatggccgggcgcggtggctcacacctgtaatcccagcactttgggaggccgaggcaggtggatcacaaggtcaggagatcaagaccatcctggctaacacggtgaaacctcatctctactaaaaatacaaaaaattagccaggcatggtggcgggtgcctgtagtcccagctactccggaggctgaggcaggagaatggtgcgaacctgggaggcggagcttgcagtgagccgagatcgcgccactgcactccagcctgggtgacagagcgagactccatctcaaaaagaaagaaagaaagaaagaaaggaccatatatcaaaaatgaccccaaaagcagagggagccaagacaccaaagaatgcagcagacaaatcctgtttgttggtaaagggtgatttgttgggggagcttatggagagaagaaacatggtcttgggcggcggcaagacaggtacctctctgcaccattacctcacagacccagtgcttatatagtacaggaaaatgtgcaggacccagtgcttatatagtacaggaaaaggcagtcctccagaacaggcaaaaacaccgtgcacatcacagcctataatttgtatgataacatcaagtttgctttgatatgttcttacactagggacagcaaataatgtagaactcaggagacattcccgggagtggggttaatcagaagtcaacatggcaattagcatccaagatggggccactttgtcttcacacagaacctctctgtgactcagtttccctatctttcaaatggagataaaactagtccctaccttataggattgttgtaagaattaaaaatgaggtaataattgtaaagtcgtaaagtgcttcaagcagtatccattaaatgattgataaataaatcattggtaaatgatttaccagtgatactgataaatgacttctttatcatttatgaaaaattgataaatgatttatttaccaataaaccaacggtaaatgatttatttaccaataaaccaacggtaaatgatttatttaccaataaaccaacggtaaatgatttatttaccaataaatcaacggtaaatgatttatttaccaagggtaaatgtcactcattgataaatgacttattggtaataaatcaattattagtttattggtttattggtaataaatcatttatcaatgagtgaaatcatttgggacaaagaagagagagggaaaagaggtggtctgagggttgggccttaggttgtaacagcatagaaacattggggagaggagaatacagtgactgaagaggaaaaccaggccaggcgtggtggcccatgcctgtaatttcagcattctgggaggctgaggcaggaggattgcttgagcccaggagtttgaggctgcagtgagctatgattgcatcactgcgctcaggcctgggcgacacaatgagattctgtctcaaaacaaaacaaaaaaacaaagaggataaccagatgggtgtggtgtcaagagaccaatgccgttgagaggagtagattcagaaagtgtcatgaatagcaacaaaagcaataggtcactttaatgagcacccactatgttcaggtgttgttctaggtactttatacttattaacacttttgaattttcacaacaaatccatggtgttggcaccatcatatatttaggttattagttattgctgtgaaacaaaccactccaaactgagtgatgtaagaaaaacatgatttttgattctcacagattctatgactcaggaattcagacagggcatagtgatgatggtgcctcagctccatggtgagaaactttgactttctgggaactagaatgctctggaggattcttcgtcacatgatgggtgtctgggctgggatgacttgaggctatgctcagttggggctattgactggagcacttacgtgtggtatctccaagtggcttgggcttccccacaacatggcgaccgggtttcaagaaacccggagagagagcaagtattcctcaaaaagatcaagccagaagctgcaaggcgtcttctaacctacttggaaatcacgcagtgtcacttacagcagttttcgtaacaagaagccataccctggcttctctcttcctaccctaggcaccagcagggacctccaattggctgaacctatctaggagcagggtgcaaaggagcctgggaaatgtagttgtcttcctggcagcgcaaaacaaaggaaggggatgagtcattaaccaatcaggttaatgacctacatgaaccttgagcaaatgaccctccttctctgaactctgtgtatcgctcgcgaaataggagccctacttcattgcaggatcgttttgaagaccagaggagacagttgtaatgcacacgaattgcttcacccagggcgtagttcttttatttatttatttatttatttattgaattaattttatttataactctaatgggtaagcagcctggttctcaattgatgggagctgtcaatattgctattggtctgagaactgatgatacgtaacggtttactatgtcctggcacagggtggcacgtcttagctctactggtcctgctggttttggggtttagtccactctttttgcttgtttgtttgtttgtttgttttttgagatggagtctcactctgtcgcccaggctggagtgcagtggtgcgatctcagctcactgcaacctccgcctcctgggttcaagtgattctcctgtctcagcctcccgagcagctgggactacaggcgcgtgccaccgcgcccagctaatttttgttatttttagtagagacagggtttcaccatattggccaggctggtctcaaactcctgacctcgtgatccgcccgtctcagcctcccaaagtgctgggattccaggggtgagccaccgcacccggctagtccactctgagatcaagcctagatatcctttcttgtgaccgtctctgccatgagctaccaggacatgacgaatctgccttccttcttgctgcctgttagagatataccctggtgatctaatcacctcttaaaggtcccgcttctcaacaccattgcattggggattatacgttcccaacatgtgcacattcaaaccatagcagcgtttaagcactccaaggatatgggtctactgccttcagcctgacttgctattgagtgtgtactcgagagagaggtgggagaaatacttcaaaggcttcaaaatcatttatttgtccttctttatagggaccccgggagatatggcagaatatggggtgcttggggtgacagccacttgctgcattttgattacatggccacggtttgggcatatcggcacctgagaccacccttggttcactcccttcctccctccccctcgcttactctgctccaggcacacagatctcctggctccaacatgccagggcctcagggcctttgcactggctgttccctctgcctgaaatgcttttttctcagagcctttgcactaacctcagggcttcttgtactaacctcactggctattccctctgcctgaaatgcttttcctccagacacccacctggattgtcccctcacctccttcaaacctttactgaaatgccactctctcaatgaggcttcctggacttccctatttaaaattgcaccccctcctgacattctccattccttttcctacttatttttttctcgcttaacacttaccaccttcagacaagctatgtaatatactcctacaataccttcattgtcttcctttgccagaatatcagccccttgagggcagagatgcttatctctttggttcatagctgtatctccagcacctagaccagtactgggtgtatagtaggtgctcaataaatatttgcatatttggccaggcacggtggctcacatctgtaattccagcactttgggaggccgagacgggtggatcacttgaggtcaggagaccagcccagccaacgtgacaaaaccctgtctccactaaaaatacaaaaattagccaggcatggtggcaggtgcctataatcccagctgctcaggaggctgaggcaggagaatcacttgaactcaagaggcggagattgctgtgagccgagattgcagcactgcactccagactgggtgacagagtgagactcagtatcaaaaaaaaaaaaaaaaaaattgcatagtgaatgaaggagtgtctgaatgatcaaagccctctcacctgctactccctttgcttggagcctttttacccccttcacactctaaagtaagaatagtttgaattacaaagaatacaaatttatctctcattcactatgttttatcaagagtaggagcaaaatggccgggcacagtggctcatgcctgtaatcccagcattttgggaggccaaggcgggcggatcatctgaggttgggagttcgagactcagcctcaccagtatagtaaaacccagtctctactaaaactgcaaaattagctgggcgtggtgacgcatgcctgtaatcccagctactcaggaggctgaggcaggagaattgtttgaaccccgggggcagaggttgttgtgagccgagatcgtgccattgcactccagcctgggcaacaagagtgaaagatcgcgccattgcactccagcctgggcaacaagagtgaaactccgtctaaaaaaaaaaaaaaaaaaagagtaggagcaaaaatatgactaagactgtattttgcattattgaccaatgatggtttacattatttccttattttccaccccatcctcccccacccactccctaagctgatagtcatcctatgcacctagttttaggggaaagacacagcagggcagccagtatcctgctgacttaaaaaaaaaaaaaccagctatattgacatacagtaaattacatatttaaaatacattggtggggcgcggtggctcacgctgtaatcccagcactttgggaggccgaggtgggcaaatcacttgaggccaggagttcaagaccagcctagccaacatggtgagaccctgtctgtactaaaaatacagaaattagccaggcatggtggcacgcacctataatcccagctactcaggaggtggaggcaggagaatcgcttgaacctgggaggcggaggttgcagtgagcggagatcgcatcattgcactccagcctgggcaacagagtgagactctgtctcaaaaaaaaatatatgatttggtaaacaattttttctttaatttctagatttgttttcagaaacggtcttggcagggcatggtgcctgaagcctgtaatctcgcccctttgggaagctggtgtgggaggattgcttgagtttaggagatcgagatcagcctgggcaacatggtgagaccagcctcatctctaataaataataaataaataaataaataaataaaataattagctggtcatagtggcatgtgcctgtagtcccagctacttgggaggctgagatgggaggatcatttgaacccaggaagtcgaggctgcagtgagccaggattgcaccactgcactccagtctgggtgacagagtgagaccctgtttctccccttcccccccccacccaaaagaagggggaaaaaagaaagaatcagggtctccctatgttgcccagactggccttgaactcctggactcaagcgatcctcctaccctagcctcctgagtagctgggattacaggtgtgtgccactgaacctggcctgatttgataaattttgacatatgtgtgcaactatgaacccagccttgaaatcaatggatcatatccattgcccctcaaagtttcctccatcccacccctccctgcctccccctcctcccacctctcattccctcgtacctcctgatttgctgttagtcactgtcgattagtttgtatttcctggagttttatgtaagtggaatggtaccatctgtggtcttctgtgactggctgctttccctgagcatgatgtcctggttcatccatgttgttgtatgtatcagtgtaccattctgttgtacggatgcaccccagtttgtttatccattcatcccttgatggaggtttttttgtttgtttcgctttgtttttttgagatggagtctcgctctgtcgcccaggctggagtgcagtggcgcaatctcggctcactgcaacctccgcctcccaggttcaagcgattcttctgcctcagcctctcgaacagctgggactacaggtgtgcgccaccacgcctggctaatttttttgtatttttagtaaagacagggtttcaccatgttgaccaggctggtctcgaactcctgacctcataatctgcccacctcggcctcccaaagtgctgggattacaggcgtgagccaccatgcccggcctatactttaagttctgggatacatgtgcagaacgtgcaggtttgttacataggtatacacgtgccatggtggtttgctgcatccatcaacccatcatctacattaggtatttctccgaatgctatccctctcctaacccccagcccccgacaggccccagtgtgtgatgttccccttggttgaggtttgaattactgatggcacttttggctatcatgaatcaagttgctagctggatatggtggcacatgcctgtagtcctaactctttggaaggctgaggcaggaggattgcttgagcccaggaatttgagactgcagtgagctgtgattgggccaggctgcactccagcctgggtgacagactgagactgtctcaaaaaaaaaaaaaaaaaaaaaaggaaagaaaagaaaacagaatcaagctgctatgaacattctgtacaagtctttgtatggacatgtgctttcatttctcttgagtaaatgcctggtaatggaatatatcgtatgataggtgcatgcttaatgttttaagaaaacttaccaggccagtcacggcggctcatgcctgtcattccagcactttggggaactgaggcgggaggattgctggagcctaggagtttgagaccaacctgaccgacatagtgaggctctgtttcttaatttttttttttaataagaagaaaatgtaccaacttttcttcctttgtgctggaattgcaaggtaaaaaaataatagtaataacaaggaaaacgtaccaacttttccaaagtggatctgccatgtgatgttcctgccagctgctcagcatgcttctcttctttgcttcactatctgtctcattttttttttttgagatggggtcttgctctgttgcccaggctggagtgcagtggcatgatctcggctcactgcaacctctgcctcctgggttcaagcgattctccttcctctgctttccaagtagctgggactacaggcgtgttccaccacacccagctaattttgtatttttagcagagacaggtttcactatatgttggccaggcgcgtctcaaactcctgacctcaagtgatcaacccacctcagcgtcccaaagtgctgggattacaggcatgagccaccacacccagcttcttttttttgttttgttttgttttttgtttttttgagacatcctcggtctgttgcccaggctgtgcagtggcgtgatctcggctcactgccacctccgcctcctgggttcaagcgattctcctgcctcagcctccagagtagctgggattacaggcgcctgtcaccacgcctggcaaatttttgtgtgtgtgtgtgtgtgcagtcggggtttcaccatgttgcccaggctggtcttgaacccctgacctcaagtgatccgcccgcctcagcctcccaaagtgctgggattacaggcgtgagccaccgcacccagccgctcaccatctctttgtcgcctgcatggcaccattctctcctgtaccaccccaaagccttaccaggtgcctcctgcatttaaccaggtcccatagctctctgtgcttcccggcacaccctctcaccaccctcatcatcaattattcaccttgctgactgcttagtgtttgtctcctggctggattacataagccctgtaagggcagagctctgtttgtcttgatcaccattaggttctggtgcttggcatacagtaggcattccacacatgcttgctgaattaatgcatgaccgggtctggggtgctgggtttcacaccaggctctaccgcaaacattgggtcaagtattttcattcccgacgtacagatgagtcaattgaatcaacggaaagcaaaatgatcccatccaagctccctcaacttgccgggctggtctgggagtcgaaccagatctgcctgaccctcccaccggtgctgaaaagtggagtgtgtgctggggtggtaggggatggggcagaagagagacgggcttcctcacagaagggtttgagggctaggatgaggcgtgcacactctgcacccctgcttcggagctttgaaagggtgcacagcacacccgccctctctgggaaccctcgggagcttgaggttgcctgatgaaggggctgatgggttgaacgcaaagggcccctccacccacccttttttctatctccccaaccaagccctggtaacaggcatttccggtttccggccggctccctggtgctggggtgggggtggggagttgattgctgccgtcgtgcttggctctgggtccccttctcccagaccccagaggcctctgtccctgcacactgcttccccgaaggagcgtggaaagccagccgacctttctggctctttcttcatcttgggcaggggttttgttgatgggaggctggctggcaaatggggaagaatgaacctcagggttcaccgcagtgcgcctgggtgctgatttgcatatgggcacgatgccagcacagtgggtgcccgcctcttcctggaggaaggaagaggggcactgaggggggttgcccccagcagggaggaaccgtcctcataatgcctctcctacgtttgtttaaaggaccatcattctcagcaaactatagcaaggacaaaaaaccaaacaccgcatgttctcacttataggtgggaattgaacaatgagaacacatgggcacaggaaggggaacatcacacacaggggactgttgtggggtcggggaagtggggagggataacattaggagatatacctaatgctaaatgaggagttaatgggtgcagcacaccaacatgacacatgtatacatatgtaacaaacctgcacgttgtgcacatgtaccctaaaatttaaagtataataataataaaattaaaaaaaataaaggacctcctgtcctttgccactttctcacactcttcaggcgaccaggaagtcctttctggtggtctaactgcagtcactgctgctgtctgatggagcccctttctttagctggccccaccgcagcccggagaggggatgaatcatgccccctttcccctctttgaggcatcacatgactggaaggaagctgtctccgggttcagctgatctccctgaggtcaggagggaacttcctccctcgagccacagacacagccatctgctctattgtctctggtgatctgcctgcccatgagcgccctcattatgccactctctaagaggcaccaggagcagcttagtgtggttcaaagaggcagtgttgtacagaggttagaggcacagactttgggatccagtgctggtatctggttctccattcctatctgtgtggtccgggatgggcagtatcccctctctgagcctcagttgtttcctctgtcaaagggagatttattcattcgacagattttattgagcatctactatgtgtcagacatggtactaggtattgaggtcctctatttacccaaaggagttgaacatttatgtccacacaaaaacttacactcaagtctttgtagcggctttattcatgattgctgaaactgggaggcaacaaattgtccttcggtagatgaatgcgatgtagggcaaggcaagccctaaattggggctcagcctgggacggttctttgttttgcccaggaaagaattccagggcgagctggaggtgttagacagtagcttttactgaagtgaaagtgcatagcggcagttgcagaagtcctgctcctcgcagagcagggctaccccacaggctgtgagcccggagtaatcagggttgcagtcatctttgtacccactttaattatatgcaaattaaagggcagattatgcaaatttctaggaaaagggtggtaacttctgggttgtcgggtcattgccttgggaaaggagtagtagctgctggtgttaccatcacaatggcaaactgccatggcacactggtgggcatgtcttatggaaaggtgcttctgctccagccctgttttagctagtcctcaatttggtccgttgtctgagccccacctccagagtcaagttccacctacttcctcgtatggataaataagctgtggtgcatccagacaatggaatattattattattattagagatggacttttgcccttgttgtccaggctagagtgcaatggtgtggtctcggctcactgcaacctctgcttcccaggtccaagctgttctcctgcctcagcctcctgagtagctgggtttactggcacctgccaccacacctggctaatttttgtatttttagtagagatgggatttcaccatgttggccaggctggcctcaaactcctgacctcaggtgatccagccacgtcggcctcccaaagtgctgagattacaggtgtgagccactgctcccagcgcagacaatggaatattattcagcactgaagagagatgagatgagctctcaagccatgaagagacacgcaggaaccccaaatgcatattactaagtgaaagaagccagtcccaaaaggctacatactatatgataccagctatgtgatgtttcagaaaaggcaaaactgtagaagcagtaaaaagatcagtagttgtcagaggttagtggaaagggggtatggataggcagagcatggaagctttccacggcagtgaaaatactctctatgacactataatagtggatacccatcatcatacatgtgtccaaatccagagaatgtgacgcacggcaggcaagccccaaagtggggcttagcctgtgaggcttcttggtttcacccaagaagcctcacaggctaaggaaagaattcaagggtgattccagtggtagggtagacgaaaacagctttattgccgtggcagtgttacagctccatgactgctcttgcagggctaccccacaggctgagagtagcagctcagggcagtttggcggtcctatttatatttatttatttatttatttagagacagagtcttgctctgtcgcccaggctggagtgcagtagtgcaatctcagctcattgcaacctctgcctcccaggttcaagcaattctcctgcctcacccttctgagtagctgggattacaggcgcgtgccaccacgcctgactaacttttgtatttttagtagagatgaggtttcgccatgttggccaggctggtctcaaatttccgacctcaggtgttctgcctgccttggcctcccaaagtgctgggattacaggcatgaaccactgtgcccttcccatacctccttttttttttttttttgagacggagtcttgctctgtcgcacaggctggagtgcagtggcgcaatcttggctcactgcaagctctgcctcccacgttcacgccattctcctgcttcagcctcccaagtagctgggactacaggcgcccgccaccatgcccggctaattttttgtatttttagtagagatgagttttcaccatgttagccaggatggtctcgattgcctgaccttcctgaggcgtgaaccacccgcctcagcctccctaagtgctgggattacaggtgtgagccaccgccccccggcccatacctccttttaattacatgtagagtaaggggcagtttatgcagaaatttccagggaaggggtagtaacttttgggtgatcaggtaattgccatgaaaagcggtggtaaggccgggcgcagcggttcatgcctgtaatcccagcactttgggaggccgaggcggatggatcacctacagtcaggagttcgagaccagcctggccaacatggtgaaaccccgtctctactaaaaatacaaaaattagctgggtatggtggcacacacctgtgatcccagctactcaggaggctgaggcaggagcatcgcttgaacccgggaggtggaggttgcagcgagttgagatcataatactgcactctagcctgggccacagagcaagactccatctcaaacaaaacaaaacaaaacaaaaacaaagaaaatagaccagttgtggtggctcacatctgtaatcccaggaccttaggaggctgaggcaggaggatcacttgagcccaggggttcgagaccagcctgggcaacatagtgagaccctcatttctacagatacacacacacacacacacacacacacacacatacacgcacacacacatgagttggggggatggtttcaggatgaatcaaccacattacatttattgttcactttatttctattattattacattgtaatatataatgaaataattatacagctcacacatatgtgtatatatatatgcacacacactatatgaatattatatatagtaatatttattcatttatatgaataaaaaagaaactaaaagagaggaggaaaggaaggaaggaagaaggaaggaaggaagatcagcctggagtctctggactgccctgatggaagtgtcttggatgctaaaggggtttatgggctgattccctcaacttcctcccgtctaacaaggtctggtgttccatcaaggcagtggctatgctcccaagaagtttgcaaatgacagaaaacctaattacaggtcaacaaaccatgacctgtgggccaaatgcagcctgccacctgtttttgtaaatgaagctcttttttttgagatggagtctcactctgtcacccagcctggagtacagtggcacgatctcggctcactgcaacctccgccacccgggttcaagcaattctcctgcttcagcctcccgagtagctgggattacaggtgcattccaccacgcccagctaatttttgtatttttagtagaaacggggtttcaccatgttggtctggctggtctcgaactcctgaccttgtgattcacccgccatgggctcccaaagtgctgggattccaggcgtgagccaccatgcacggccaacaattttttttaatgaaaataattttttctcaatgccgttttggaagagaagcaaactcgtatgtgggttttaagtatggcttcattcagtagctccaacaatgtcatcaaggactgcatgtctctgtgatggattccttttctggctttgtaaatctaggatctcccactcatggcagcaaagtagctgcagttgctccagaccgcctaacctcactcttgaccaacacagcggagagtaaatcactgtcccagaagctggagcttaagatccgggatttgcactctctcattggtctgaagtgggtcatgtgttaatctctgaaccaatagtcataggcaaggggatgggccatgctaattgactggaactgggggtggagcccctctcagcccatgttgctagaagagaaagaggaaagggtatggatgtgtgcataattagttaatgaatatattcattctttccaccatccctcattgatttgtctactgcgtcccagcagcagggaatgtgatggttgataagaacttgtttctgctctcatggtgatcccagtctactgggattccacgatctgttcagacaggtacaacctgttgtaatcaatgctgtgtattcattaggatagaggtttggctactgtaacagttaggtagagattaatttatcatctaaacctatagagcagcagtctccaacctttttggtagcagtgaccggttttgtggaagacaatttttccatggaccagagttaggggggatggtttcaggatgattcaaatgcgttacatttattgttccctttatttctattattattacattgtaacatataatgaaataagtatacaactcaccataatgtagaatcagtgggagccctgagcttgttttcctgcaactagatgatcccatctgggggtgatgggagacagtggcagatcatcaggcaccagattcccgataaggagcgcacaaggtagatccctcacatgtggagttcacagtagggtttgcactcctatgaggatctaacgctgcagctgatctgacaggaggtggggctcaggtggtaatgcgagcaatggggagtggttgtaaatacagatgaagctatgctagctcacctgcccaccactcacctcctgatgtgtggcccagttcctaacagaccatggaccggtaccaggaggcttgtactgggagctactctggaggctgaggtgggaggatcacttgagcccaggaggtggaggctgcagtgagctgtaatcatgccactgcactcaactgggcaacagagtgagaccctgtcttttaaaaaaaagttaaaatcactcctgtaatcccagcactttgggaggccaaggtgggcagatcatgaggtcaggagttcgagactagtctgaccaagatggtgaaaccccatctctactaaaaatacaaaaattagctgggcttggtggcacacacctgtaatcccagctactcaggaggctgagcaggagaatcgcttgaacctgggagccagaggttgcagtgagtcgagattctgccactgcactccatcctgggtgacagagtgagactctgtctcaaaaaaaaaaaaaaaaaaagaaaagaaaaagttaaaaaaaaggccgggcgcggtggctcaagcctataatcccagcactttgggaggccgaggcaggtggattgcctgaggtcaggagtttgagaccagccttgccagcatggtgaaacccgtctctactaaaaatacaaaaattagccaggtgtggtggcaggtgcctgtaatcccagctactcgagaggctgaaggaggagaatcgcttgaacccaggaggcggagtttgcagtgagccaagatcacaccattgcactccagcctgggagacaagagtgagacttcatctcaaaaaaaaaagttcaaaaaaaccccaaccaattctctcctccccaataattaccttaggacaacaggcataagcttgggtcatccttggcaaactaggaggtaagtcactctatgtagcagagaaccaaagtaacaaggacttaaataaaactgaagattatttatttcttatgcaataatctgagcttaatcagtccaaggctggcatggtcctttctacaatgtcaaagaccagctcctcctgttctgttcttccgccacctgtgaatttcctttgtcctcagtttccaagaatactcatcaccatactcacttgccagccagataaaggggctagaatgttcctccctttaagaatgcaacctggaattgcacattatcagttagcttttgctgtgtaacaaacagtcccctaaaatggaatggcttaaagacaatatttgttattccaattaatttagtaaattgtctgggcagataggtgatctctgtggttagctaataacttggctggggtaggtagtctaggagggcctcattcacatatctgctggttggccagttgattagtataggatacctttagctaggtgcttgtctctgctccacacggtctctcatcctctggcaatttagcctgagtgcttgaatttggcaggagtattccaagaaagcaacaggagaagttgcaaagcctctatgggctaaagcgagccacaagaccaacccagatacaaaagatgaagacttagaatctacctctctttttttttttttttttttttgagatagggtcttgtcttgtcgcccaagctggggtgcagtgacttgatcttagctcactgcaacctcaaactcctggactcaattgatcctcagcctcctgagtagctggaactataggcatgtgccaccacacctggctaattttaaattcatttgtagagacggggtcttgctttgttgccaggctggtcttgaactcctggcctcaagcaattctcccaccccacccaatcctcccaatcatgtcttggggttacaggcatgagccaccatacccggcaattctctttggctggtaggagctggaaagtatttgtaatctaccacaaagggcattcagggcagaggcaaccttatatatgagacctggagatgagagacagtaaaataggtgcatttagcgtgtggcaaccacttccacctggctggagcagaggtgggagaggtaagtgagaaaaaaaagagtagagtcatcagagaagtcagcaggggccgtggtgaggttgaactttgtgttggggatgatgggggaaccatggcaaggtttcaagaggagattgacatggttagatttgctgtatgaaggtgggctgggaggagtacaaaacggatcaggaagaccactgaggaggctgttgcagccacaaaggtgatcactgcggtggctgctctaggatttgggaacagggatggtgagaagagcttagatgtgacagatagtttggatgtagaatctgaataatctattgattgactggaaatggaggattcaatgaatcctccatttccagccaggtgcagtggctcatgcctgtaataccagcactttgggaagccaagacaagctaattgtttgaggccaggagttcaaaaccagcctggacaatgtaacaagaccctgtatctacaaaaaataaaaataaaaataacgttatctgggcatggtggtgcatgcctgtagtcccaacactcaggaggttgaggcaagaggatcaattgaacccaaaaggtggaggctgcagtgagctatgattgtgccacttcactccagtctgggtgacagagcaagacctcatctctacaaataaaaagttagccaggtgtggtggtgcatgcccatagtcccagctgctcaggaggctgaggcaggaagattgcttgagcccaatttcaaggctgcagattgcactactgcacttcagcctgggcaacagagtgagaccctgtctctaaagaaataaaaataaaaataaacccgactttcaaaacacttagattcgttcctggcttgtagacgatcacctatgaaattactctaacttggccgggcacagtggttcatgcctttaatcccagcactttgagaggcagaggtgggtggatcccctgaggtcaggagttcgagaccagcctggcctacatggtgaaaccctgcctctactaaaaatacaaaaaattagccaggcgtggtggcgggcgcctgtaatcgcagctactcaggaggctgaggctggagaattgcttgaacccaggaggcggaggttgcagtgagctgagatcacgtcattgcactctggcctgggcgacaagagtgaaacgttatctcaaaaaaaaaaaattactctaagttgattctgaaggattggggagtgttgaaaatcatcttgggttcctaagacaaattgctgggtggtaatggcaccattgttagatgaagaggctggagggagagcaagtttgaactggcaatgatgtcaatcttggacctgttaagtttgaggtgcccattgttgaaagaatgaacctgtttccccagctgtaagcaaagaaatggattgcaatgaaaaggcatgctttcaactgttgttccaaaacctttgtcctcatctggaacggaggtacagactgtctcttagttactgtgttattcatttctatttatttatttatttttgagatggcgtcttgctctgttgcccaggctggagtgcagtggcacgatctcagctcactgcagcctccgccttccaggttcaagtgatcctcctgcctcagcttctcaagtagctgggattacaggcatgcaccaccatgcccggctaatttttgtatttttagtagagacagcatttcaccatgtcggccaggctggtctcgaactcctgacttcaagtgatccaccctcttcggcctcccatagtgctgggattataagcatcagcctccacacccagcctcatttatttattcaataaattgtattgggcactattgcatgccaccatgtggtgttcaggattcagaggtgactcaaccctgggtcctgacttcatctggagagagcccagcacaggcgtcttcgttgtcaggcctgggttgaggagggacatcatgttaagggaggctgcagttgggggagaatgaggactctgcttggctgaagacattggggaaggtttcctggaagaagagatattggagatgggccttgaaggatgagtaggagttcaccaggcaaataggagaggaacttttagcccagacagcagtcctttattcatctccctgcatataattactgtaagaatcggcaagagaagctggaatggagatccatgaggtctctgaggatcagacagacacatcacagctaactctggcccaaagggtacttcattaggataacaccagctactgtaacaaacaagacatttcagtgacttcacatggtaaaaattgatttcttgtacacaaaacagtacaatgcatgtgcttctagttccaggtcggggggcttttccccgcagataattcagggacccaggctactttcatttgcagttttgccatcccttagagtctcagcctgcagaaaatagggagagaggaggtatggagaagtaatttctccttaaatacagtgccctgaaagtgatgcttatgacaaatgctcctattctattggccagaagcagtcacatgactgcatccacatgcaaggagagatgggaaatgcagtccttagctgggcagccattttccagcagcaattccatattatggaagagaaaacacgaatattggtggatctttagtggcctctgcccgaggtagacagcaggaatagaactaagggcttggaggcagtaacactcagtttgatttgtgctcttgagtaaacccttcttctcactctttgggtttctctctctgagtgatgagtgaagattggaagctgattaatatctgaggtattttccagtttcaaaaattgaccgggtgcagtggttcacacctgtgatcccagcactttgggaggccaaggcaggcagattacttgaggtaaggagttcaagaccagcctggccaacatggtgaaaccctgtctctactaaaaagaaaatacaaaaattagcagggcatggtggtgggcgcctgtaatcccagctgttcgagaggctgaggcacttgaacctgggaggtggaggttgcagtgagccaagatcacgccactgcactccagcctggatgacagagggagactctatctcaaaacaaaaacagaaacaaagacaacccaaaatacaaaaattgatgggttggtgaatgctcttggtttcccagctggagctaagatgatgatggtggtgatgctcatggtcatgaatactattgtggtaatgatggtggtgatgattataatggtaacgatgatggtgatggtggtgataatgatgatgatgatgatgatgataagaatggtgatgaggagaatggtgatggtggtgatgatgatattactatcataatgataatgataatttccagaacttgaaacgtccagccctttttatgcatcatataactgaattacaacaacatgacacagtaggcataaacccttcatgttggttcatttgcctttatccttgttacctatttattgctaagtaacaaattatccccaaacttaattgtataaaacaaccatttattatgcttatggattatttgggtcaagaattctgaaatagctcatctaggcagttcccctttagggtttctaatgaggttgcacacagatgtcggctggggctgcagtcatctaaaggccttagctggagggtctacttcctgagtggctgggccacatagagcttcagctcctctccacctggggctccccacaggactgattgagtggcctcacaacatggtcgccggtgagtggtccaagagaccaaaatggagcttcgatatgtttcattatttagtcttgagaactcacatcttgtttcttccaccctgttcttttagtgacacatggccagtcttggttcaatgtgggaggggattacaaaaaggcatcttaacttatgtatgaatactaggagctatggaccattgggggccatcctggaggctggctactacaaacacattgtcttaattactgtagatttatggtgtcttaatatttggtaggactcataccctttattttccctctgtaggagtatattggctactcatggctgaggttttctatacaaatcttaggatttgtatgtcaagttcaatgaaaagccattctggggtttttaattgaaattggattaaatctatagctcaattttggagagaattgaagattttaaaacttgagtcttggggctgggtgcggtggctcatacctgtaatctcagcactttgagagcctgtggtgggagagtcacttgaggccaggagttgaagaccagcctgtgtgacatagtgacatcctgtctctataaaaaatctttaaaaaaaaattagccaggtatgatggcatatgcttgtagtcccagctacttgggagactgacgcaggaggatcttttgagcccaagaggtcaaggttacagtgaactatgatcgtgccactccactccggcctgggtgacagagtgataccctgtctctaaaaataaatcaatgaatgaataaataaaataaaacaaaacactgagtcttgctagaaaggaactggtatatattctattttgtttaggtcactagctttatgcagttttgtttcacatcttctaggctatggtcaatagtatccttttaaaatcaaagtctgatttccctatgtgaaaagctaaattcttcattttatcattcaatcagttctagcaactgtggacacttgtgcaatccacacccttatcaaaacagaacatttccatcacttgtggcctctctgagtcaatctctaccttccctcttgctccggaagcaaccactgatttgatttctatcatcataggttagttttgcttactgtaggatttcacaattttttttttaatttgtgagttatttttgcttatgtactgacacttagtacactttgtatactggttttgtattcagccacactgccaaataattttattaatttcagctatttatctatatattctttgggaatttctatgttgatgattgcttcttctgcaaaaatgactttctttctttctttcttttctttctctccttccttccttccttccttccttccttccttcctttctttctttctttctttctttctttctttctttctttctttctttctttctttctttcctttttccctctgtcttgtcttgcagtacaggctgagatcttcaatacaatgttgaatagaaatggtgatagcaggttccgttgcgtagttctgatttcaaagggaatcttttcaacatctcattattaagtacagtgtttcggtctaggttttctgaagaccttctttatcaggttacagaagttcccttccatttttactttgccaagagatttttttccccctctttcttttgatcaggaatgaatgttgagttgctaccgcatctttcatgtgtcttctgttgcagatttctctttttgacaaaaagagaacaggtcttgggtcagagccttgggcgagcaacagaatctacctagaatttagtaacgttgtttgaaccatatttattctacagttgcttcttcttttatttatttatttatttattttgagacagggtctcattgtgttgcctgggccggagtgcagtggtgcgatcatagctcactgcagcctctacctcctggcctcaagtgatcctcctgcctcagcctcccaagtagctgggactactggccatcacaccaggctaatttttgtattttttgcagagacagtgtctctccgtgttgctcaggctggtcccaaacccctgacctcaaagtgatcctctcgccttggtttcccaaagtgctgggattacaggtatgagccatcacacccatcatacagttgtttctgtttgtagcccgtgagcttagttttgtaggaggatgtaaagctctcttcttaaacacaaaagagttaaagttcatgttccatatgcaatgggttgcatagactgtggcagcaattgagaagatgatacattctgcaaatggaagtgtgagaaacagggttacaacagacattaagtgccaaatgaattcacacacacagctatggcataatggttacgcacaggcttggaagtcatgctgcctgagtttgtatcccggctgtgtgtctcacctcagtttccttctctgtaaaatgaggataataatatgacttaccttgaagagttgctgggaggagtccatgttatctctgcagcatgctgaaaattgagagcatggtgggtggaagctcatgctagcttccactacacacaaggtaaagagaaaaggctgtggtcaagaaagtgggctcagctgggagttgtggctcccacccgtaataccaacatttagggaggctgaggcaggaggattgcttgaggaccagcctcggcaacataatgaaactctctgtctctacaaattttttttttttttttttttgagacggagtctcgctctgtcgcccaggctggagtgcagtggcgcaatctcggctcactgcaagctccgcctcctgggttcacgccattctcctgcctcagcctcccgagtagctgggactacaggcgcacaccaccacgcccagctaatttttttgtgtttttggttgagacatggtttcaccgtgttaatcaggatggtctcgatctcctgacttcatgatctgccctcctcggcttcccaaaatgctgggattacaggtgtgagccaccatgcccggctacaaaaacatttttaaaattagctggatgtggtggcacacatccattgtcctggctgcttgggaggctgagctgggagcattgcttggtcccaggaggtgaaggctgcagtgagctatgattgcatcgctgcactccagcctggacaacagagtgagagcatctctctctcgctctctctctctctcacacgcacacagacacatacgcacacacagacacacacacacacagaacgtgggttctagattcataccatctcggagtttaattgcagctcctcccctaacttactcttgctgttaatctcaagcagcatccccacaccgatctaagcctgctttcttgtaggtaaaatagacacagacgggtgtggtggctcatgcctgtaatcccagcactttgggaggccgaggcaggtgcattacttgagatcagttcaagaccagcctggacaacatggtgaaatccccatctctagcaaaaaatacaaaaatcagctggacgtggtggcacactcctgtagttccagctacttgggaggctgaggtgggagaaccgcttgaacctgggaggtggaagttgcagtgagccgagatggtgccactgccctccagcctgggcgacagagcaagactccatctcaaaagggtataaacactgacagtgtggttatgagaatggagttaatctgaatgcctaaccatgtgtagtaggcatccaagaaatgcattttttttttcttttgagatggaatctcactcttgttgcccaggctggagtgcagtggggatatctcagctcactgcaacctccgcctcctggttcaagcaattctcctgcctcagcctcccaagtagctgggattacaggtgcccgccaccatgcctggctaattttttttgtttgtttttttggtatttttagtagaaatggggtttcaccatgttgcccaggctggttttgaactcctgacctcaagtaatctgcctgcctctgccttccaaagtgctgcgattacagggatgagtcatagcacccagccaaaaaatgcaaatattgttatggtaggggcacagagtaggggttggcaagtatgtcagaatcacctgaggagagtgttaatatgcagattcccaggccccacctccatccatctagttaacaaacatatatcaggggcctcctacacataaggtactatcatagttgctgggcattcaagaaacagaacgatggccctcccctcttcaaactgacattttatttgggtgagataaacaataaacacaacaagagaagcaaaactaaggggatagaaaacgccggagtaggggtgtgggattttatgaaattttaattaatttatgtatatatttattttctgagatggggtctcgctctgttgcccaggctggagtgcagtggcaccgtcgtggctcaccgcagcctccacctcctgggctccaacaatcctcctctctcagcctcccgagtagctgggactacaggcacccgccaccttgcctggctaattttttgtgtttttagtagagacgggatttcaccgtgttagccaggatggtctcgatctcctgacctcgtgatccgcccgcctcggcctcccaaagtgctgggattacaggcatgagccaccacgcccagccttaaatttgtttttgtagaaatgggatctcattatgtggccccaggctgattttgaacacctaggctcaagtgattctctcacttccacctcccaacgtgctgggattacaggtgtgcaccaccacacccagctgactttttattttttgtggagatggggtctccctgtgttgaccaggctggtcttgaactcctgggctcaagtcaacctgggagtgggattttaaatagggtggctagaggaggtctcacagagaaggtgtcctttgaggaaagacaaagacgttggcaaggaactttcttctggatatcagggtgtatttgtttgcgtgggtgccacaacaaagtaccacgagcttggaggcttaaacagcagaaatttatcttctcacaataaatgtcttgttcacctccctatcctcccctcttcttcctcctcgcccactctaactccagccacatgggcctccttgctgttcctccaacatgttaggcaagatcctgcctcaggaccattgcatgcactgttctctcttcttggaatacactttcttgtgtgctatgggttgaactgtgtccccccaaaatttatacattgaagtcttaacccctagtacctcagaatgtggcagtatttggatatggagtatttacagaggtagttcagttagaatgaggtcatctgtgtgggccctaatgcactgtgactgatgtccttataagaagagtaaactagggtgcaggcagggcaagaccacgtcacagtgcagggagaaggtggctgtctactgaaatgagcccttagaggaacctacaaatatctagtcctaaaaagtagaaacaaactggccgggcgtggtggctcacacctgtaatcccagcactttgggaggccgaggcgggtggatcacctgaggtcaagagttcaagaccagcctgaccaacatggtgaaacctcatctctactaaaaatacaaaaataagctgggtgtgatggcgggtgcttgtaatcccagctactcaggaggctgagacaggagaattgcttgaacctgggaggtggaggttgcagtgagctaagatggcaccattgcactccagcctggcggacaaagtgagactccatccccctcaaaaaaaagaaagaaaagaaacaagctatccatgaaaacactttgtgatgtgctgttttatatcacagaatggaacctgtgttttgattcaacaagttcaaaacactcttttcataaaatctaagaagttatgtttctgaacctattgagcctttataggaacatatgaatatccagtcctaaaaactagaaatgagcgatctgtgaaaacactttgtgatgtgctgtttcatatcacagaatgggacctgtgttttgaagaaaccaaccctactgacaccttgatcttggacttctagtctcagaactatcttggacatttcctatgaatagaattgtacaatacatggcattttgtgatttgcttctttcactgagcatgtttttaaggttcatccatgttgtagtgtggaacagtattttgctccttttttatggctgagtaatattccattgtgtggatttgcctgtactggacatttcctataaatagatgcatgcaatacgtggctttggaagatggattttaaccaactctactgacgagtctgctttaggactcttggtccagactgacttcatggagagtgttgggggttgtgggagaggccaagcctacaagctgtgggaagctggtggatggaaggctggttagaattcttcaggatctggggaacctcagagagtgctgaacctgttgggacgttggatgagccaatacttggcaaatgcaagaatacaaaggtttctttctttctttttctttttccagatactcaaaagctggggccatgttacatgtgcccagctgtttcattagttaatatcttttggttgcaggccatggcaaccaaatctaaagtaacttaaacaagaaaaggaatgttttggctcatgaaataaaaaagtttagggatggccaggcatggtggctcccacctgtaatctcagcactttaggaggccaaggtgggcagattcctcaagtccaggaattcaagaccagcctgggcaacatagcgagacctcgtctctacaaaaaatacagaaattagctgggtgttgcgacacatgactgaagtcctagctacctgggaggtggaggcaggaggcatggttttttgtttgtttgtttgagacagggtcttgctttgttgcccaggctggagtgcagtggtgccatcatagctcaccgcaggctcgaactcctgggctcagtgatccactcatctccgcctcctgagtagttcaaaatgtttttcaggtcatccacattgtagtatgaatcagtgcttcattcctttttatggctgaataatattccattgtatggatataccacatttgtttaaccgttagtgattaattttatcttttgtgaattttaactcaataaaaacattcagagcatagatctggatcaggcacaacttaatctttaccagaagataattcaatttcatggaagagggtctgtgctttcatttcccctccacaccagtccccaagctaggtggcctgggggtcagtttctcccctgccctttcgtactgccccaccctcatttctctgtctcctcacagttcctgtgccttaagaacattagaaccttcctgtccacctgctgtgagaagttcggcctcaagcggagcgagctcttcgaagcctttgacctcttcgatgtgcaggattttggcaaggtgagctgcacacttgaagcccaaagactgagtttcagttaatttctattgacgtctacactgggcaagctaaggactgtcaggggacaggcagacaagccagaccaggccatatacaagacgcaaatagcactggcttgggatatgtggaactgggtttgagttcctgctctgacacttgctgtgtgaccttggatacgtggctgtgcctctctgagcccctcgtttctcatctgaaatatgggaatattatcatcctgccctctctgagtggctatgaggattaaatagaaagatagagggccgggcgcagtggctcatgcctgtaatcccagcactttgggaggctgaggtgggcagatcacgaggtcaggagatcgattccaccctggctaacacagtgaaaccccgtctctactaaaaatacaaaaaattagctgggtgtggtggccggcgcctgtagtcccagctactccggaggctgaggcaggagaatcgcttgaacctgggaggtggaggttgtagtgagccgagatggtgccactgcactccagcctgggtgacagagtgagactccgttaaaaaaaatactaaaatataaaagaaagaaagaaagataggagcaaagggtggggctcatttgagagaacgatggtatggggaataggaggtagagaaaatcctgaattaggcttccaagaggcatgggatctagcgcctcagacagagccttgcagctggaagctgtgttctgccgtgggggtgtacaaggggctcactgagtggccactgccccgtcacaggtcatctacaccctgtctgctctgtcctggaccccgatcgcccagaacagggggatcatgtgagtaaccacctgggccttgggccatttagccccagtcctccccctccctgaagccccacttctacccagcccccaggcccctggctcacaccctcctgaccccccaggcccttccccaccgaggaggagagtgtaggtgatgaagacatctacagtggcctgtccgaccagatcgagtgagtgctcaggcctgtggccgcacagctcactggagcaccgtcctgggggtggagggtgtggggggacatggccttgccctccgggaaataaggtcataccctggtgtctggggcacacaaccttgcctgagagtctggggagacacagccctgccctggggtcttgggggacatggcactgtcctggggtcttgggggacatggccctgccctggagcttggagggacatggcctgcccttggagtctgaggtcccacccttggagtcttggggggacaaagccctgcgctggggtctgcggggaccctgctgtgatctgggagaggtccaagggatccctgacctcacaacccacagcgacacggtggaggaggatgaggacctgtatgactgcgtggagaatgaggaggcggaaggcgacgagatctatgaggacctcatgcgctcggagcccgtgtccatgccggtgcgtgacgtggagggtcgggcctggggagggcgtgggcggggggcagccccaggccccccaacaccggcctctcccctcgctctcagcccaagatgacagagtatgacaagcgctgctgctgcctgcgggagatccagcagacggaggagaagtacactgacacgctgggctccatccagcaggtgggcgcctcccacccagcgcctgccgggcgcatgcgcgggagctgggccggcaggtgcacgtccacctgtccggccgctctgggcagctgaggatttcctgctcccatcgcttttcctttctgtgactgtctccgtctctgagtttctctgacttacatatgtatatataaatatgagtctgacgtatatatatattaaaaaatatatataaaatataggacactgcctgcaggagcagtcaaaaaaccaaaaacaaacaaaataaatacaaaatcaaaaatatataaatatattaaacatatacataaatagaaaatatataaatatatacaaagtatatataaaaatataaacatataatatgtataaaatataaacatgatatatgatatttataagatataaaatatatagtttttcatatagagctatatgtaaataatatatacaatatataaatatataaaatataaaatgtagatatattgatataggtatatatctttttatatagatatatatttttaatatacaagatatatgtccatatgtagatatatatacctttatatatcttatatacataaaagatatatatctttatctatctatcttttttttttttgagacacggtttctctctcattgcccaggctagagggcaatggcaagctctcgctttactacaatctctgcctaccgggctcaagcaatccttctgcttcagcctcccaagtagctgggattacaggcatgcaccaccatgctcgactaatttttgtatttttagtagagacgaggttttgccatgttggccaggctggtctcgaactctgacctcaagtgatctgcccacctcggcctccaaaagtgctgggattgcaggcatgagccactgtgcctggcttatatatctatcttttaaagatatatatcattatttaaagatatatatataaagtatgtataagatatgtaatagatacaaatatatattttatatatattttttgttatgttaaccaggctggtcttaaactcctgggctcaagcaatcctcctgtaatccaagccctttgtgaggctgcactgggcctcttcctcttgtctctctgtctctctctttatctctcactctgtctctttttccctctgggtctcctctcgctactttcttcctcagtgtgtcattctctcctttgtagctctttatcccaggctcagtctttttctgtatcctcacctctccatttcttttaaaaatagctttattgagatttcattaatatacatgtaatccacccatttagaatatacagttcaatggtttttggcacacacaagattatgcagtcatcatcactgtctaattttggaatattttcatttgttttgttttggttttttttgtttctttttttttgatttgttttgttttgaaatgtggtctcactctcccatccaggctggagtgcagtggcacgatcatagttcactgcagcctcgaactcctgggctcaagtgatccccctgccttaacctcctgaggagctggggccacgggtgcatgccaccacaccctgcttaattctttaattttttttgtagatatggggtcttgctatgttgcccaggctggtctcctactcctggcctcaagtgatcctcctgccttggcctcccaaagtgttgggattttgggtgtgagccaccaccccggccttaattttagaacgttttcatcatctcccaaagaaaccccaaactctttagctgttccccttcaatctcttatcttcccccggtccatggcaaccacgagcttactcgctgtctctgtggattggcctcttctggacatttcatataaagggcatcacatactatgtggtttatatgtgtctggcttcttttgctgagcgtagtgttttcaaggttcatccacattgtagcctgtgtcagagcttcattccttttcatggctgaataatattccattgtatggatggaccacattttttttttcttttttgagatagagtctcactctgtcacccaggctggagtgcagtggcgtgatctcagctcactgcaacctctgccatccaggttcaagtgattctcctgcttcagcctcctgagtagctgggatcacacgcatctgccaccgtgcccagcttatttttgtagttttagtagagacggggtttcaccatcttggccaggctggtcttgaactcctgacctcgtgatccacccacctcaggctcccaaagtgctgggattgcaggcgtgagccaccgcacctggccggaccacatttgaaacacccatttacccattgataagcattttggttgtttccgcttttgggttattatgaataatttcactgtgaacattcttgtacaagtttttgtgtggacgcgctgcctctctttatctccctctctctgtctccttcccctgtctctctgagactggtctggaggagggaatcttatcttccgtcatctttctctcccttccccgcagcatttcttgaagcccctgcaacggttcctgaaacctcaagacattgagatcatctttatcaacattgaggtgagccggccgatccccagccctcttgggtctgtctagtgcggataacctgctgcccctacctctccctggagtacgggggttgggagttgagcggcatggggcgggtggatgaccctttccttcctggccccctgagccctgggctctggtcccagccctcacccttccctccgagtaggacctgcttcgtgttcatactcacttcctaaaggagatgaaggaagccctgggcacccctggcgcagccaatctctaccaggtcttcatcaaatacaaggagaggtgagacccagctggccagactgaagctctggggtcactctgtcttgcctaggctgggcatctgagagaccttaccctcagacaccactggacggggaggactttttgctgtgtgttcatgggcgaggggctgcccatctctggttcaattcccagctctgctgtgtggcactgggtagtcacttaacctctctgtgcttctgcttcctcatctgtacatcagtgggccacaggaatgtgcctcctaggctggtggtgagggttgactatacggatgcacacagggcctggcacatagtagatgctcaataagtatttgttaaatgaaggaacattggccaggtgtggtggctaatgcctgtaatcccagcactttgggaggctgaggcgggtggatcatttaaggtgaggagttcaagaccaggctggccaatatggtgaaaccccgtctccatcgcctaaaaatacaactaaaatacaactaaaaatacaaaaaacaattagctgggcgtggtggcatgcacctgtaatcccagttactcaggagaattgcttgaacccgggaggcggaggttgcagtgagtcaagatcatgccactggactccagcctaggcaacagagcaagactctgtctcagaaataaaaacaggccaggcgtggtggctcacgcctgtaattccagcactttgggaggccgaggagggcagatcacttgaggtcaggagttcgagaccagcctggccaacatggcaaaaccccgtctctactaaaaatacaaaaattagccaggcatggtggcaggtgtctgtaatcccagctactcggggggctgaagcaggagaatcgcttgaacccgggagatggaggttgcactgagcccagatcacaccactgtactccagcctgggagacaagcgtgaaaccccgtctcaaaaataaataaattaattaaattaaataaaaataaataaacattgggcagagacaataccaggtactgtggtgaaattactgtagcattaaatgagataatgctacaatagcctcacatgggagatgctattgttatgcccatttcacagatggagaaactgggactcaggtttcttctccagcggggaagagcaaggccagggctgacgccagcctctgcccgaccttgatgccagtcacctttacctggtggcctgtcttctccctgtaggttcctcgtctatggccgctactgcagccaggtggagtcagccagcaaacacctggaccgtgtggccgcagcccgggaggacgtgcagatgaagctggaggtgggcgccgggccacttctcgggggcctctcccgctcctccccaggccctgggggcagcagggaggacactgagttgcagatggtccactttctgctgcagcccagccagagatccaccaaaggactagggagggaggtactagccagccaagcagaggaaatggagaagaacagaaatgggctggccctgggtctgggctgacccctgatatcagggtgaagtcctgaccctgaactgagctctgatctcacactcaaccccagccctgggctgagccctagcactgattgtaccccaagtcgggctgagctcccacttctcactgaaccccaattccaaccaacccctgatcccaggctgaacttgatcttgaactgaacttcaacctggatctgtctggtggaaacacagacagggcaggggtggtgaggacgggggctctccagatctgtccccctccccatctccagcccccctcagcaggcagaatactggacctctatcccaggcagcatttgccacattccagtgggtttgtttgtttgtttgttttgttttgttttgtttttttgagacagggtctcattctgtcccccaagctggagtgtagtggcatgatcatagctcaccacagcctcgacctcctggactcaagcaatcctcccaactcctaccttggcctcctgagtagctgggactacagatgcatgccaccattcctggctaatttttgtgttttttgcagagatggggtttcaccatgttatccagggtggtctcaaactcctgggctcaagcgactcacccactcagcctctcaaagagctaggattacaggcctgagcaatcgtgcccagcctcttcccattgcttttttgtttgtttgtttgtctttgttttttgagatggagtctccctctgtcacccaggttggagtgaagtggtgtgatctcagctcaatgccatctctgcctcccgggttcaagcaattctcctgcctcagtctcctgagtagctgggattgcaggagtctgccaccacgccagctatttttttttttttcatagcagagacggggtttccccgtgttggccaggctggtcttgaactcctgacctcaagtgatcctcccgcctcggcctcccaaagttccttccagtggttctcaagctgcccccacctcatggagtccttttcctgtttccttgggggcagatatgatgctttggcctctagaaaaattcccacagctctggggtggagagctgctcacgtatttattcaaatctatctgcacccaccctgcaactggctgtttctgggacctgcctcagtttccccattgttctctgattccccaggaatgttctcagagagccaacaacgggaggttcaccctgcgggacctgctgatggtgcctatgcagcgagttctcaaatatcacctccttctccaggtgccaggcacatctctaggcgtgggctccacgtacctactctcctgtgtctataaaagtggggacggggctggcttctgggggttgggtctctaggacgctcggggatgggtcactggggtcatgtctcagcctccagggtcagcagtacgatggaggagctggtgagctagcattgtttggaaggccctccccgcagggagaaggggaggggcccaggtgacgtctgacgtcttggttctctcaggagctggtgaaacacacgcaggaggcgatggagaaggagaacctgcggctggccctggatgccatgagggtgagtgggtgtagggtgctggtgactcacctgctgcagacaccctcctggtaggggctgatcctctagccgggattaggtaggagcctgggtcggctgttggggggccaggttcacccctgccccctccccaggacctggctcagtgcgtgaacgaggtcaagcgagacaacgagacactgcgacagatcaccaatttccagctgtccattgagaacctggtgaggcggtggagccgggtgggccaggggtgtggccacgtggggagagtgtgtgtctggctcctttcttgggagacccttgctagaccccctgcctactgcataggaccagtctctggctcactatggccggcccaagatcgacggggaactcaagatcacctcggtggaacggcgctccaagatggacaggtgggtggagtcaacatggatctgggatggagcctgggcaaaggggtgggaccaggctcctagatgggcaggtgggtggagtcaacacagatctgggtggagcctgggcaggggcggggccgggcttctagatggacaggtgggtggagtcgacatagatctggagcagagcctgggcaggggcagagccaggcttctagataggcagatgggtggagtcaacacagatctgggaggagcctgggcagggatggtgccaggctcctagatgagcaggtgggtggagtcaacacagatctgggtggagcctgggcaaggtgggggccaggctcctagatgggtaggtgagtggagcaaaccatatctgtggtggagcctgggtagggatggggccaggtttctagataggcagttgggtggagtcaacataggtctggggaagagcctggataggggcgtggccaggctcctagatggacaggtgggtggagccaacacagatctggggtggagcctgggtaggggtggggccaggttcttatgtagacttgtaggtggaattaagatgaatttggggagggacctgagtgggggtgaggcaagatttctagacagacaggtggtagacccatccagagaaggcggtggagccttgatggacaggcaggacagggccagcgaggggtatgggtggagcgaagactgacaggcagtagggccaatgcggatcacgtgggtgaagtcaggatggacaggtgggcatggccaagttggccaaggaggaggagaagggcagggtgggaccaggatgtggaggaactggtcagagggctgatggggacagttgggaagagccagacaggaatgcgttatccatccttccaggtatgccttcctgctcgacaaagctctactcatctgtaagcgcaggggagactcctatgacctcaaggactttgtaaacctgcacagcttccaggttcgggatgactcttcaggagaccgagacaacaagaaggtggggctttgacgccggaactatggggtcctccacgcagtcggcagcttagccctctccacttgggcatgtgcctgtttgccagactacatctacatggaagtgtgtgttaatccactcaacaggtgttttttgtttgtttgttttgttctgttttttaagatggagtctcgctctgtcgccaggccggagtgcagtggcacaatctcggctcaccgcaacctccgcctcctgggttcaagcgattctcctggctcagtctcccgagtagctgggactacaggcacacaccaccacgcccagctaatctttgtagttttggtagagacagggtttcaccatgttggccaggatggtctcgatctcttgaccccgtgatccacctgcctcggcctcccaaagtgctgggattataagcgtgagcccactcaacagtttttaaattgagcacctactatatccagggcactcttctaggcactaggactaaaatggaaagcaaaacagaattttcattttgtttgtttgttggtttgtttttgagacagtctcactctgttgttcaggctggaatgcagtggcacggtcttggctcactgcaacctctggctcccaggttcaagcaattctcctgcctcagcctcccgagtagctgggattacgggcacccaccaccatgcccagctaaattttgtatttttagtagagacgaggtttcaccatgttggccaggctggtctcaaattcctgacctcaagtgacctgcccatcttggcctcccaaagtgctgagattacaagcgtgagccactgtgcccagcttattttatttcttgtatggtacttgcgttcttatgggatgctttctacaaagaaaataaagtaggtggctgggtgcagtggctcatgcctgtaatcccagtactttgggaggccgaggtgggagaattgcttgagcccaggagtttgagatcagcctgggcaacatagggagatccccgtctctacaaaacataaaaaaaaatttagctgggcttggtggcacatgcctgtagccctagctacatgggaggctgaggtgggaggatcgcctgtggctaggagttggaggctgcagagagctatgattgcactacagctaggaccacagagtgagatcctgtctctattaaaaaataaatgaatgaaacaggagatgtggctgtggtaggtgagggtgggagggggagctatcttacctccattgttcagggacattctctgtggaagtgacatttaagctgagacccctctccctctcggctcttccttacttccttctgctttttctcctgtgaactcttccgttcgcttcagtttttgccctggagttccccctgtgctctggtctgtggcttctctatttctttttttgagacggagcctcgctctgtcaccaggctggagtgcagaggcatgatctcggctcactgcaacctccgcctcctgagttcaagagattctcctacctcagcctcctgagtagctgggattacaggtgcccgccaccacgcccagctaatttttttgtatttttagtagagacggagtttcaccacattggtcaggctggtctcaaactcctgacctcgtgatccgcccacctcagcctcccaaaatgctgggattacaggtgtaagccaccgcgcccggctggcttctctatttctcaacctgtgtctccctcgaggagccagttgctgtcttgtaactgcctgcttacagcatccgtctctcctaccaggctggagctctggggaccacatcctattcactgctctgtccccagctcctagcagtgtctgtttctcagcaggtgctgcaccaatgctttgttgaacagaaaaatcgatgatgagtgacatgctgtgtctggtgtgtgcttctgcaaaggggagtgtgtgtgtgtgtgtgtgtgtgtgtgcatgtgcacgcctgcgtatgtggttttgggtttatggttgtgtatttggatatcctagaaagcccttttacaaggatatccatgcatggtgctaggggcatagagactgtcatgggcttgcctgttccctacagagggaggggtgggtgggtgtgtgctcccaccctctgcgggggcagtgccttcagtctgagctctgcttccctgcagtggagccacatgttcctcctgatcgaggaccaaggtgcccagggctatgagctgttcttcaagacaagagaattgaagaagaagtggatggagcagtttgagatggccatgtgagtccccgtcttcctccctctttctgtccacagaggggcaggggctgggaaggaggaacgtgatctagtccctactctgtcctgacatgccatgggaccactctgaaccacagtctcttcatttgggaaataagagggacaggcccaaggctgtcttcatccttggaatgcaggggttgtgtgcaagcttcagttaccagcccagactcttctcctttcctcctcctctttcttgttctcctctcctcttccttctcctccttctggtttccttcctcctcctcctcctctttctccttctcctttcctcctcctctttcctcctcctccccttcctcttcttcttcctcctcctctccttcctccccttcctcctcctcgccctcctcttcctcttcctcctattcctcctccacctcttcttcctcctcctccctttcctccccttcttcctcctcctcctcctcttcctcctcttctttctcttcctcctccctttcctcctcttcctcttcttccttttcctcctcctccttcttcttcccctcttcctcctcttccacttttgtcttctctttctcctttttatgtgaggcaaaattccaacaacaaaaatctaacaatttcgaagtgtatgatcgcatggcattttgtacactaacagcattgtgcaaccatcacctctatccagtttcaaaaccttttcatcagcccaaaggagacctcatacccattaagcattcactcccaattccccgctctcgcagcccctggaaactcctagcctgctttctctttctcccaatgtgcatggcagcacgattcagtgtggccaaagggtgaaaacgacccaaaagccaatcaatgaatgagtggacacgcaaaacgtggtctgttcataccatggaatagtattcagccataaaaaggaataaaatactgaccttcttttttttttttttttaattttcccctgccagctccaacatctatccggagaatgccaccgccaacgggcatgacttccagatgttctcctttgaggagaccacatcctgcaaggcctgtcagatgctgcttaggtgagaatctgggaggagggtcctgcataccggacttggtcatcagttccttgctagagaagatggcctagtaattggttccctaaattgggagatgggggagtccctactttgatcttctgcttctccgtcactctcctgatctaaagagaacccaaggggtccctttatgtttttagcagaatatttggccctgtctgtaaaggtcactcgctcttctttatgtgttccctgcatctcagaggtaccttctatcagggctaccgctgccatcggtgccgggcatctgcacacaaggagtgtctggggagggtccctccatgtggccgacatgggcaaggtacgagtgggagggaggctgggaggtgagcttggttctctttggaggatttcccgttctcaccatttcctttaccctcccgtagatttcccaggaactatgaagaaggtaagactttcccgtggtccttcctgtgtaccacaaataatgggcaacagcgcggggaggacccaggacatcctggaactgggcaggatcctttgtggggtgaggagagtaagggggcctacaagcccccaggctgggcataggtagacaggctttctttgtttctccttccaggacaaactacatcgcagggctcaggacaaaaagaggaatgagctgggtgagttggcaggggttgctgtgtgggggcaggaggaaaattcatctctattgatgttgacccagggacagatctccataatcatattaacagccacattgggccgggtgcaatagctcacacctgtaatcccaacaatttgggaggccaaggcgggaggatcgcttgaagtcaggtgcacaccaccacgcctagctaattttttttttttaaatagagatgaggtcttgctacgttgcccagccatactgtataaattaaatcatacagtatgtgcttattttaattaattaatttatttatttctggagatggagtcttgctgtgtcgcccaggctggagtgcagtggtgtgatcttggctcactacaacctccacctcccaagttcaagcgattctcctgcctcagcctcccaagtagctgggattataggcacatgtcaccacgctcggctaatttttgtatttttagtaaagacggggtttcaccatgttgggcaggctggtctcgaactcttgacctcaggtgatctgcctgctcagcctcccaaagtgctgggattacaagcgtgagccactgtgcccagccttaattttaaaaaatttaaaaatatatgtattttattaaatatataataatttattatttaataatatattaatattaattaatataatatagtaataatatattataataatatataaaatatatattaatatatatttattaaaaatatattatatgtatatataatatatcttttttttatttttagaggcagggtcttgctctgtatcccaggctggagtgcagaggcaggagtgttccacttatatgccatttatatgacatataaatatataacataagtcaggtgtggtggttcatgtctgtgatcccagcactttgagaggccaaggccaggagtttgagacaagcgtgggcaacagaacgagaccctgtgtctacaaaaacatttttaaaaattagcggggttcttgcttgagcccaggagttcaaggttgcagtgagccatgatcacgccactgcacgccaacctgggcaacagagcaagatcctgtttcaaaaaaataaaaaaataaatatatgaaatctatgaatgggtatgttttcttcttattattacttactatgtaattagcaatagtcagtcagctttcttagcaagagtcaaaattagaaacaacccgtgtcctttgtacaatagaatatatatatgtgtatatatatatacatacacacacacacacacacacacacacacacacacgtattttattgagagaggaaatacatactttaaggtatgtaaaaatcaataaatcttaagtatatgacttaatacatttttatccatgcaaccaacaatcaaataaaaatgtagaacatttccatccctccagaactgcactgtgtaatataaattaattaaaatgaaatcaccttaaaaatttttttgctcacgttagccttgaagttctcaataatggcctgtggctagttgctaccatattggacatatccatcaccacagaaagctttgtcagaaagcactgctactcacctatctcccatagggaaccactgtctgacctctatcaccatagattaattttgcctgctcttgagttttctataaataaaatcatacagtacatgcttatttcatctggtttcttttatctgacgtaatgacggtgagatgcattgatgtgatcgcctgtagcaatagcttgttccttttcattgttgtatagtattccattatgtgatgatatcacaatttgtttattgattgatcaacctattgaggacatttggttggttgccagtttttggatattgtgtataaagctgcaacttttgaaggactttttttttgttttttgtttttttgtttagttttgttttgagacagagtctcactccatcgcccaggctggagtgcagtggcatgatctcagctcactgaaacctctgcctcctgggagttcaagtgattctcctgcctcagcctcccaagtagctgggattacaggtgcccaccaccacacccagctaatttctgtagttttagtagagatggggtttcaccatgttggccagtctggtctcaaactcctgacctcaggtgatcttcctgcctcggcctcccaaagtgctgggattacagacatgagccaccgtgcccagccaggacacatgttttcatttctcttgggttgctgggttacagagtagatacaatgtttagcttcagtagatattgccaaatagttttacaaagagtatccccaccagcaatgagtgaaaattccagtttctccacgtccttgtcaacacttagtattgccagtctaaaaagaaaaattttagccattctcgtgggtggcaagattcagggttgaaagttgactgccaaccaccctgtactcctgtaccctgtcctccaggtctgcccaagatggaggtgtttcaggaatactacgggcttcctccaccccctggagccattggaccctttctacggctcaaccctggagacattgtggagctcacgaaggctgaggctgaacagaactggtgggaggtacaggctggggccacaagagtgatggggtgggacccaagtgtagggttatggattcatgtggtctcagggagttgggtcatagttccaccatgctctggaggtgatgcctggggagtggggtaggtagactgagacttctgggcatggcttttctgagcgggccatcttcccaggaagctaatactcattatcacctctctgggctctccaggccatcctgagatagatggacaagcagagtgaccattgagcagagagatggacacacacacacacacacacacacacacacacacacacacacacacgagtgatggggcaggatccacgtgtagggttatgggtttagatggcaggtggggttatggatcctataacctctctgttcctgtttttgtctcctgggtgtttagggcagaaatacatctactaatgaaattggctggtttccttgtaacagggtgaagccctatgtccatgtgagtgcctcaagtctgaatggaataagggcaaggggtccagggcgggtcctgggaggatggacagacttggaaagacacccccggagttggggagggggctgcccatcatggcaggtctttctctaactcaaggcttcacccaccccaccaactgagcccagagaggggccaccctggaaacaatgattgatctttttctccttgatcatttttgtgtaaaggtcctttccttcctacatgggtatggtagggaggaaggagcagggacctagaaggtgggcctgccccttgcttccttctgagacaccaaattgagttctgtgggagcactgtggcctccattgcctgtgtccttgccctgctcctggtggacacacctgtccactccagcctctgctgttcttccagtgttctctgcttgatggacccctcgctcttcatgatgacttcagatctctccctctctccccaacctcagacaccccctacctcattcacagcaaatgaccccactgtacacttcacagcctgcagagggaaattctctccagtgctggttttaactttatattatttcagacttctagcaaagctatgagaataatgcaaagagctcctgtgtagcctttacccagtttcatcagttctgttaatgttttgttccatttgctctgtcatttcctctctctacccacacatagtatttatttttcctggaagagttaaaagtgagtttgcagacgacgttcccctttacccctaaatacttcttaagagcaagagccttctcatgcataaccagagcaagatattaaaagacacaaaattcaacattgacattatactattatttaattcatagtctgtatttaaatgttgtcaatttccccaaaaattttatcaaaaatttttttgttcctatggtttctccactgtcaagttacaataggaatttccaaccccatcattctttccaaatttattagctggtgttctgctgcaagaaagagctgtcctttctgccctcatctgtctgtctgtctgtctatctatctatctatctatctatctatctatctatccatgcatccatcttttatctatatatcatctatctatttacctatcatctatttgcctatcacctatctacccatctattatctatctatatcatcatcatcatcatcaatcttttatctatttacctatcatctatccatctattcgtcatctacatattatctatctatctatctatctatctatctatctatctatatgtctatctatccatgtacctacccatcaatccatccattcatcaatcagttcttctatccatccatccatccatccatccatccatccatccatccatccatctatcatctatctacttatcaatacattcatgatctattcatccacctatcatttatctatgtatcatctgtctatgtattatctatcatctatctattcaccgatcatctctctgcctatttttcacctaccgatctaaccatctatcatctgtctattacctatttattatcatttctctctcatctattcatttatcatttatccatcacctgtctgtttatcatctatcatctttccatctatctattacctgtttatccatcatccatctattctatctatctatctcttaattttttgttttagagagagggtctcattctgtcacctaggctggagtgcaatggtgtgatttaactcactgcagccttgacctcctgggctcaagcaatcctcccacctcaccctcctgagtagctgggaccacagatgcaagccattatgctcagctttatttatttatttatttatttatttaagatggagtttcactcttgtttcccaggctggagtgcagtggggtgatctcggctcattgcaacctccgccttccggtttcaagcgattctcctgccttagcctcctgagtagctaggattacaggcgcctgccaccacatctggctaatttttgtatttttagtagagatggagtttcatcatgttggtcaggctggtctcgaactcctgaccttgtgatccgccagcttcagcctcccaaagtgttgggattacaggtgtgagccactgcacccagccgcagctgtttttttgtgtgtgattttttttttttttagagatagggtctcactatgttgtccaggctggtcttgaactcctgggctcaagcaatcctctcatagaacatccttctcttttttcttttaaaaaattgaggtgaaatttgcacagcataaaactgaccgttacaatgaaaaattcagaatactgagtagctgagattacaggcgtgcaccaccacacctggctaattttttgtatttttagtagagatgggattttaccatgttggtcaggctgatctcaaactcctgacctcaaatgatctgcctgcctcggcctcccaaagtgctgggattacaggcgtgagccaccacgcccggctgggtatggcattttcttttggagtgataaaaatgttttagaactaggtagaggcggtgattcctcattcattttattattattatttttgattatggcaaaatatatagaacataaaagttaacaatgtaaccttttttttggagacaggatctcactctgttgcccaggctggagtgcaatggtgcaatcttggcccaccgcagcctcgcctcccaggctcaggtggtcctcacacttccgcctcccaagtagctgggactacaggtgcataccaccatgcctggctaattttttgtatttttcgtagcgatggggttttgccatgttgcccaggctggtttcgaacttctgggcccaagtgattcccctgcctcagcctctcaaagtgctgggattacaggcctgagccgccatgcccggccaacataaccattttctaaggtacagttgagtggcattaagtacattcacagtgttttgccaccatcaccaccatcatctccagaacacttttcatcttgcagcactctgaacccattaaacagcaaccacctattcccctctcccagcccctgacattcacattctactcttgagctctatggatttttctgtcctaagtacctcacctaagtgaaatcatacagtatttgtcctttgtgtctagcttgtttcacttggcataatgtattcaaggctcatccatgttgtggaatgtgtcagaattttctttctttttttttttttttttggtgaaatggagtctcgctctgtcacccaagctggagagcagtggcgcaatcttggctcactgcaagctccacttcccgggttcacaccattctcctgcctcagcctcccgagtagctgggactacaggcacttgccaccacgcctggctaattttttgtatttttagtagagtttcaccgtgttagccaggatggtctcgatctcctgaccttgtgttcctcccgcttcggcttcccaaagtgctgggattacaggcgtgagccactgcgcccggcctttttttatttttatttttttgggatggagtgtggtcctgttacccaggctggagtgcagtggtcgtgtaattataactcactgcagactcgaccccctaagcttaagtgatcctcccacttcagcctcctgagtagctgggactacaggcatgtgccaccatgcctggctaatttttctacttttaaaaaaatttttgagatggagtttcgctcttgttgcccaggctggagtggaatggtgcaatctcggcccactgcaacctcagcctcccgggttcaagtgattctcccacttcagcctcgagtagctgggattacaggcatgcaccaccacaccaagctaatttttgtatttttagtagagacagggtttcaccatgttggccaggctggtctcgaactcctgacctgaggtgatctgcccgcgttggcctcccaaagtgctgggagtacaggtgtgagccaccatgccgggcctaatttttgtattcttttgtagggacagggtttcatcatgttgcccaggctggtctcgaactcctgggctcaagagacccaccctccttggcttcccaaagtgctaggattacaggcatgagccaccgtgctgggcaattttcttaattcttaaggctaatattccatggtatgcatataccatgttttgtttatccgttttcctgtcaatgaacaattggttgcttcaacttttgcgtattgtgaataaagctgctacaaacatgggtatgcaaatatcatttcgaatccatgctttcaattcctttgggtatatactcagaaacaggacggctgggtcatatggtagtgtagttctagtttttaatgttttgaggaaccaccatactatttttcttttctttttttttttttttgatagggagttttgctctgtccccaggctggagtgcaatggaatgatctcggctcactgcaacctccgcttcccaggttcaagcaattctcctgcctcagccttccaaataactgggattacaggcatgcgtcaccacgcccggctaattttttgtatttttagtagagacggggttttgccatgttggtcaggctggtcttgaactcctgacctcgtgatccgcctgcctcggcctcccaaagtgctgggattacaggcatgagccaccgtgtccagcacatactgtttttcatagtgcaccattttccattcccaccaacagtgcacaagggttctgatttctccacatccttgccaacatttgctactttctgttttgtttgttgatttgtttttgccttatagtagctgtcctaattgttttaaggtagtgaaagtgagcactttcggccgggcgcggtggttcacgcctgtaatcccaacactttgggaggccgaggcgggtggatcacctgagctcgggagtttgagaccagcccgaccaacatggaagaaaccccatctctactaaaaatacaaaattagccgggcgtggtgacacacacctgtaatcccagctacctgtaatcccagctgaggcaggagaatcgctggaacctgggaggcggaggttgctgtgagccaagatcgcgccattgcactccagcctgggcaataagagcaaaactctgtctcaaaaagaacaaataaataaataataaatacatacataaaacaaaaaagaaagtgagcactttcatccatatttagatgagggttggtaaactttttctgtaaagagccgaagagtagtgtaaatctgctcaccctccagggtcccatatggttttgcaactcttcagctccgcccctgtagtgcaaaagtagccacagataatctgtaaatgatgtatagacacggctgtgttcctacaaagcataattcatgggcactgacaggtgaatttcatatgatcttcacaatcccaaaaacattcttttggctaggcgtggtggctcatgcttgtaatcccagacctttgggaggacaaggcaggaggattgcttgaggtcaggagtttgagaccagcctgggaaacaaagggagaccatcccccgcccgatcttgacaaaatttaaaaaaattaaaaattagcgggtgtggtggtgcgtacctgtagtcccagcacttgggaggctgaggtgagaggatcgcttgaacctgggagatcgaggctgcagtgagctatgatcatactgctgcactccaacctgggcagcatagtgagactctgtccctaaaaaaaagaaaaaattcttttgatttttgccaaccatctaaaaatgtaaaaaccattcttgacttgagggtaatgataaactgctgggaagacaacccctgctttatatgatactggggcagtctctcccccgaggttctgggactttatccccagtgagtaccacagtgcctggcacataataggcactcactaaatgcaagtggaatgagtgaatgaatgaatgaatgaagtgccctgccctctgctgtcaagctggggtctttacactaagttggggtctctctctgtattcttagggccctcctcaggacctgtctgttcatctctggtgagtagaaacatttatttttgtttcaatgagaggtttctgggttggggttccaggctgggtatgggaggaacctccgagccaattagttatgcattctgtgatccctgagcaccgacttctgaatctagctctgggctgggggctgctggggatgggacagacaaaggagggtccctcaccttgggagatgatggtcttgttggaaggaaaatggttacaatgatgatgacgatgatgacaatgatgatgatgataatgatgatggtggtgatggtaatgacagttccagttgtttttgtaggattttttgttttgtttgtttgtttgttttgcacctatagcatgtcaagcatataggggtggaggtttacagtgtggcttttggagcccgctgacctggattcaaattctgaccccaaccttacctagctgtatgaccttgggccggttacttaacctccctctgtttcagcattcctctctggaaaatagcttaatgacagtatctacttcatagtgtttttaggaggcgtaaatgagtctgtcaagtgcttagtcctggtcctgacacataatgaggactttatacagcattagctgttgttattactcatttaatctgttctaagatgcatggttgttttttttttcttcttcacatttgaacatctctgacattgaaatagctcttgcgatccacagtgtccatcttctgctgaattttataggcaggaagtgttctttcataatggcacataaaagaatggggcattgaacaattgctggcgcatcagctatttaatgagctcctttaatcttcacaaaagcccttcggaaaatagatttgattcttactctctgcccccatactttcttcttttcttcttcttcttctttttttttttttttttttttttttttttttttttttttttgcaaatgaggctgagagagggtaagtgaattacttaatgtcacatggtgaggaagtgatggagatgggatttgaacccaaagcctcagtgcctcagtttatcatctctggctagtaataaaacacagcatgatgatgctcccatcttcttgttgcccaggctggagcgcaatggcgtgatctcggctcactgcaacctccacctcccaggttcaagcgattctcctgcctcagcctcccgagctgggattacaggcacctgccgccacacctggctaattttttatattttcagtaaagacagagtttcaccatgttggccaggctggtctcgaactcctgatctcaggtgatccactcgcctcagcctcccaaagtgctgggattacaggtgtgagccacctcgcccagccgacgctcccatcttctaagtgtgtaccacatagtagcaggtgcactattgccatttataaaaaatgtgcatctgtggcgtctccctcttttcagaagaggaaattgaggcccagagaggcaaaaccagttgccgaggtcttagaacacgtaagaggcagggtcaggatttgaatcgtgctctcctgcgttagcgctccttccgcccttctgcgccgagatgtggtcaatggggtggggaccagggtgagaccagggaggctctctcgtgggtgcaagatttaaggggacgctgaaaatctcagtcattaaggtccatcatgttttaatgcaacattaaaaaaaatcaaaaacaagccaaaaaaatttcgagatgaacaaataccaaaactgtaactaaagacaggatccaatagagctgggagtaagaggaggtgggtgaggtgagtcgggcagtcagattctgtctttattcaaaatgttgatgtttgttcatcatggtttctttgcattcattaaaaaaagatgttaaacaccaactcgaaccagatttgcattcgttttttaaaattgaggtgaaattcggctgggcgcagtggctcacgcctgtaatctcagctctttgggaggccgaggcgggtcgatcacttgaggtcaggagttcaagaccagcctgggcaacatggtgaaaccctgtctctactaaaaatacaaaaaaaaattagctgggcatggtggcgcacgcctgtagtcccagctactcaggaggctgaggcaggggaatcgcttgaacctggcaggcggaggttgcagtgagccgagattgcgccattgcactccagcctgggcaacagagcgagactcggtctcaaaaaataaacaaacaaacaaataaataaataaataaaaatgaggtgaaattcatacaacataaaattaaccttgtaattgttactggcatttctatttctattcatatttacatttatattacatattaacatttacatgatgttagatattatatgcaattacatatgatttataattaatacttatcatttatattgtgtatttatgtttacaacctattatatattataccacatatcataaaatatatttatattatgctatgtattttcacaaattaatgttttttatttatgttgcacatttatgtttatattatattataccatacacaatatattataataagatttataggttacctatttactttacattatattatatttatctacaattatgtataatatataactaatatttattctttaaattgtatatttacatttatatcatcttatcacatattataccatatatcatagtatatttatattacagatttgcatttatattatgctacatattctagagaattaacatttattatttatattgcacatttatgtttatatatcatatgcgttatataatatactatactgtagctttatatattacatatttacatttacattatgttaggtgacataaaattatatattatgtataattaatatttattatttatatatgttacatttatgtcatattgtacgttatgtattttaacatacatttacattaacatgatgtatttacacttatataaaattatatattatgtataattatgtattacacataattaatattctttattgtatgttacatttaaatcatgttgtacattatatactataatatacattacattaacaagagatatttacgcttatataaaattatgtattatgggctgggcacggtggcttatgcctgtaatcccagcactttgagaggctgaggcgggtggatcacttgaggtcaggagttcgagaccagtttggcctacatggtgaaaccccgcctctattaaaagtacagaaaattagctgggcgtggtggtgtgcacctgtaatcccagctactccagaggctgaggcaggagaattgcttgaacccaggaggcagaggttgcagtgagccaagacagagcgaggcactgtctcaaaaaaaattatatattatatataattatgtattacatataattagtatgtattatttatgttgcccatttacatttataatatattgtatgttataccatatattatacatttacatagactatatatggtgtattccatgtaatataaatattacatgtatatttatattatattcatattatatattatagggttatatataactatctatattaacatatagctatctacaatagatagttatatattattatataatgattatatattattatatataactattatttatattgaatatttacactcacattataaatatattcatgttatatttatattcagtggctttttgtttttttttttttggagacagagtttcgcactgttgcctgggctggagtgcagtggtgtgatctcagctcactgcaacctccgcctaccgagttcaagcgattctcttgcctcagcctcctgaatagctgggattacaggcgcccgccatcaagcccagctaatttttgcatttttagtagagacgaggtttcaccatgttgcccaggctggtctcgaactcctgaccttgtgattcgcccacctcggcctcccaaagtgctgggattacaggcgtgagccacagcgcccagccagtgccatttggtatatttgcaatactgcgccgccatcactgccgtttagctccaaaacattctcagcacccccaagagaaaccccatcccgggcagttgctcctgcctcccgcagcccccgggaaccaagggtctccttcctgtctctgtggattggcgtgttctgggcatttcctatgaatggaaatcacacagtgtgtggccgtttgtgcctggcttctctcactgagtgtgatgttttaaggctcatctccattgtagcccatgtcagtgctgcttcccttttgatggctgactttattcattttgatttctaagaatattgtattagaatactgtttgttttacttattgtcatttaccttgatgactaggttttttggctctcacttacattttgcacctgaggctcgtgactcattctccttcccctacttctgtccgggtgaccacagagatgggcacacagtgagccttcaggaaatgcctggtgaagccatcgccaaattccagacacccagccagacccaaagggctgagccatccccccgaatccatgtgtcaaaccttagtggtgacctgtagaagtggaagcccgctccccatgtctgggctccggcccctgcctccacggggcctaccttggtgctgaagggctgttagagccaggctgtcaccaacttaaaaaatcaaaggggttcagggggaaaggcaacctccatatggcaatatggggacccaggcacggggaccgtgccacctctgtccttggtgtctctttgcaggtacgcaggccccatggagcgggcaggggcagagagcatcctggccaaccgctcggacgggactttcttggtgcggcagagggtgaaggatgcagcagaatttgccatcagcattaagtaactcctttctccctgactcatacccttttggggcctgggccctgcgggcctgggaaaaagggtatccaggttttactttatagaagtgtacggtaatagcatccaccttttactgagcccctgctggttcccacgtgcctttcaccttctttatttcttttaattgacgaccacaagaaagagatatgattcctatagaggctcaaaaaggctcttaaaattaattaattaatttgagtcagagtctccctctgtcgccctgacctttcttttttcccctttttttcttttcttttcttttctttttttttctgacagagtccctttgtcgcccaggctggagtgcagtggtgagatctcagctcactgcaacctcccaggttcaagcgattctcctgcctcagacccccgagtagctgggattacaggcgcctgtgaccatgcccagctaatttttgtatttttagtagatacggggtttctccatgttggccagcctggtctcgaactcctgacctcaagtgatccacccgcctcggcctcccaaagtgttgggattacaggcgtgagccatcgtgcctggcctgaaggcttttatttttaaccaattttcatatatatgttttttctttttttttaacttccaggaatttctaatttttttaatttaattttattattattattgttattttggtgacagtctgtctctgttgcccaggctggagtgcagtggtgagatcttagctcactgcaacctctgcctcccagattcaggggaccctcctagctcagcctccccagtggctgggactataggtgtgcaccaccacatccagctaatgtttatattttttgtagagacgagggtctctccttgttgcccaggctggtctcatactcctgaccttcaaacatcctcccacctcagcctcccaaagtgcaggtgtgagccactacatcccacctatatattttttttttcaacttattttagaatcagagggcacatgtgcaggtttgttacaaaggtatattgcacaatgctgagggttggggccatgaatgatcccaacacccagggagtgatcatatactcggtagtttttcagctctttcatcccaccctcctccctctagtgctcccccgagtctactgtttccagcctttttttttttttttttttttgagatggagtctcactttgccgcccaggctggagtgcaatggcatgatctcagctcactgcaaactccacctcccaggttcaagcgagtcttctgcctcagcctcttgagtagctgggatttacaggtgcacgtcaccatgcctggctaatttttttgtatttttagtagagacagtggggtggggggtggggggaaagtttcaccatgttggccaggctggtctcgaactcctgacctcaggtgatccacctgcctcggcctctcaaagtgctgggattacaggcgtgagccactgtgcctggccaatattattcccatctttatgtccatgtgtacccaatgtttaacccctgcttataagtgagaacatgtggtgtttggcttactgtttctgtattaattcatttaggataataacacccagtgcatccacgctgctgcaatgcacatgatctcattcttctttatggctgtatagtagtccatagtgtgtgtatatgtaccacattttcttatccagtccactgttgatgggcacctgggtcgatccatgtctttgctattgtgaatgctgctgtgatgaacaaacaagggtgtgtgtctttctggtagcacaattactttttcctttgggtagatacccagtcatagggtagctgcatcaaatggtggttctatttttagttcttcgagaaacctccaaactgctttccgcagtggctgaaccaatttacagtccagcccacagtgtagaggaattcccttctctcacatgctgctgagtttgtaatttcattgttatttttggctcctgtgaatttcccttactttttttttttttgagagctcagcaatttttttctcaacatttctagtgtttttttaaataggaagagttttgtttgtttgtttctttgttttttttttttttttttttgtgatctagtttgccagatgagcaggagtggaggtcttctccaaggccccttttagtctatttccaccatgttgacagaaatgggtctttcctccctcttcctttatatcctatggttgtctatattggtggaaggggaggtctcttcgtatccattctagaacactgccttctttacaagatcttactgacttctcaacaaacctgtgagtcagggaagatgattcctcttctacgagaggaagacattaaggctttagagtagcaaaggccccagggaatgggctctgttgggacagcttgtctttggtttccagtagttactcctccctgaaggggtcaaggttgcttcctccataactggggcttggtggggaatgggcctggtccccagactcagggcccggtgaccatctggttccagatataacgtcgaggtcaagcacattaaaatcatgacagcagaaggactgtaccggatcacagagaaaaaggctttccgggggcttacggtaagggtcaatgtccgctcaatcccagctttccagaacctaggaggaccctccctgcacctccgccttgggacccccttttcccacattcagggtgacccccctccagtggcactacagtgcaagtgaccttaaacttatgctcttaatgatgaacaatgggaataataatgaataacagcagttgaatattgacagagcacttaagtgtaagatatgttcatttttaaattttatttatacatatattcaagcattatgtatatatgtatgtgtgtatatatgcatatatacatacatatgtatgtatgtgtatttaaattttacttacgtatatatacatatgtatacatatgtatgtagggtacatgtatatacgtgtatctgtttatttttatatatatagatagatagagagagagagattgagagagagaaagagagtcttgctctgttgcccaggctggagtgcagtggtgcaatcatagtacactgcagcctcaaattcctggtttaaataatctctcgcctcagcctcccgagcagctggtactataggcatgcaccatcatgcctggctaattttaaaaaaaaattttttttttgtagagatggggacttgctttgttgctcaggctggccttgaactcctgggctcaaataatccttctgtcttggcctcccaaagtgttgggattacaggtgtgagctactgcattcagccctcaaatatgttatagatagaaacctaattaatcccctcaaccttctttctgagttcccatttcacagatgggtaaaactgaggtttactcctcgtctagcttcactgaatggcagagcccatagcttgtctttgcctaatctgctgcataatcatttcagcaacaactcaaatgccttttgagggttcttgcttctgtttggtgccttgtaattttcaaccatattttagacactttaggcctaatgatctaaggcatatggtttttacccatggtctgtgggcccttgagaagctgagtcctctgaaagaaaatcagaatgttgcatgcatctgtattttttgtcttagatttcacttgattctcaaatggatccttgactcccccaaagtttaatttattcaacaaatcttttttttcctccatactttttattctgaaacatattcccccaatttttaacttctgaaaaatttcagacaagttattggaatagggtagtgagtatctatgaacctttcatataggtttactttaaaaaaaatacaagagacagggtcttgctctgtggcccaggctagagtgcaatgttgtgatcatagctcactgtggcttcaaacccctgggctcaggcgatcctccctcctcagcctcctgaatagctgagactacaggcatgcactgtcatgcctggctaattgtttaaatcttttttagagatgggatcttgctatgttgcccaggctggtcttgaactcttggcttcaagtgaacttcccaccttgacttcccaaggtgctgagattccaggcatgagccactacatctggcctgatgatgattgctaattgtaaattaaggcatgtggccccatagaaggttttgaatttggtgagctaattatctggtaaatttatcacgaagtaagttagtccactattgaaagaacctgtttttggccgggcacggtggctcacgcctgtaatcccagcactttgggaggccgaggcaggcggatcacgaggtcaggagatcgagaccatcctggctaacacggtgaaaccccgtctctactaaaaatataaaaaattagctgggcgtagtggcgggcgcctgtagtcccagctactcgggaggctgaggcaggagaatggcatgaaccctggaggcggagcttgcagtgagccgagattgcgccactgcactccagcctgggcgacagagccagactccgtctcaaagaaaaaaaaaaaagaaagaaagaacctgttttaggcagtgtggtcccttccccataaatagtcctggctgctcagggaggtgatgaactccccatcatggggagtattcaaggggtcactttccaaagaggccagaaacagggcctgcttcatgtgaggagttgcatatggctgttcctagctctgcccccttatgggctggcccgctgggatagcatctgccatgtggtccgccttctaggagctggtggagttttaccagcagaactctctaaaggattgcttcaagtctctggacaccaccttgcagttccccttcaaggagcctgaaaagagaaccatcagcaggccagcaggtaggaggtctcagactgggggcttacagcctcagccccttcccattgtggagggaaactttggggatgccattgacaccccttccaatggccttgcagaggtcatatctgtgcagtagcaggaacccctttccactcctgtctatcccttcctatatatattttaatataatataatttaattaattaatttatttattttttgagacagagtctcactctgttgcctaagctggagtgcagtggtgcgatcttagctccctgcaacctttgcctcccacctcttgggttcgagggattctcatgcctcagcctcaaaataaaaaaataaaaataaaaattccaaaccagtcttattttctggctgggtgcggtggctcatgcctgtaactccagcacttcgggaggccaaggtgggtggatcacttgaggttaggagttcaagaccagcctggccaacatggtgaaactccatctctactaaaaaaaaaaaacataaaaatcagccgggcatggtggcacaggcctgtaatccccgtgattcaggaggctgaggcaggagaatcacttgaacccaggaggcataggttgcagtgagctgagattgtgccaccgcactccagtctgggtgacagagagagactttatctcaaaaaaaaaaaaaagtgttattttctaaattcagacgggaggatgatgctgggagtacaattgtgtccccttacagtacagggcatctaatactctgcagaaaagagcactgaggagccctttatcctggagttactgtcctgagagcttgtgcccccagagagtgagtgggtatctgccccagacccttttctcacttctgttctctctccacagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggtgaggcaggcagggctgggtgacggggagggcatgggggttgagctggtggtggacgagactggaactggggactggagaaggtgaggtgcggctcccatggagatctctcacggtgggagggaaggaagggacacagggatgtcatttatgcatttatgcaacctacctgcatgtattcagcacctgctgtgtgcagacattgtgctgggtgtcgaggagacagaaacaagcacggtacaaggattgccctcatgaaacttataatcgaatgtggaggacagacctataaccaagcagtcatgacactgagtggtcaagactaacaagggtgccagtcacggtggctcatgcctgtaatcccagtgctttgggaggctgaggtgggaggatctcttgaggccacaaattcaaggcaagcctggctaaaatagtgagatcccacctctacataaataaaaataaaaacaaaaacattagttgggcgtggtagtgtgtcccaggtactcaggaagctgaggtgggaggattgcttgagtccaggagttggatgctgcagtgagctatgattgtgccactgcagcctgggtgacagaacaagaccctgtctttaaaaaaaagaagaaagaataaaagagattgtggtggagaatcacagggcagcgtgggagcactgagggagcccctgacccaccctaggagtggatcaggatgacttctgaaaggccaaactgattaataagggataaataaagtcatgcaaatgaaaaggttgtatatgtgttgggggaaagcattccagacagaaggaccagtgtgtgcaaaggccctggggtgagaggtgcctaatcagtactgaatatacaaagaggtagagctgggactaaaccactgtgctcactttgcctgcttgaattccgattccaaggagtggaatagacttcaaatgtcttcaagtccacttgtttctgccaagttctcatttttgttccatgaaggcagagcaccttctttatttcatccactgatgacttctcagcctctagaattctgccttatgatggatttctcagaaatatgtttgtgtaatgaagacaaggacagtggttagagtttacattctactggggaaaatatacacaaaaaatgatgtggataattgcatcgatgaggagttttgttaaaacattggagggtcagtttaatgagcagtggaggacaattaggctttgagagaggcttttggagcattgaggaaggattgggatgtaaaggattcatccatccatccatccatccatctatccatccatccatctatccatctatctatccacaaatcatccattcatctgtgcatccatccatcttagcctatgcatccatccatttcaacctacgcatctatccattcatccacccacccttccactcacgcatctatctaaccatctatccacctacccacccattaaaacattaatctatccattaatccaccatccagccaacatctattcatccatttctatctgtgcatccatccatctatccatgcatgcacccatctgttaatctatctctatatttatccatccatacacctactcaccagtccattaattcatccatccatccatccgaccaccatccactcacccttccaatcaccattcaccaacccaagtatccatccacccattcatctatctatctatctatctatctatctatctatctatctatccattcattatctatctacctatctatccacctacccatcaatccaataatccatccattcatctatccatccagccaaaaaatattcagtaagtatctactgtgtgccaggaactgttctaggctcttgggattcagtgacaaataatacagacaaaaatccctgctggccaggcgtggtggcttatgcctgtaatcccagcactttgggatgccaaggtgggtggatcagttgaggagaggagtttgagacccgcctggccaacatggcgaaaccctgtcttaactaaagatacaaaaaaattagctgggcattgtggcgtgcgcctctaatcccaggtactcgttaagctgaggcaggagaatcgcttgaacccaggaggcggaggctgtggtgagctgagatcgcgccactgcactccagcctgggcaacagagtaagactgtgtctcaaaaaaaaaaaaaattctgccttgtagagctcacattgcagttgcagggaggggaacagacaaaaagcttgtaaataagcaaatgatacataatgaatcagacggtgatatgtgctatagaaaaagataaagcaagacaaggggtccaggcacggtggctcatgcctgtaatcccagcactctgggaggccgagatgggcagatcaccggaggtcaggagtttgaaaccagcccggccaacatggtgaaaccccgtctctactaaaaatacaaaaaaattagccgggtgtggtggcaggcgcctgtaatcccagctactcgggatgctgaggcaggagaatcacttgaacccgggaggtggaggttgcaataagctgagattgcgccattgcactccagcctagggggcagagtgagactctgtctcaaaaaagaaaaaaaaaaaaaaaagaaaagaaaagaaaaagaaaaggggctaaggagtgttggggtgggtggagcttgcaattttgaatagtatggctaggaaggtcttgctgataaagtgccatttagggagggacttttaggaggtaatgggtgtgtgtgtgtgtgtgtgtggtcagccttgtgtacgttgggtgatgtgttttctgggatagacagaaggaagagcaggtgcaaaggccctgaggtgggagggagcctgcctggtgtgtggaggggcagtaggaggatgtgcagaggttgcactgatgaactcctcgtctgtttccaggttggctggttccctgccaactacgtggaggaagattattctgaatactgctgagccctggtgccttggcagagagacgagaaactccaggctctgagcccggcgtgggcaggcagcggagccaggggctgtgacagctcccggcgggtggagactttgggatggactggaggaggccagcgtccagctggcggtgctcccgggatgtgccctgacatggttaatttataacaccccgatttcctcttgggtcccctcaagcagacggggctcaagggggttacatttaataaaaggatgaagatggatagaa

SEQ ID NO: 2858 - DNA, 84699 bp, Homo sapiens; identical to SEQ ID NO: 2857
  source 1..84699: mol_type = genomic DNA

SEQ ID NO: 2859 - DNA, 84699 bp, Homo sapiens; identical to SEQ ID NO: 2857
  source 1..84699: mol_type = genomic DNA

SEQ ID NO: 2860 - DNA, 63495 bp, Homo sapiens
  source 1..63495: mol_type = genomic DNA
ttggtttgcataaagcatttatttacagcagtacttgcaacaaagtaagtgctatataagtatgagccatttttattaccataagcaaagctttctacattggttgacttgacaaacttctggcaaactttttttctctttggaaatcattcagcaggcactgtttacatcctttcgctgccatatctctagctttcactaaatctgccacacattcctgccttctctgttgacctcgcttggattctcctacatgcttccagttagccagccagaggattttcctgtctctgggaatcttgtggaaaatcttgcattttggggcaccttctccttcagttataatgatataccttaaaagttttacatttacaaatgtctatttcacactctcattctaaagtagaatcgatgatgaccttttctccccgttcagccccataaaaactcattttcccctcttttcttttcctcccagctcctagacttcctttggaggagtggcctaggtggtggggcccagggctgagtaactgatatttccaggagttccccgaagaaggcagggccagagggagagctgggaaggtggtgacattacaaagacaaatgcatgttatagatgaggcaacagcattatccaaggctgaggtggagagcccagcaggccagggccacatcgtggtggggtagggtctgattcacattgaggcagaggtgagtctccttccttctccttctgatgggttggtggagttacaagccagggaaggaaggaaagggtcccagatccagacttgctctttctgaaatccagggcttcccccagggactgggtcagccacctggggaatgagagtgggggtctgagctcaaacatggtgtagtgaaaaggacaccggaccatgactccaaaatctggtcctgtcctggtccacttctaagacggagtttcgctcttgttgtccaggttggagagtaacggcacgatctcagctcactgcaacctccacctcctgggttcaattcttctgcctcagcctcctgagtagctgggattacaggcttgcgccaccatgcccggctattttttttttttttttttttgtatttttaatagagacagggtttctccatgttggtcaggttggtctcgaactcccgacctcaggtgatccacctacctcgacctcccaaactgctgggattacaggcgtgagccaccgcgccgggcctgtcctggcccacttctagctagttatatatgcttgggtgagtcacgccctcctctgtcagttttcctgaatgaggggattgactcgtttagcaacttacaagtgttttctcccactgaagagcaagctggaccaatacgttctgcagctaaaatcaaacaagggtctctccctagacccttgtaaaataacaacagcaataataattaatgtacagaagtttcacaatgtaagttctccccccataaatatctccaaatcagtggtacctgctaccctgtatattagactataatacaaatggagtctgagtctgaaaacaactcatatctaataaatttaagattaagcgatatatatgctattctgcagtaaggaacgtggctttcagatgtttttccacctgaagaattctgagagacatggggccaggtggacaccaaggctcttgcagtgtgaagtctgattcctctctgggttttcagggaactacggatgcaggtgcaaggacacagcttccaggagttggggcagtcacgttcccactgactttaacattcctggtgactcagggaatgcggccgcattccccaaactcaagcactgatctgaagaagcctctgtgatccacctcgaagaacgcctttctgtaccggtcccgcacacctacagctcactctcacaaagaccccaccttggagtaaacggacagacgcttcccaccagctgggctgggctggctgcagagagcatgcacttgaagttgtatcactccgcccctgcctcacaggcaccttttgacttttgggtggtggagtgagaataagaaggcaccttaccctacatcacggaacccccaaacactctctctgactagccacccgagactgccccgctctcccttcccacactctggggtgcggcagcgctagctcttagccctgtgggtgaacagcggccttgcaaccacattgaggcggcagggagatcatgactcagccgctggggtctgaaaattcttctcctccatcccaccctgccagatggagaagatgcggctcactgcttctccagaccctctcccctggggagggggtgggggagcaggctctcggctactctcggtgatccgaggaggacagggagggctggctctcctgggcaggaggtaaggcactggcagggggaggacgaggtcggcaggtgcttttctgcaaactggggacaattcagtcctgctacatggatccgtggaaggagggcttccacctcaaccaaccccttagacccagggcgaggaactgtgagcttggtgacagggacagctgtcatattcttctgtgaggctgtttttgtctgtttttcctccttgggtctctcagcaggtgggttcgtgcctggtgctccagtgatgggaagaaaacccacctcaccacagctactgcccgtgagaatataaccagggcaatgggatgttggtgggcactgaagggggtggggtgggagctgtgggccgattatttatcgtgagtaggcaggagagggagaccccactaggcgctggacaagcggggcctgcagtggggggaggtgcaggtgtctctgtccctgaggaatggatgcatttctcctgtctgttccctcaacatcagtcagcagccacttaggcagcggtggaggcatctctgggcaaggccctgcctccagcctctgccctctgcccccacttgggtttctttgtcaaacaaacagcaactcctcatggctgaggtctcaagggaccggggaaaagcccgcaggaaaggggttaggttggacaggagagagaatgggctgggtggataggggaggtggcagaggaggggctgaaccccagacggggtgaggagggctgctgagtagccgccagccccgggcctggcacgtggccctggaggagcagccccacccaggcaccgccacaggctgtcctagtcaggagatctcattgccaaacacttcgagcacaaggggcgttagcttcatgctgcactcaggctggaaggagaggcagcggtactgcttggagtgctcctcattgaggctgcgcaggtcggctagcttctggatcatcttggcatagagcaggtggctgcccgggggcgggtggcggcagcggatgtacgtctgcagtgtgttggacaggcggtcctggatggcctcaatcagcgcggcgtcctgcaccccaggacgatctgtgggcacggggatagagaagaaggcacaggagctctcagctgggcccctcactgctcaatcccaccaccccccacccacacagacactcaacggcagcaccccctaggccacccctctatgactgctgaccggtgataccactgcctggccccaaagccctccagtgacttctccgtgcatttaggatccagacctaggtccttccatgggcgcacctggccctgtccctgcctggccttgctccctgtccatgctctgtccatccctcagcgtcccgatgcgccatgctctctggccaccagccttcacatctgtgctccctctgcttggaactctgctctgctatctttgccagactcttactgatcctttggataacagcttaaaaggtcttcctccaaaaggccattcctggcaacactctacctctgtagcccagaccacgtcagcttccctccttctattctacccttctgtagcatcacttactttatttttaaaactcttgccttgttaggaattaataattaaataacatttgtttaatgtttcctcctaagcttcatgggagaggagcctgtgtcccatttgctgctgaaccccagtacctagcatagtgcctggtacctaataggtgctcaataaattgttgctaagtggatgaatgaatgagagaaggctggctgggcaggggtagaggagcccatctccattccttgagcctccagtccaggaaagcatccctgggcacaggccactagcacaggctgaggcagggccgcccctctttggacctcatcaccgacatcatgtccccaaggtcacaataacttcctcttcggccttttctccctcttctcacctctaaccagcggaagaggtcaagggtcactgcacattgcctccaaaatcaatcaggtaaactatataggcagaaccatctctcaggctccaaagttttgtaccctgcccgcaagaaacctcaaataacaggaatgttgagcccagttcacgcaagagcagagcctgagtattgggaatgcgcaggcctgtctgtggccccaggaaccctgcttatctagttcctcagaatcccccctacgaatcgcctgcacactctgcaaggcagagctaagggcagtgaggggcacctcagcgtccacacaccacaggggctctgcaaaccagcaaagtaggtatttccttatctgtgtctccttttgctacgtctcccttcaggttgcccagctggccctcagcaggtctttgtccttcatactccccgctccccaggtccctgagctcctccctgcctggccccatacctggggagacgatgcagatggccatgagcaggacatgctcctcctcatgcaagttcagcttcttcagtcccacctggaacttgatgaggggctcaatcagctccaggctgtgtccggctgtgagagacaatggccaggtactgcgggcagagctgaggagccgcccacccacctccaaccccatgggtctgaccctcgcccttctctccctgttggtgcctaactccctcccatgtatctgattggagccaaaccccaggacgggtggagccagaatctgggagctgaaaaagactccccaggaggtggagtctaggcatacctttggtcacgtcactgacgcggtacttgtagtcttggttgccacaggtccaggacatgtcgtccatggtgaaggactcattggagcgcaacatgatgacctcaatggcacttgacttcagcagtacgatctggtcctcagaggtgaggtctctgcaggggagggagggaaggaggtcaggttaccagtaaacgccttcaagccacacaaatcagtttagtgctttgacaggtatacacctgctgggcaccaacatgcaccctgggtctttcatcgaggagcttgcaggctggctggaagggacaagagtgttccttgagagagaacagttcaacactgtgatcatgtgccaaggccagaagtgaagtagctcagttactaagacaagaaaaactcagagaccaagcagccagagctatggggcacaggaaacggagcccagggaagttcccagcattgaggcatgaatatggtggtctgcaaaaggtagggccatggtatcttcaacaacacccaagttttctcctcctctccctcctactgtcctccagtccttctcagtagtaaattcagccaactctgtctctaggatgtctctcaagcccgtgatcttattcccactcctaccaggagtgccctggttcagagctccagcgtcttttccaatagcctcttacaggaatcccagacttgtgtctctccagtctctcattcatctttcttaccactgctgcaggtcaatgtcctcttgcactcagaaatcttcactgactctcaaacaccctaggatcaggcccacactccctaacttggctccaacctctcattccaactccctttcccatggtaaactccaccaaccttccattctagcagcatcatgccactccacattcagatgctgtgtgttctcactgtgccttttttttttcttgtgacaggatctcactctgttgctgaggctggagtgcagtgttatgatcatagcatgctacagcctcaaactcctgggctcaagtgagtctcccacctcagccttccgaatagctaagactacaagcatgcgccaccatgctcagctaatttcttttattagtatttttagagacagtgtcctgttctgtcacacaagctggagtgcaacagaatgattatggcttactgcagcctcaaactcctgggctcaagcagtcctcctgcctcagcctcctaagtagctgggactacaggtgcacaccatcacgcctagctaattttttttgagacggagtctcactttgtcgcccaggctggagtgcagtggcgcgatctcggctcactgcaagcttcgcctcccaggttcacgccattctcctgcctcagcctcccgagtagctgggactacaggtgcccgccaccatggccagctaatttttttttgtatttttagtagagacgaggtttcacagtgttagccaggatggtctcgatctcctgaccttgtgatctgcctgcctaggcttcccaaagtgctgggattacaggtgtacgcctagctaatttttaaattttttttgtagggatggtgtctcactatgtggcccaggctggtctcaaattcctggcctcaagtgatcctctcatcttggcctctcaaagaaccagggttacaggtgtgagccactgcacccagccatcaccacgcctttcagcatactacagctccagccaggaatacccttctaattctccattttgtttttctggtcctgaatccactgtgttttccactggagccccgcaccttctgactctttagcacagttagggccatgtcattgtgatgccttgaacattgctggtgctcttattttgcccgtctcctccagttctgctctttacatgcttgttttctactcctttttttttttttttttttttttttttttgagacagagtcttgctctgttgcccaggctggagtgcagtggtgagatcttggctcactgcaacctccacctcccaggttcaagcaattctcctacctcagcctcctgagtagctgggattagaggcacctgccaccacactcagctaatttttgtatttttagtagagacggggtttcgccatgttggccaggctggtctcgaactcctgacctcagataatctgcctgcctcagcctcccaaggagctgggattacggcgtgagccactgcacccggccacttgttttctactcttgtttgtaagttacttgggggccagcacctcctcttaatcaccttactgttgcccacacactgaccattgagccgtcagcacaagatgatcaatagagatgcgttgatgatttgagaggccaatgactagttccactattctgagtcaggaatgggcttgtctgaacaatggcgaggaaaaggcagggctcacaaatcagcttgcttctggcttttactccctttctcttcctgactgtctacttcctcctggatatcctgcagataggctgtcaccccgtcaatggctgcatgtttatatataaagatgggaagctgatattaactgatgagagtgttgtatcaatgggtgatagatggtgggaaatgagaaggcttgcatgatcaggatggccagcaaaggatctgtattgaaaaaaaatcacaacgtgctagagttggagggcccctcttaggaactcttagagatggctcctacataacctctgcaggactctcctagggtcagggagctcagggcctctggacacagccatggggttgttagcgccgagattaatgacctcttctattgagctacaatccacgtgatagtacactcatttgtggtttacagttttgtgctcaataaacccagaaccagacttctccactagccatgggacttcctttgaaccataactaatggagttttttaaaaaggaaaactgccgtgtcctccttcagatagtctaatgacacaatgtctaacatctcaccatccttgtcacttttctctagatgctcaatccacatttaaaacacaaaaatgaacaccatccccatttttgttttgactcattatacaagtaaaacatactcattatcaaatctttggaaaatacataaaaatgtaaaaacaaattaaatttgctcataaccacacttcacattttggcgtattttcttcctatctttttttcttatttatttattttaattttttttttgagacagtcttgctctgtcacccaggctggagtgcagtggtgcaatctcggctcactgaaacctctgcctcccgggttcaggcaattctcctgtctcagcctgcggagaagctgggactacaggcatgtgccaccacacctggctaatttttctatttttagtagatatggggtttcaccatgttggccaggctgctcttgaatcctgacctcaagtgagtcctgcccaccttggcctcccaaagttctgggattataggtgtgagccaccgtgcctggcaccttcctgtcttttttctatgcaaatatatatatacccacaaatatacatagagagagggagtatacatttaacatactggagcttatactaattctttatcctacttcctatatcactcaaaattatttagcccagttcttagagggttgcatgatgttacatcataacagtatactctaagttattgagccagtcttccatttatctatttttgaacattttgattgcttccaatttttgctatcataggtaattctgggaggaataactttatacatagccttttgttcagtgccccactcaaacagatggccagcagtgaacacatcttccatggatgcaggccagagaggttttagtgggatcactgcttttgtgatccagacatcctgctgctaggaacacaaacccaaaacgaccccaaatgactgcccacagcctggaaatacagggcctttctaaatacagctcacagccaggaccagggatggtggcgtggtgggagtagaggtggagttacaggggaagccataagagagcttgttccacgatgataggcaccagcacagctccgttccccctccctcacctgtgtgacatttacaccctcctctgtcttcacgcctgcagccgcttctgggcacccgagatgtgactggaattgtgttgctgtttcgtctttcccacccccacaggcagagcccggcccctcccctcccctcccgcattcccacggtacctccagcaggcttgtagcagggctcttatctccttgcagcaattgtttacatgtctatctctttcatcagacaccaaatccctggatgccagggactgtcttctcaacaacttttgtccctcacagtttatgtaagaaagctatttgttggatggatgaagaaatgaatgtggagaaagggcacagcacgaaggaagcatgataacccccagggctcttccctaggtatggaaatggcaatgaaggtgaaggcatttagcagaagagggcagggctgcagcttatgtggcctggtctcttgtgtactttacttgtcagtgaagcctgggggtcccaagtcctcagatctaaggctgctcttggccatttagatgctgctgctgatgccacctcctccatgcatttcatttgcagtgccagcagggagggagatttgtggggtgagactgagaggctaagggaggagagatgggaggagagagcaggccaaggccacactgtagcacagttcacaccaagaacagcccatccagccctgccccacgttggtctcatgcccccactggagactcatcctgtgcccccacacacccacacagaagtctcatcctgccttccccacaccctccgcccctgcctgcaggcagcaagatcaaagccaccagggatgcagccactgttcttctatgtcttggaacaatagaacccctaagtgtggaaagcagcagaaccagagagctactgggctggcccaccctgggcccagttggagcctaggtttgggctccagtccaggctcagcatcacctctgtccagtcacagagagcgtccataccagtgtccctgcaagctctcttagcaaggcctgctccattttcattggcataccttctgctctgggacttctcaagtcatactgaagacagagaagccaaccctagcatgttcaggatcagtttaacccattttgcatcaatggctgggcagctcctgtacctgccatatgtacctcactttagccatgagttgcaaggacagactaggggacagaggagaacatgatgaaaggaagagggcagacttcaacttaacctcgggaagagaaactgagagtagtgctatttgtgtcagggtacatgtgggagggcaatggataggggccttgagcatgggagaaattggaggctggggttccttagtgaagggggcagcattggagtaatccgatttaatgagtaactttctttttagggcagctttcccgtgtatgcaatctcagccaccattggaatcactgaacctggaatcactgtatctggaaagggccgtgggggccctctgtcctactccccactagagcagggaaggatgaagcctgtgtagacaaggactgctgcctgacatgaggatggaagccgagtgcttctgtgttttttccctagctgtttacacaaaacaagactttggaatatgtggagtttgcaaacagtaacgtgaagcgtggaggagggagttggaacttgtgctctacggaatgtgttgtcagttccaaagaaagcctctgagggtaaaccctgggctcagagcaatgccgggctcacacaagatctgtcgcttgctcctgcttgcctgcctgccagaggggccctcgctcctatcactacaaccaaaatgtgcaatgcagtaggagtgtctcagcactgtctgccagttttctcttcttcaccattttcacattaattccaggggaagagcatcgaaaaatttctgttatttgggttggtgagaggcataaaataacacagagccagttttctcagggcagaaacaaactggaaagttctgggtttagctctgtgaatgaccatcatctcactggcaaggcattaatttcggcaataactcatggcttttctacacagctaagagggccatacaccaatatatggcacctcataatctgtttccatccagagccggcaatgttaactcattttccagctccccatattccagcactgaatctgagcattagtatctaggaagcattttgccccttctgccgtaaatacagctattgctgctacttgaaagacaataacattgcttgagattgatttacttctctttctcaaccatattgtttatgtattttatggcaatataccaaatgaactttggggaagaatgaagatacaaatatacataaatatagccatttcccaacacatctattaaatgtgtcaatactctattgttttaagaatattggccggcagtggctcatgcctgtaatcccagcactttgggaggccgagacaggcggatcacgaggtcaggagatcaagaccatcctggctaacacggtgaaaccctgtctctactaaaaatacaaaaaaattagccgggcgtagtggcgggcgcctgtcatcccagctactcgggagactgaggcaggagagtggcgtgaacccgggaggcggagcttgcagtgagccgagatcatgccactgcactccagcctaggcgacagagcgagactctgcctcaattaaaaaaaaaaaaaaaaagaatattggccgggcgtggtggttcatgcctgtaatcccagcactttgggaagctgaggctggcagatcacctgaggtcagtagttcaagaccagcctggccaagatggtgaaaccccaactctactactaaaaatacaaaactagccaggcgtggtggtgcgtgcctgtaatttctgctactcaggaggctgaggcaggagaattgcttgaacccaggaggcagaggttgcagtaagttgagatcgcgtcattgtactccggcctgggcaacaagagggaaactctgtctcaaaaaaaatacaaaaaattagccaggcatggtggcacgctcctgtagttccagctacttgggaggctgaagcaggagaattgcttgaacctggaaggcggaggttgcagtgagctgagatcgcgccattgcactccagcctaggtgaaaagagcgaaaccgtctcaaaaaagaaaaaaaaaattaacactgcatgagtatttaaatataagtattatatacagtactagtgttaaaacaatgaaacataggaataaatgaatgaaatttatatgaatgaattgataaaggaggatcccttctccagtagaactccttatacttatatattttggcaaaaatgtatcagtatggttaggaaatggtctttatttttttcttttttgagacagggtcttgctctgttgcccaggctggagtgcagtggtgaaatcatggatcactgtagccttgacctcctgggctcaagtgattctcctgcctcagcctccctagtaggtgggactacaggcatgtgcaaccacacctggctaatttataattttttttttttgtagagaagaggtctcactatgttgatcaggctggtctggaactcctgggctgaagcaatcctcctacctcagtctctcaaagtgttgggataggcatgtgccactgtgcccagccaggaaatggtctttaaatgtacattttggtgaaggatgccagggtcatatatgccagtaaacctatctctctccaggattcctagactgtttcacaagtctacatggccaagcccttctctctatcacttcattctgctctcagagttggggtgtggaggaatcatatcgttgaatttaaagagataatatgaggattccagtcaagccagctggagtgaacacagcagtgagctgggagttctaggcctggctctgacatgctggctccaacacctggaagggatcctggctggccattggacctctctgggcttccacaccatcatccagaaagtgcggggatggactagctctccagtgctggcctgcagagtaacgcaagacaggctgcactttctaaatacagatttctgggcctacgccagagattctgatttcgcaggtctagggtagggtctgaatctctattttaaagaagcaatggaggctggctgctgtggctcatgcccgtaatcccagcactttgggaggctgaggtgggtggatcacttgaggtcaggagtttgagacaagcctggccaacatggcgaaactccgtctctactaaaaataaaaaaattagggcagggcgcgatggctcatgcctgtaatcccagcactttgggagaccaaggtggttggatcacgaggtcaggtgatcgagagcagcctggccaacgtggtgaaaccccgtctctactaaaattataaaaattagccgggcttggtggcccacacctgtaatcccagctacttaggaggctgaggcaggagaatcacttgaacccgggaggcggaggttatagtgagccaagatagtgccactgcactccagcctgggcatcagagcgagaatctgtctggaaaaaaaataaaaataaataaataaataaataaataaataaattagccgggcgtggtgtctggtgcctgtaatcccagctacttgggaggttgaggcaggagaatcgcttgaacctaggaggcggaggttgcagtgagccgagatcgcgccactgcactccagcctgcgtgacagagcaagatgccgtttaaaaaaataaaaaataaaaaaaagaagtggtggatgagtgatctccaacccttcttgtagctcagtctaggactctgactctgttccccagagattgcagaagtttcttacctgaatcctggtatcatcttagcaaagccaatgaccttttggatgctgtaactgaccaggtcagccaggtggggcagcatggagagctgggacagctctagggtcacagaagggtcatctgaatcttcttcactcagatccagattggagaagctggacgagtccatcatgtctgggagagatgagggaagagaaggagctatttaaggatacttggaccaggccccctcctgccagaccctgcaaaaacctggtgtgccctggcagcagagccagctgggaatcccacagtgactccacaggtcacccttcagccccaggcttccctctgggactctctctgcctctttcagcagcataaggcagtaaaatcaaagagccagagacactcagagcaatgagacttcctcaagcagactgtgtgctgttcctatggatctcaatcaagaaagaatttgggacccatcaagtcatggaaaaaaatgttcaaccttgctaatggtcaaagaactgcagtgtagaacatctataattttcacctacaaaccagaaacaaaaatgtttaaatattgatgccagtatttataaagatgcaggaaattaggcaatgcctatgagggctggggtgctaaaggaggtgcacattactgaaggtactctagaaagctatttgacattagtcaaataattgtgtgtactctttgaccagtagtcacacttcctggaattcattgtaagggaaaatttccgataagtgtaaatatttggctacaagtatactgttttcttattaaaatgctgagaaataatccagatatccaatggtaggggattaggtacattattgtattccagaatactatgcagcccttaaaaattatattctggatgcgtactaactggtatggaaaaacaatgccatataaaaaaaagcaagtcatcagattgtatacagcacaatttcttttctaaatatacatatgtgttttttttaaaaaaaaaaaaaaaaagaaaggaaggaaagcatgatgcctcccagactctcagctgagctggaggggacaggtcctccagggccagagtggtccccagagctcaagtggaaggtggacctcaataggaccaacacgttcaccttcccactccaaatttcaccttctgaagggcccaggattaaaatatcacgtaaaggaagcaggtcacctccacggagggggccatgggctgaagcctggcttagaggaaacagcatgggcccgggaggctgatgctacacagctggaatcccagcttggcctcttccccagtgtgggcccttgggtaagtcacccctttctgtaacagaggggctgttgtgaagacgctgcatagcgcacagtatttatgtaagtttccattagggagccttccacctccttccatccagcagccccagggcaggtgcggtggactcctcgcccccgctcccttactctatggaggactgaagtcctgcttacctgaagaggtgatacagtgatctgagcaggaggaggaggagtccccagagaagctgggagtgtgtctggagttgggcctggaaggatggctccctccaccatcattcacacgaactggaggctggaagggaaagatggggtctcagacccacattttggggttgccttcctaccttggccctgatctctgataggaatggctttgaggaaggtctacaggaaggcgaagcctcccagtgccaggggcagagcagcctccgtccctaccccagttctgttcaggatgtcccctgccctctgtccctactccctgggccctggctccactagtgcttctcctctggaccggctcatcctcccagcaggcagacatacccggaactggcagaagtcggagtaggtggggtcgtaggtcttatggtgggcgtccagcagtatggcaatgatgcgctgctgctcctcagacagcttgggccgcagactgtccttcaaggcctcctcctccttccgcttcaggatcatctcccgcttcctctgcacttcctcatctgtcagaatgactgtggggtgggaaggggagtcaggagggctggccagcagctcctccaggaaaccttcctcctgcggttgggggtaaaggtccaagataggaggggctttaacactcggggctccctcgggggtcctcctgccacggagactcccactccactgtgtgaagaaaaattgggtttgctatggtgaaaaggaaggcacatgcaagaagaagaaaaagaggatttgagaggggggatgatctgggctttagggagtcggggttctcaagaacaagttgtgggaccttgggcaaactctctgggcttttgttcttttgtttgtaaaatgagagatttggaccatgtaagttcttccaaggttcctttcttgtaccttcctccataaagtgtgtgtgtgtgtgtctgtgtgtgttgacatgcaggtgggggaagtaataatacctgcctcaaaggatcaactgatttgagaactggatgcatgcctggcccagagcagatgctcactaaatgttagttctcttctcttccctaccctgatgttccatgatcctgaagaagatatcagggtgaagagaggatgccagagctctcatagcgctggaagtgagatgtggagaggactcctctatgtggctgtctccacatccaggtttccagacatgggactgtggaatatagaaagactagacctctttggttctctgcaaaaccacccctcctccagcatgtacagccttgacatttctgtccatggaagttttcaagtcctcttgaaggccccaaagggtgaggccttgcagctctaatcttagaagttctctccagccactaatcagggtgtggggccatagagagccccaccaccacctgcaggcttctgcctgcctccctgtgctggggcagctgtgggggtggaggggatgctgggagcaaaggtgcctggcacggcggctgggcaaacagacctcctggctgtggcttgctgagtgctgacggcaggagtgggcaccagggcctttggcctgtagctacttgcttggtgctgctgctgccagggcatctgcccacagaactggggagtttcacaagagcagagaaaggaaccagaagcccagggtgggtgagttccaggctttgagaaaggtccattggcccaggccctcaggtagggggaggacgagagaagttgctgtggggtgaggaagagcctatgctgggagggagtggacagccaatgccacaggcatggcaggaaagcgagcgctactgcaagagatggtgcttccctccacagggagcctgggagtagaccacacccaggtgactgactcacctgcccaaacagctgccaactctcctcccacagtgggtgtctgcacagaccctaccaggtcaggcagggtgggagaggaaggggcagggagcatccagggaaggcaatgggggtaagccctcgcttggggagcccaagattaggtgtcttgtctttcctgctcacctggggaccagagttagggagacctgtttctgccagccacaccatggtgtctacaggcacgtagctcagcctgactggactttgctaactttccagtgattctgtgatgccattctcctgcccagatacttttctcggcccctactgatgaccacgtccaaactaaagttggcctcttcctaactttcagacttcatgtcttagtgcttctggacacagcctctgttctgggcatgctggcattgctgctggcctgggaacatgacctgctcatgctcgcccctgcatttccagttgtgctaggtgcccgtccagctgggttttctctcccccaaacctgtatgagttctaccagttcttcagtgcctacatcatagccatctttttccatgaagcatttcttgattgccctgatctgcatcaagccttgtttttttctgctgagcctcatttcctatgcctgctacatatttagtctttcccacacacattgacacccaattatcttctgctctgtaagactcatggttagcacagttttcaattcattacctatagacggagcccaagaagttcaaggtctctttctctagattacaagttacttaagggcagggtccatgtcttacaattctttcttttctctcccttcctttcccttccttccttccttccttccttctttccttccttccttccttccttccttccttccttccttccttccttccttctttctttttctttctttctttctttctttctttctttctttctttctttctttctttctttctttcacagactctcgctctattatccaggctggagtgcagtggcaccacctcggctcactgcaacctccacctcccgggttctaagcgattctcctgcctcaggctacagagtacctgggcttataggcacatgccaccatgcctggccaatttttttgtatttttagtagagatggggtttcaccatgttggccaggctggtctcaaactcctgacctcaggtgatctgcccgccttggcctcccaaagtgctgggattacaggcgtgagctaccatgcccggcctttgtcttacaattcttatatttcccccataaaggctagaccggaggggctacctggccgtggtgtctgctcaatagtctgacaccaaatatcaaatgcatccacacagattacaccaactgtgtgcaaatcattttcctggttcaggaaaggctagtgagtactctagtgctgcttgtctcctgcaatgtagtgaatggcacctggcacaccagagagctgagaaagctgacctcttttattgaaacaattgttatggaaagattttcaagacagaaaaccttgtaacggaacacttttaacgtcatataacctttccctgatgattcagaggtatcattctgaataattactgaacattgcaggacaaggttacagcctcagagttgtcagaggctgtctgccccgcattgcatggcttggcgtgctgggctttggagttcttgggctgcttttcttgcttccagtgtccacctccctgttaaactatgcgttgtcttcttattggtgtctgcctctggatgtgtgcctttctcccccttaagacttacttctgatctcttgggagctagaagttctggtgatcaagtttgatgtaataaaaagaaaatattcgtaatgctggatggcacataaagagtttttctatctataaggcactattctgagagccttttgtatattaactcatatatttagccctcatgacaaccctttaaggcaggtgctgttgttattcccatttagcagatgagggagctgaggcccagagaggctttctacctttctcaaagtcacacagctaacagtggtgaaaccagcatttagacctgggcagtctggttctggagtggaaggtcataaccactagcctctactgtgtctgattacatctggttataagcggactttggctttcagccatggagttttgacaggcattgtgttccaatccatctgaagagtgtgaaaataaaattaagtcacaaagcttgtaaattacccactttaaagagacaaagaaagttcaagtttaaccctataacatgattcctcccagtcacttgcatcaaatagcaacctccatcttctatggaggtaacagaggaagaaatgctgagatctaccagtttcacacaggcccaatccatgagccttctgcaaggcaacattgcttgaggactgaataagtctaaagtctttcacatatgcaaatgcactgtgatttacgaaataatttgtttaaagatcttgttaatttcatgggaaatttcttatcattttttcaatggattgaacctaagatgtcattactatcatataggaagacactatatgatatatgaagccattgacctagaataagagtaaacaggttctgaaagagtgttgggctgtctggtgatcaggcgtctaaagtgcatgagttttggcatgtggactttgtaaaacctacatggctgctcagaagctttttttgacttcattttaagctccttgctgagtgtgaaataattttgcgcaagttattcccatgcaagacatgttctctccttaacgaagccaagatctgcaacataaacaatttgaaaacatttcaagatgccaaggatgggctaagaacaaccacaggaagaggacataaaatgtttccaaatgaacggcacagacatgatcaggtttgggagaatcttactgatctatagacctgtggaagatatacagagagaaagaagcataatgaggagctaatattcattgattccacacatttattgagcacctactatgtgccaggtactttactaacaccagggagaaaagacatacatctgtaaaaacatcaaacaagttaccacaatgtgtggttctgtgcaggacaggtaatagtataagcaaaaagcaagaactcagttataaaatttcttgggttcccagggtataaagtcaactaagaatggaaaagagagaaaatgagtctttggtgggaccaagctctcttcaatccatctcttagagcatgtgaaagtgcctggaaatgcacaatggagtgagctccgacccactggggccacgagaggctgcctcgggtgtggcccacaagcctgccctttggaagcagaaagacctagattagaatgaatgctgataccatcatcttattagctgagagccatgatattttaattcctctgagcttcctcagctattgaaaaaataaaagtatttacgtatttagggagtgttgtgagaatttcagaagaaaatgcatgtgcttgatgtgctatctgacacacagtagttggtcaatacacagggtttctgtcctcatcctttcccttcctgtgcctcttctatggaaggcccacctccttgctcggacagcaggagcctgggcttttagctttcttcctgtggttttacaaatattgagacactcaattgtctctgggatgctatgccttggggacaaaacccagcccagataagaaatgtgcagctctcccagggttctgaggccgggggacttcacactggtgaggcctcctgaagctggactaacctgaggctgggaatgtctcttcctggacagtcttcccttcaggaaagtaaaaagcatcaggacgtttctattttaactggatccccgctccaccagcccatctagaactgagtactgctccctgcactgggatgaggagggtggtgtggcgagaagctaccttgggcatacagcaggatggggacacaggactccacaggagagaattaggctggggtgggcgtggctgagggatggggtggacatcgcttctgggctgctgggttcccaccacgtggtagggtgctcctgggcagggccccctgatttaccccaggctggtgctgctcttcaccatggatgcagcgctgtttatggggaccaggaggcaggtaggaggggacatgaagtctgattctagtcccagcttggccaccaacttgctttctgaccccagacctgaggtctttacctctctgagtctcagatgttctttctattttaagtcagtaagacatcctcttcctcctgaggtaggagaggggcctcttgggcatcagtgagcttagtcctgaggggaactcctgtggcagtgccttacgaaccactgcagtggaacctcgtgccagtcttggttagctggagctttagaaaccggactccctgctttgcagaggctgtcttctctgcggagatgggactgtgctgagcacaccttgttggtgcccaccctaacgcctcaccctgagcagggcccactgagaatgtgtgtgaagcctcttaaggcacccgggcctccagcctccacttcttattctctccaggataaacacaggagccagggcgtggcagggactagggtaggagcgaccagcgtgcccaggcctgcaccctgtgatggtgtggagaaaccacagccctggaaacacctttcagggctgccagtgttggctggggagccgtcagatcaggagggaggagtcatgacccacagaagagaagcctaggtcaaggcccaaagaggaagcccagggtcagggcctcagctctgcctctgtgtcccaacaacagataatttttttcccattaacggagaaatttgctatcctctaagccctgttctgtgacttatcctctgtccctgacacatcttcctgttacctgacctctccccatccccaaccactccaaacggtcccatagccaggagggtccgcatctgagcaacatccccaccccgactccgactccgattcctcagacccacagctaggagggcctgggttctgtcctagggccgggtgggggtctggatgcagatggcagacaggagtgagcaagagaaggagaaaaaggaatgagtgtacagagagcacccatgcccagctggccttgctccagcccagagagggccaggctggcccctcccagcatctactgaattcaatgcctactctagttaccaaataactgtcctagagctctgatgcaaagttcaagtgttgttttcagtgatgggtcaaaatatccatgtaaatatgccatgttggtcttctccaaccccagagagggacaggaagtcctatagaatcactcctctttctccatctggattcagagggtcgtcctagaacccagtgcttcccctggcagactctttcctcctggtctctccctggcacaagccctcagatctgctcaaggcgccagagaggctgggaggctggggtgggacagaacgtggatgccaactatgctctgaatactaattctccccatcactcctgcccttcctaacccacatcagccctctcttcccaagcccatagaacctgggggtccttgaacctcattcttccctctaggtccgagtaacagggagctgtgaaaaaagaatgacatcctggaggaagaccctgacccaggagtagaagggactcttgaaggcagtgtccggcctctccttcctctcaggccccactctggagggacccttccagggcctctgacaccaacacacagatcctcaagaggtgcacagggccgctgagtgcatctgaccctggacttccagctgccctgtcaccagctgctggtcccactgaggccctggccccagatgctggcagctacagaggaagggcaggcagaccctctgcccaaacttgcaggagagtggccaaggcctttccctgactccacttcaggcccaaaccctgcccagcccctggacactcacactccttcatcatgccgatgtccacacagcgtttgagccggcaggcctggcagtggcgtcggttgtccttggtgatgcggcagtccccgttgaaggggcaggtgaatagtgccttccgcttcatgcttcgcctgccgagagagcacacaccctgccctgggtcactgaacttccggctcctcaccctgtcatcacggagacctgtcttctgggccccctggtctccatttctccaacagaagacatgaggcccaccccagctgccagtcactctcacctctaggctgggcaccaaacgattcctacttctcctttcattgcctgcccagctccaatcatggcttgtacttaccttttttcttttaatttttgtttcttttggggggacagggtgttgctttgtagcccaggctggaatgcagtggcatgatctcagctcactgcaggctggacctcctgggttcaagtaatcctcctgcttcagcctccagtatagctgggattacaggtgcataccaccatgcctggctaattttttgatttttttgtaaaaatggggtctcactatgttgcccaggctagtctggaactcctgggctgaagcaatcctctatcctaggcctcccacagtgctgggattacaggtgtgagccactgcactccgactcttttttttttttttttttgagacggagttttgctctgtcacccaggctggagtgcagtggctcactcagctcactgcaagctccacctcccgggttcacaccattctcctgcctcagcctccagagtagctgggactacaggcgcccgccaccactcctggctaatttttttttgtatttttagtagaaatggggtttcaccgtgttagccaggatggtctcgatctcctgacctcatgatccgcctgccttggcctcccaaagtgctgggattacaggcgtgagccatcgcgcacagccacgccccgactcttatacttattttacagtactctgttccccttcccattttaaaaaattaaacaggaaataacaaaagtgcatttccctagaaaaaacccttttttttttgagatggagtctcgctctgtcgcccaggctggagtgcagtgttgcgatctcagctcactgcaagctccacctcctgggttcatgccgttctcctgcctcagcctcccgagtagctgggactacaggcgcccaccaccgcacccggctaattctttgtattttcagtagagacggggtttcactgtggtctcgatctcctgacctcatgatccgcctgcctcggcctcccaaagtgctgggattacaggcgtaagccactgtgcctggccgaagaaacctttttaaatattgaaatctccagagtagccagcataataacatttaatgagccgctatgagaagtaaggatgctagtctcagcatgaagtcttctagattctagagacctgtgactggaatagctcctgttccagggatagatgtgtacatggaaggaagaaaaggcccaaaccatagctctagacatcccagaacctgcccagaaaaagaaggggccagacaagcaggtggaaatcctgaggcctggccttgggttttttgaaaggaagaggaagcaggagctctgtaggaacagaaaactagagctgggcacagtggctcaggcctgtaatcctagcactttgagaggctgaggtgggcggatcatctgaggtaaggagtttgagaccagcctggccaacatgccaaaactccgtctctactaaaaatacaaaaattagttggccatgatggtgcatgcctgtagtcccagctacttgggggctgggagctgaggcaggagagtcgtttgaacccaggaggtagaggttgcagtaggccaagatcatgccactgcactccagcctgggcaacagagcaagaccctgtctcaaaaaacaaaacaaaacaaaacaaaaaaaacccagaaaactactgaagtgttcttagctagaaaggtggcacccttgaggctgggtgtggtggctcaggcctgtaatcccagcactttgagaggccgaggtgggtggatcatgaggtcaggagtttgagaccagcctgaccaacatagtgaaaccccatctctactaaaaatacaaaaattagccgggcacggtggcacatgcctatagtccccgctactcgggaggctgaggcaggagaatcacttgaacttgggagacggccgtttcactgagccgagattgtgccactgcattctagcctaggcaacagaatgagactctgtctcaaaaaaaaaagaaagaaaagaaaaagaaaagtggcacccttgtagcctatgtaagttgtgtgtgtgtgtgtgtgtgtgcacaagtgtgcacatttaagggctcattttcctaattcgaacattctctcccactgccagccacaccacgtggactttgggaggctgcataaaggacacctccctgaggcacctccctagaggcttttcatcatccatgtcctgagagtcctgtcctcctcccagccccagcaggagtaggccccacttttctgacatagttagatggggaaagatggtggcagaatcactgtctgcatgagcagcagcatcttccaaggaactgctgagtgtgaagatgcccaagccttccaagccaaagcccaggcccaaccatttccttcctggagatgagctactgacgtcatctgctcaggggccaggcattagttaggattcttggtaaaacatgactcactgttcacattcactagaacatacatggggttgaggggaatcgcactcatcaattgtcaagcttgctctagcaaatggacagctggggaccacaccgactcagcccctgggatagagaagagaccagagtagggctctactggcagtcccaggcaggcccagactcttagatccacagagggcccaagagaccgtcagtgtaactccctccctttatacgtgggaccactgaggttaagaaacttacaggtgaggatattcagcaagaagtgcaggctcctaggtctggaagtcttagggatctaaggcttagcctttagcttcctggattgttttcaaccccagaaacttaaagtgctcagtgaagttgatgccccaaacagccccaggtggctcaatgccaagaatgacccaacagtcaaggaagcagctgctgttggttttggaccttggctctggtaccctgctgtgacaaccctcatcacccaaggggcctactgcagagccagggttgtcaggaggtggagcagcaccaggctatcaggggctccttagctccaagtctagcccgcctcaggcccagtcctaaccctgcagtagctaacaagaaagaagttatacgccaggcttttttccatcttcgtagaaacaaaaagccttttgccgttcacctctatttgtttactgctgcttttctggagggacaagagaatatggaagcatcttgggaactgttagggttccccagaaacgagatacaattatccccacagggacatctgtatgttccaggacatgagattggtgtccctcccaccaaccttgtggttcttgaggcttcatccgtcaccacaaatgctcaggcctcagaatgcccgtaattctctaaacttactcaaggaccagaagtttctatttcagaagaaactctcatttccttttttttttttttgtttttcaacaaccgggcatttcgctctggtcactgaggggctgctctgtcctcccactggctgtcttgtctggctcagagctcttcctgttaagcctgcaaggccatgggcaccaagaagacagcacatcgtcagcctagcccagccaccacctacagtgatgtgagccaaagcctctcaccagactgggcccgggactgagagcttcttgaggccccagggcctatcagaggccccgtctgtccttccccaggctccagggagcctgcctttgaccctcacttgggggcagcccccccagctgcagggttgcctgaaaagagattccactgcttcgccatctttctctcatttttctcatgtcactttaaatatgaagctccatctcagatgtctatacgcaggagggttggagattgccactcagccccactttgcctgacaacaggaatgaggctaggaataggaagagaaggccgggcgcggtggctcacacctgtaatcccagcactttgggaggccgagacaggcggatcgcgaggtcaggagatcgagaccattgtggctaacacggtgaaaccccatctctactaaaaatgcaaaacattagccgggcgtgttggcgggcgcctgtagtcccagctactcgggaggctgaggcaggagaatggcgtgaacccgggaggtggagcttgcagtgagctgagatcgtgccactacacttcagcctgggggacagagcgagactccatctcaaaaaaaaaaaaaaaaaaaaaaaaggaataggaagagaaaatagtgcagagctgaattaagagaaagtactgggactgggtgcagtggcgtgagcacgcctgtaagcccagcactttgggaggctgaggtgggcagatagcttaggctcaggagtttgagaccaacctggccaacatggtgaaaccctgtatctacaaaagattaaaaaaaattagccaggcatggtggcatgcgcctgtggtctcagctacttgggaggctaaggtggaaggatcgcttgagctggtgaggtcaaggctgcagtgaaccaagattgtgccactgcacttcagtgtgggtgacaaagtgagatcctgtctctagaaataaaaaataaaagagaaagtactgggggtaaaaaaaaagtttggcgcccttgcttctgcttaagagttgtcatatgaagcccgagaacactgaaaaggaagaggacaccattacgctctggagcgtggggtcagtgttcagggtatagaaagtttgctccccagctccaactgccagacccagaggctctctggaactcagatcccagagctggcctttcaggtgtgtctggcccaacatgtctgtttgctgggccacagatcctcttggctcagaggtcctgttcttccctgttctcctgccttccaagggcacttccacatgtgtggctgtcatttactctctgcccacgaggagtcagggcagccagactgcccaaccctggctctgtgctttgtcctgaaggtctacaccctaccctgccttcctcccaatactaattgcctgtgagctggtttggatttgagaaacaagagcttcaggtttccatgagagcccattgcctcagctgctctctgagcctggaccctgtcatcctctggttggttggcatttataccccagctcaggaagggggggtaggggtggggcaaccaagctaaatatagatgcagtttctagaaagccaggggtgagagaggacattgaccgattctcatgccagagaccagtttatcaaaacagaaagagacaaaaacctcacaaaagcatcaagagcctggggccagggcctcaggcctgggacagttgggcctttctccagtaggtggcctctgccagcagagacgcacgttgcataacccaggcgtagggtcaactatcccctctgggctccatctccactgcactgtcacagagattccagcgtctgctcaggatacaggaactagcgagagctcctgatctgaaagctatgtgaggtgctgggaatgcttactagtttgattatggtgatcatttcacaatgtatatgtatagcagaacatcgagttgtgcacctgaaatatagaccatgtctatctgtcaattataccccagcaaatctaaaggaataaaaagacctacatcaaatgatgtaggggcctacatgtatgtgagaggcagcatcagggggttctcctcaggtgggtttaaaaaaacattaaaggatggttagcactgtagaaaagagcacagacttttttttttggagggcaattggcaatgcgaagcatgttaaacacacagacattttaacgcagtaaagccacttccaggtatttatcctgtgggtagatcggtccatgggcgcaatggtggttactgcagctctgtctggagaagccaaagaccgaacctaaatgaccatgacagaggactggtttctttcttttctctttctttctctttctctttctttctttctttctttctttctttctttctttctttctttctttctttctttctttctttcctttctctctctctctctcttccttccttccttcctctctttctctctttctatctgtctgtctatctgtctttccttccttccttccttcttttctctctttctttcttttttttttttttctggatggaatttcactctgtcacccacgctggagtgcagcagcacgatctgggctcactgcaacctctggctcccaggttcaatcgattctcttgcttcagcctcccgagtagctggaattacaggcatgtgccaccacgcctggccaattttttgtattttcaatagagatggggtttcaccatgttggccagactggtctcgaactcctgacctcaaatgatccacccaccttggcctcccaaagtgctgggattacaggcatgagccaccgtgcccagccaggcactggtttcttatctcacagaacctccatataatactctgtgactatgaaaaagaaagaggaagaatgctgaaatgggaatgagcttgaagaagtgttctttagcagataaaaccaagatgcagaatggtgacgtgtgtgcacacacacatacacacacacacatatgcacttttacataaagaatctggaagcgaacacgatgagctggcaacagtgacagcttcctggaggaggtagggaactaagaattgggttgaataggtgatttacttttcacttacatatcctcttaaactgttggctttttaaaaagccatattatgacgttacatttaaaaaatccactacccactacaactacctaaacattaaaaatgaaatgcagtctttggttagatcgatatgtttgagtttaaatcttaaagcacaaccttgggcaagttacttaaccttcccatccattagtttccacatctgtaaaatgggagcaacatttcagagagggttgtaagaactaaataaaggaaaagggaacaggacctggacaaaggaaaccctaaataaagggaaagaagagaaactagcagaaagaggcagtgggagggagtgctgagagtgggtgaaagtagattttaaagtagattttaaacatctcattaagaatttgagacccctgaagcagacaccatgtcttaggcctgctctctgggtgcctagcatgggagcctgcaggcagcagagtttgaaaccatatttctgtttcatgtgctgtagctcctgatgtctagagccacagcccctgtgctagttacagcaaccactgtccagttctgttgagcaccagccagttctacccagcctttgaccgacatgaagctctctcagagcccctggcccagcccttccctcttcatacctgatatttaactccttctgtttaggaacctcttttcagagaccactgccaacacatcacatagttatactttccaagttccatggtagagaaaaggaagaaaggaccatctgtcctcaaaactaagacactaaaaagggataatgatactagctatcaccactggaagctttctaggtcagtattttacatactatctccaatgctctcgacaacctttgggtagatattatccctgttttacaagtgacacaaaaaggcacgggaaagttaaataacttgctttaagtcacagctagcaagtctgaaagctggaattagaatcaagaactgtttgactccaaggaatctgactgatatggtttggctctgtgtccccacccaaatcccatctcgaattgtaatccccatgtgtcgaaggaggggcctggtgggacatgattggatcatggggacagatttcccccttgctgttcttgtgatactgagtgagttctcacaagatctgatgtttttaaagtgtggcgcttcccccttcacttgctctctgtctctcctgctgccatgtaagacaggccttgcttcccctttaccttccgccatgattgtaagtttctgaggcctccccatccatgcagaaccatgagtcaattaaacctgttttctttttttttttttttttttttttttttttgagacggagtctcgctgtcgcccacgctggagtgcagtggcgcaatctcggctcactgcagcctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccacctgttttctttataaattactcagtcttgggtagttctttatagcagtgtgaatatggactaatacactgatcttcatatatactatggttctcatcaggaatgtaccatctctcaatccaagctagagcagcagtcaaaaacatgctttcccaaagtccaggagcatgaagcagaggctgtttgaaggactcctctaggacaaatccctctagggattcaggcagtctctagaaggatgctttggaagtgtggggtcacatctgaccatgctctccactggccctgtataacccaagcacagggaagatctcaagtgtgtgctgagtgcaaagtcatgcaaatgagccctgattagagtgctgaatttcaaaagaaataaaagaatgacaaaaaggtaatgtaaaatcctatccttgcagctgtctttcttgatagcttcagtgaccttccctctccaaatattttggcctcctctacccaagcttctgaacattactcttggaacatccatagataaccccactcattctctttcattcacatccttgaatatctgtgaatggaggtcagctgccaaagtggacctggacaaagtctctccagcaacactgacttcttggtcactcatttacttgtgcccatagaataccctgtgtggctgttcctcccttttttctctattttctctcctttaagcagtttaggttttaaattcctggacatctgccctatttctctgcttcctttcacatcaggttgctagaagagctacaaatatcagtggggtgaccttcctgaatgccagaacattcctcatcttcctggatcctcgccagcctaccttttgccccctgcactccgcatgacccataattaacaaagtcctcaagaaccttggagctaggaagcgaaaacgcacttctctgcactgtctttgttagcttgtagctgcacagagtccttatttaagcatcccaacagggaggaagaagacaagataagcaggcaaacgatgacctgtttctcatcttgccttccaggatcagctcttaaacctcaccatccaccttcattctcttcatcaaaggggttcctctgattttcttctctgtccattacaccttttcctttatatcagactccggacgaagccatccatgaccatatgcatccacatgcatatacatatatggatcatccactatatatgtcatttggaatagacctattccaaatgtttttcctcctctggctcttacttatgctttagttgttaacatatagccaagaggtgtctggccatctataagcctgcctgtgccaaccttatattcacactggaaatatcatctttctctgaggatgtccctgtattccagaataacaggaagcacaagcaacatgaaatagcttgcaggaggaattgaccagcaatggcctctaatgcctgatcatagatcaatagaactgtgatccctctctaaccttctaaccatcatcacacttcagctagattatgagtcttagactcgttttgatgataacaactagctcctagagcagtttagttaactatcttagaagccaaaccaaatactaaatggtcaaatgggattggattactggtctccagggcttggaaaagagctagtgacccaatattcaagcaatgctgtctgtcaataactatcaggaaatggtcaagcaagcttcttgagagcaaggacttggttcctgtcatctctgtgttcccaaggatgcaaggatgcagtacccaccacagagaaggtacagaccactgacattgtccttgcttcctgggatcagagtttcacaaacagatatgagtgaccacagggttctcaagcaactatttggaccagatcaaaatggaaaacttccaaataaaatttggatgaagcaaagaaggagaagcaggcatcaggggtggaagaagaggagaaatgatgtatgtatagctgattctcattattcatggtagttatggtctatagtcactgtggacactggattagtgaatattgaaacactgttcctggaggaaacacagggtgaggtttctgcaagcctctggtcacaaaattttcatcaactgatcaacacataaccttgtcttatgtgagttttctgtttaaagatatcttattcaatagatattgttggttgagttattaacattgatcaaacagccagcagcactgttgtcctcaggaagcttgtctaacacacatagtttccctgtgaggcacatcacggccttgcacttaggaacaccagacagcagtgcagcactacgcttgggaactgttttaaacagcaaagtcaccaataaaaatcaaaaaaaggcaaaaaatgtagcactaaatagattgtgaagaccctggctgggaagataggtgccaagtcatgtgaatttttcactgctctgcacatgttcacaaatgaccacaaaggggctgcaagtattgattttggtaaattttagcaagtgggcagatttgcaaatacagaatccatgaataatgaaggttgactgtgtgtgtgtgtgtgtgtgcatgtgtgtgtttgtttatgtacatatcaaacaaaattcagaaccttgcagctgtctttcttgacagcttcagtgaccttccctcaagtttctgaacattactcttgaacaatccatagataaccccactcattctctttcatccacatcctcaagcaaatgacagacatgttggctctttagaatgtagcagcctagcttagtcatcaagacagagacagtaaagatctaagtaaggtagactgaggacagggtaacaagacaaaaccagcctgcagcccatagtgccaggcattgcaggcagtggttgtgaccaacagccagcaacagactctaagggctcttgtcaaggtggactaagagtgggttaaggtggcatcatgtgcccacaagcaacacagccactctgtcagtctgtggtgacacagattacaaacataccatccttgttcattctgccatctttcacactcagcctggggcatgacaggacctgtcctctctccacccagatgcctcacatgctcctgtcctgaggattcccagcctagtggtgtgtccaagggcagcaactacagatgcatagcagtcagagccactccagtgaggaactggcctccaatgtgtcaccacccaaccagctgccacctaagattctcatttcccagagctgaatctcaggggggaggaggcctaggaggagagagtggatttgggggtagagactccataaccaaatgctttggttgcagactgacaagatatgaccttcggtgagaatctccatattgacaactcctagcccaatgccagattataaatgcagattgaagtctggtgacggaatgagtgaaagaaacacaaggccagacatggtggctcatgcctataatcctagaactttgggaggccaagatggaaggatcgcttgagcccaggagtttgagaccagcctgggcaacataaggaggccccatcactacaaaaaaatcacacaaacacacacacacacgaggaaagtggctggctggctggctgcgaggcttttgtttattttatgagagcatggttccatgaagggcagcagtggtgacccatcaggctcaaaaatctcagcttttttcatcagactgaaaaagtgtttttcaaagcacttttttacatgtcatctcattaatcctcagattaacactatgtagcagagggggtggatatcaatacatgcatgccattagttgagttaactaaaacctagatatgtcaaggacatccatttgagcaaggacatcccataaattattgccatggccagcaccccagaccatgcctttctgatgggtttcatggtagtaagcaggcgctgaggtgtgcgttagattcccctctcattagcactcaaggcagccccccaagttagaggacctggcaggaaagggtccatgtgtcacctgggacacacaactggggctctagaaggcccaccctgcaggatgtgtggacctcaggcccaaggattggcaaatgcagcaacacgacttagagccagcgatgctgcttgtctggttccccgagctggagagtaggctgccgggaagccaagcgggcagccagtgccaggccaaacaggcaattagcacccacagaaaccccactgcccagcaattgctcaaggccatgaaactctgggcctgctgattcctgaggcagagggcaggtgaatcaggagcttgtgttgacagagagaccccaagtccttgagtaagagtcccacacaagcgcctggacttgaattcactgtgcccccaaggcgaggagagcactccggtttagacaacaaccaagccgacctcagcatcctcctctggacttgatttgtgctttcctcatttgatggttagagccctgccatagccacctccagtctagaccgctagacagaagatctgttttggctgccttctttcaggctattctctctctctctctccaatacatgccaaatgctaatttctcatgattcccagttcctgccccaattcatccctttcccacgctcccaccctggctttgaatgggaacctccagtgcttttcccacacctttcacatctgtaatcctgggctcatgtaaggggagtgtgttggtaaagaaactggccctgatcaaacaggaatgcaggtacattcctgacactgcctggatgttccaaggttggctttcagaccaggacaaacagtccttgggtgaagatatgggtacagatcgtgatgacccgacaagaggtgccatttcccttgttccaaggaacagtttggattggatgggaaggcaagctctgaaaccaagttcttgggctttccccaaagacatgcctgtctcttgggtgaggaagctgtgatcatcaacagggaggaggttcactctggaaggatggacacgtgggttggtgtaggaggctgtgggttacaggcgtaatggaaagacagagacccacacagcaacctcaggaaagcgatttccaagagagtcagaggaacatctggagctgagaggagggaaaagaagataccactcaccaagaccctcctgctcctgtggctgtgagcgccgcatgttccatggacattgtaaggaaggagatgtgaaaaatgcaagggctcccttcatggaaacaccttgcttcttctccctccctttccactggggagagcctgggaggagggctcacctgaagaagcctttgcagccttcacaggtcatagcattgaagtgaaagccagtggctcggtctccacacaccccacagatccggggcacgttccggtcaaagtctccagggtcaggcagggaagtgctggccgccattgcctccatccctgtaagaacagcaagcaggccacggtcagagccagagtcagtgccagggccagctggcatccttggtgccacccacccccagcctcatcccaccgcccccaccccccaccaccagggagctcagcaagggtgggcatctccccagggcccaggcctgagcacagtgccttcggagccctcatacatgattcgccctacatagctggctcagagcatggcttggaatcagctgcctggtttcagatgttgcatctgtcaggttaatttgggtttagtggttcacctctgcatgcccccgctgtctgcattggaagaggtgttttacttccagggtgtaaggatcatatgcatgaacccattcatgctactggcactagctctgcctcaggcacagacctgaaccaggtcaggggcttctatcctgcccaacgccccctccaagggaaaatgagagtcctccctcagcctcagcacctacatgtggagagaaaccctcaggtctcctcctcttgagggtggggggaattgaggatttaggtgccctggtcattccagccccagctcctcacaaccataaagctcagggctaataggcttatgcccctggtgttcctgtaccaagacaatcaacatttcaagatatttcccccccctttttttggcaataacacttaaaacattattttgaatgtccttctgagtcatgtgagtcctatacaattaattgtgttttcagagatggtttttctaaacaggcattatcatctagagatggatttcatacttgaggaaaaggagaagagacagacggaacgaaagcccacagctttgggaaggccttctcaggaagcagctggcttgactctttcattagccaaaactgggcccccagctttgtctgctgcgtctgatcccgtctactgtcaggctcagagatgattctgggatacctcagactgccctgaaatgctttcagaccctactgcctcccagttctcccaattttatctgaatcctcaaaagggtcattacaggtttcagtgacccctttgaccctaggcaaagggtccttcttgtcagaagaaaaataagagagaaagccaggaaacaagagacaagaacccactccaccccagggtaccatttcctcctgcccttgggtgacagaggcagattctgggggcccttgggaggctctgagctacttttcaatgactaggcccatgatctctgatctagggtgtggaatatcaaagctcattaagtcttatttcaccttcataccacttcatggtgtagatgctattatcatcatcccctttacaaatgaggcccagagaggcccaaaccttaagatatgtctagaaaccactactgccaaatgaataaaacaaatactttctaaaaattccccaaagagcttcacaccaagggaaagaagtggtgcagataagcaagaatatgttatcatcagtcccaaagggacagagggaatcccggtcacagacctcggagattccctaacctcatttagcttttcttttcctggaaaccttaatgtattaggttggtgcaaaagtaattgtggttttggccatcaaaaataatggcaaagatcgcaattacttttgaactatcctaatagtaatagtgacactattgctaatttctttcacagctagatttatacttgctaaactctaatgtatatataatatatacattaaatatataaatacatattaatatatattatatattaatatatattaaatatataaatacatatttaatgtatatattaaattttagcagctacatatacattaaagtttagcaagtataaatatatacctatatataaagagagaagcactttcagaaagagaacaaagatcattgcagcgatagcaaagacacagaatcaacccaggtgcccatcaactctggactagataaagaaaatacagtatatgtgtgtgtgtgtgtatatatatatatatacacacacatatactgtcctttttacacacgtatactgtcctttttacacacatacactgtcctttttcctttgcagcaacatggatacagctggagaccattatcctaaggaaacaaagccagaaacagaaaacaaaatagcacatgttctcacttataagtgggaactaaacatcatgtacatatggacataaagatgagaacaatggacactgggaatacaagtggacaggggcaggggctgaaaaacaacctattgagtactatgctcgctacctgggagacaattcattcatactcaaaacctcagtatcttgcaatatacctttgtaacaaacctgcacaggtaccccctgaacctataagaaaagttcagaaaaaaagaacaaaggaatgattaacagaaacctttggagagatgagatcggggaggggtgtgcattatatagtagcagtattctattttttgagtagtgagcatatggtatcttcttcttattattattagcaaaacactacatctatgttttgtatatctgtgtttgcatgcccttctgaatatacaaaacgtttcataatttaaaaaacaattaaaaatagaaaaagtgcttgtggatctatcaacattgtccccaaagaccatcccaagtccaagctgatgcctgcaggttttagaacatagcacacattcaagatgtggccagcatcccggaggcccaatatcattgtggggtaataggggaaactgtccaggatgcttgtggcttaaccctgggtcagctgagatgctgcagctccgagtcatcgtggtgttgctacagagtctgggtcatccaggctcccaagtatccggtggatttcgtggaaaacagagaaatcaaatggggggtaggaaggaatatctgttaaatcagtcaacacatgttcagcatcacatggactcatttggagatgctatgatgcaagcgagtggaacaacatactaccacagcacagcaacggggcagtcctgcaatggggtggggtgctgccttgacatcaggaagtctctatgctgggggtgaaggctggaaaggctggatcaagcagccagaggcccacagtgaatgagaccatttcaggggagctgacagaagacccaaccctgcttgaggttatttgctgctatcaagaagccagcgcccaggaccagagtccacatgtggagatgtccaagcctctgtggcttgagagctgaaagtcccaggaatgacaggcagagactaaagaaggcagcaaagagaaagaggagatgggggctggataggaaacatcagacgcacaggagagcccagccagggtcgtggctggagccagcaagccccatctcctgagcccttctctgaactcccacccgcaccccacacactcatgcatctcagttgcagactctgctggcccgggacccaccttgcaaaatcctgggtggtatcccttccttcccctgcccaccaccttcttatgcccctcccccccaccccgccccttgaaaacagaaagccagggaagttgcggctgatgaggaaacacctacctgaaggagcagggggcaggtaagtggagcccaggggtgctcttctgtgaggtctcacagacacttcagacccaaaggcttctgaaatgaagaaggggaaaccttttatctaaggcggagcgctgaccgcctccccagtctctaaggaagtgggcacgagaggctctttccagggactttagtccccagatcagtgactgcaaacagaagtggcttgttgggagcaggcatgccatgtcatcgctggcaggggtgtgggggtggcggctgggcagcagccaggatggccctccctcgaggcagggagtagcaggagcagtgggaagcggtggcggcaaccagccccaggcagaaggaaacagcctcccgcctaggcactccttctcctctcacagcccagggtgtcaggagggaggaagggccttttcgttagggagacccacactctcactaccccctccatctccagattgtaggcagctcaggaagcagagcaactgggccatgtgtcctgctgctaagagcgggaagacggctgccccaggcagggcagaggaggtgccgcacaggagctgggaatggggcaggcttggatggcagcccacagccttggcctcttgggacagcttcaaaggcaggtgtctgagatctcctgtctgtggagaccgggtgtaggcggagcaggtgttgcaggggttaaatacagcaaagcattgctttcaaacaggatgttttctgccacttttagctcttccccagacatgctcaacacccccagctgcagtagggttgactctgctgcccagactctggatcttagcagctggctggggggccagcaaggagggatgggcagaatagtatcctttccacttccactcacacccggccctacttgtccacctgcagacatagacaaacagacagacacacacacacacaaacacacaaacacacacttctttccttctctgatgccaacaggaggtgaccctggcaaaggcctttaagtcagaccccagatggggtatgtctagaccccagcttttgtctttctttggagacctctgtcttccagtggcctaagcagggaagggggagagctcaaggggcttccaagacctgggcccggtcctagaactgtgagccgactgaggccacttgccaccccctccagtactgccagctcccagggagcatctgaggaaaacactagtggacaatgagccaagataacctaagctgggctggcccacccccacaagaagcatgggcagtgggaggtgtctgctgaggacaggcatgctgccacgtacccccaacccaggccctcctttgccccctctgctcctactgcccaagtccttcccagctgaccacgctctgcagggttcctcctctggccttattgattcctcaggctcctttcctggtgctcaggaaggtgaggtggggaccgggtggatgcagaaaggagcactgctttcctatcctcaatccctgtggttttcagaggtcagaggtgacatccagatagacaaccaccctggaacttaaaaaaaatgtttccggagtatttactacatgccaggcctgctaagctctgcatacattatttcatttagccctcacaacagttctgtgaggcagggagcagtcctacttgtagcaaagccaaatttcagagcactctgagtgacttacccagggtcccacagctaggcaagtggtggttcctggggccaaatgaggacaggctgattgtagtgcccaactgggtccttttgcaatgacaatcatcagagcagatgcctactgctccgcactgggccctgctccatggttttcctgtgtcctcactcacttcactctcataagagcctcctccagtgggtactttattgcccctatcttaggggtggaaactgaggcgcagggaaggtgattgtctttggagctggatttgaatctaggtagcttagctctgagtcatttctgcaaccctaagccgtggacacctttcacttccactaagtcaggagcaatgcagagaacaatccccaggtcatgagggaagaacctggggattgttcttttccttccaaggatccccaggccaagggatggcaggcctcagccaggttccatccactttctgtcacccagcccctctcatctgggaaaatcccattcaatagatgggcctctcctcctcactcgactttccaatagtggacggtccttttaggagagatatcctagattcagcctctaagtccaagtgcaagcctataggaaagtggggcaaagacataaggtggaaaggaggacaggtggaaaaactgcttaatacctgccctctgccacgtcacacgcccaccccaccagcaattcatgttctgagtacacagaacatcccactgcttttgctgggaccgtccccagagcaaccctctcctgaccctgctttagaaataccaaacccccagcactaagcttcagagaagcagagggggaggagctcaactctgtagaaagcccctggcttccatccctccagggcctgcatcccacatcaaaaaccctgcctgaccctgaccccagtgctgaccttgccttagcaagaaatgagaagataacacgtttccttccagtcactgaagccacaaccattgcctctcctacacgtctgcctgtcagcccacaccacaggcggccccatcttgcggcagcttctgttaaatgggcatccccggggccatctcgcctacggcagtcttgcagggtggcaattgccaggtgtcctgggcagagccctgggaggacaaaaatcaaagtccctcatggctcagtttaactccacattgactggaccctcctaagggtggtaaagctgtgactctgagaaggaccatggagtggacaagaagtctgaccgctaatgtcttttctagctctgagagcatgcaactccaagactggaattcccatcatgagaagcactatttttttttctttttaagagacaaggtctcctctgttacccaggctagagtgcagttgcacaatcacagctcactgcagcctctaattcctgggctcaagcaatcttccacctcagcttctcaagtagctggggttacaggtgtgagccacgccaggaaagaagaccttaaatgagatgaagctttctccctgatccctcattagccagatgaaccacaacattcatgcctcagtgagtgagactcactcatcctcagatgccaatgagcaggaagggcacaaaagatgtggcccctaatcgaccccaggagaggggtcctctctctgccaggttgggactggagtgatctaaactgggctttctaattgttgacattgttccaaagttcctactccttctagaaagaaatggaaagctaagctatttccccacagagtgggagacaattcttcttcttcctaaaattgccacacacagagtcaaccaagtgttgggcttttccaggagaagatatgcctgtgtgtccgccagccacaaccgcacatgtacttgtgcgtacacacccttgtcttgctatttttcgtttcatcatccattaaactctgccccatcgagtgctaagcactgcatgacctacctaactttttgtcttctctttattctggtgcataactcaggcataataatatcatggccagctaaggtgataccctctctttcttctccaccatccccaccatgtatccattttctttgtccagaacagtctcagtacctcccagaagaagctgacagagaacagagtgataataatggggagtggagagggtttactgtataaatagaacatatccaaactacttcctgccccgactgtctccccagctccttcatacacacatcttttaaatatgtgtaagaacgattggaaattattttctacagaccacaatgtccacagtaaaacccaagagataacattcagctctgaaaatctcaagattggaaggcaacagcaccacctagtccaatcatcttaaatttcttctatgatattctagccaaacagttttctagcccatgcttgaataattttcctagtggagaaccacctcccacggcaatccactctctttggatggctctatgcttagaaagctctgtatcatgcacagatggaacagcaccccatagctttcaatggctcctcctagatagctctttgtagccatgttagacaaagctactaggccattcgcacaggagctctagaggagggcttagggggccaccatatggtaccatatgcacattagaaaaaggagccctggccgggcgcggtggctcatgcctgtaatcccagcacttcgggaggccaaagtgggtggatcacttgaggtcaggagttcgagactagcctggctaacatggcgaaaccctgtctctactaaaaaaaagaaaaaatacaaaaattagccggctttggtggcgggtgcctgtaatcccagctactcaggaggctgaggcgggagaatctcttgaaccagggaggcagaggttgcagtgagcagagatcgcaccgttgtactccagcctgggcgacaagagtaaaactccgtctcaaaaaaaaaaaaaaaaaaacaaaggagaagaaaagaaaaattaaaaaggaaaaggatccctttttctaagactcttagacttttctaagacactaagccctaagacacttcacttccatcagtcagaaaattataaaaatagaacactctataatgcttatgttgtgagtgaagttgcaggggagaagcagcagaagatagcctgggttacacttaattttgatttagactccatcaaattcccaggtttgatcatgatccccacaagaagagtgagtaaggtggtagcacagacagcgtccacctttgtggcctgcacctggagagaacagtgtctgttctatggaaagggcccatggagcagtgtgagtgctgggtgtgctcccagcagggctgccacctcctctgtctgccacttggctctttccagaggaggctgggccccagcaacgcagctctaagaacctctaagaacatttaagaggctcaccagttatgactgactgaacgatgggaaattcagtggctgatgacacagtagttgtaggaaggagtttacccctgaagcttgttcttcattaacccttttgggactatgcatcacctttgagaacctgctaaaagccatggactgacaccccctgcagtatcagggtgtattagtctgttttcacgatgctgataaagacatacctgagactgggaagagaaagaggtttaactggaattacaattccacatggctgggcaggcctcagtatcatggcggaaggtgaaaggtacttcttacatggcagtggcaacggaaaaatacggaagaagcaaaagtggaaacccctgctaaacccatcagatctcataaggcttattcactatcatgagaatagcatgggaaaaactggcccccatgattcaattacctccccctgggtccctcccacaacacgtgggaattctgagggatacaattcaagttgagattcggtggggacgcagccaaaccatatcacagggctagtgggtcactccatggaaaccaggctacatactctcattcaccaaggctactctggggaactccagcagcttcttggagcgtggcaggactcagagtggggagcccatgaggcctcaggcagtggagcaggagatatatggcttacttagatagatttccacttcttatcaacaatttttcctgcaagctgcttttttccaatggaaactctgcccttagctttgtcaacaagatttctgggctgattactgctctccaggtaacaggcaggctatgcccgtcactgctggagagtggccggtgacgcataggggactggcccatttagaagctgcagttcaatctctctggttttacaactgaagaaacggaggccgtgaaagtagaaccatgggtatttagaggctgggatgggtagcagggaggggaagatggggagaggttggttaacaaataccaaattaaagctggacaggaagaatggattctggttttctgcaacactgcagggtgactctggttaactataatttaccttctattccccaaaagctaggaaagaagattttgaatgttcacaacacaaagaaatgataaatgtttggggcaatacataagcgaattgccctgatttgatcactgcacattgtgtacccatattgaaatatcactctgtattccatatgtacaattattatgtgtcaactacaaataaaaagaaaaaattctaagaaagtcaataaaaacaagagaggagaagtatactcccttactgcgtggccttggacatgtcacttcctctctgatggcctcagtctcttctcagtctcctctgaggtaatcagagaggaagtgacatatccaaggccacacagtaaggaagtatactttctcacctccagcctggccgagtccagtacccccaatcgcctgcctgagcagcttcagggcgaggatgtggtgtggggtaggaatgggccatggaagctggtgtgtactctccctttggggctgagagttccctgtaggaggcctgatgcagactgcagcaggtcctcccagcattgactacattcttacaatcaacacagagaaacaaaaatgttgctaggatcacccacatgctcctgcccgactaactccagctcctggcttcagctcccgtggccaaagacatgaacaagaactcaagacagggagtactttagaggaaagtgggatacgcctggcctgagctttctctactccaggtgggtcttcctgggacactagcatgggggtacttcccaaggatatctgctacagggaaaagttgatgagacaaggaggctatttgttcagtgacttggagaccaagaaatagaaactggggcatccccaaagggagagagtaggtccagcccttctttggggagacccaaactactgctagtgttagtgcagctgatggctaaatgggattttctctgaaaacaaaaacaaaaacaaaaaagcagctcaagacagcgggagaaagctgcttccaagccactcccaagcccagcttccagtgtgcctgtgtgcctccctccaggctaagcatctgtcttaacgctgggacccgcagcctgagtccacataggcctgagccacggttttttgttttttttttaattgcacatcactcctttattatactgatctggaaaaaggatttagtacagttatgctcaaatgaacactggacccatgtggcaggaccaagcaactagaacatgattcaaaaaatcagtgaaagacacatttggacaggaccaagaggcatttcactgccacgaaacaaggcggggagggattctaaaacacacagcaggaagcactcctgctcctcagaggtcaaggagcttatcccatattagtatgaggaatggcttattttctgacgaccacatgagggactatttcaactgccacgagaaaccccagaaaggttattgttttgtattttacatatatgtaatatgtattttatatatattatgtatgtaatatatattttatatatatatatatatataaatctaacacataaactaaattcaggattgatcccaaccttctagagccagctcctctggggtcagggaggaaacggttgtcacgtcaccaggcaggttacattcatcttccactggaatgactagagccccaaggcagtggcctgactgcagaagagcagaggactggctcctgggggcagacaggctgtcttgcttctcctcattggttatggcttagcacggttcctccccacaagtccttactaaacaaaacactcgcaaaaacccaagtcactacctttaaactctcttggataaggggagctttcccacagcttggactgagaacgtgtgccctagaagtgctattctgactagattgtatgaagggagtgggtgcaggagacaaaatggctaaaatgaaaatgggagccactggtccccatctgcagctacaactcaagatgtctacagatgtggtcagtgtgacatgtgcaggagggaggggcagagggacgcgatgggcagggagggtgctcctggggacagtggcctgcccaggcctgagccactcttgctcaggcaaacctctttgaggcccaacaacctacccctatccagggtggccaggcttattttccttattttccttctgggaccaacgtgatctctgagtcacgtagactcttccgcattgtgtcaaaggtcagtattcaaaccccaggtcctaccagctctgagatatttgggatccttgggatcagaccccttgcctttgtccagctacctgggccagcctgatgcccctggccacctgaccactgttcagatgcccccagagcccattcctgtctccttatctacaaacagggacatgataatacctgagtctcagttcttgtgtggggatcaaacgagctgatctctgagtagccctcagaagggtgcctggcacaccataagctttatgtgttaactattattattataactgtacctggctttagtataatcaatggagaatccaggaaaatgagaagaacttcaggcccgagagaggtgctgtgaagggcaggatgcctgcttctcagtcccaaaagctccaccccaaacaaacgttgcccagaaagccacaattttgctgagctgggaaaaaaactgaccaccccacccactgtctgtggcttctaaaactctttcaaaacttcttggggtgaggagaaatgagttgttctaatctctctcctaacagtcagagaagctgagctacaaatctggacttttcctccacgtaaaacataaagcctgtggctcccaagttgtcactgattaccacccttacagccatcatccttcctgtcccttctcatccagtgtcacctccatcccccacctcccccatcatcaagtgctgatcctgtacctgcatctgttctcactctagtgggacctgaagcttgactacctccaggatgccgatgccccgctgtctgttaccagggcagcggcaccaccaccacccacccccacccaccaccacctgaagcagaaagcagaactcaggagaaggctgaggtgggtgccgaggggctggagtcaggaggtggcagcgagaaccgtggaagccctggcagaagaatggccctgccatgccccttcacctagacatggggtgggctctggctcagtgggcctggacttctggctgccccagctcttgaaggcctgggaaggccattcacttatcctgggatagattctgaagcctgtgtcagaatcagggaaggatccccagggtcctctgagatgggcagggctgggctaactctccaccaggcagctccggtcccatgcacggctgatttgcccaaacgtaccgtctccatcttctaggttattagtgagggtggacacttcccctgtactgtgttcatgcagcttctcaggacctgggccacgtaggaagttcccactcactttcaagggcagcagcagtcaccccaaggtgacatcggctgctcctccatttctgattagaatgacttccccctaacaagcttttccagagctgtttggtcaggcttctggccatccttctgggtagggtccctcttcaggacacccctggagggccagggataggatgtggcggcatttcttcttggcctcacactgtggtggacattgactctggcctctgctgccttatctctgatagggtccctgcctatgtttaagtgccagccacatggaaaggcctgtactggaagtgagagacacagtggtgagcaagacatagaccctgtcctctaggagcttacagtctaccgcgggttggggggtggggatgggggacaaacaggaacctccaattcagtacgacacatcctacgatccaggtaagtgccaggtctagagggagcatatgcaagagcctctgcctcatcttggtgagaaaagagaagagaaggctctttggaggctgtcccctctcaacctctccacggagacaggaaggagcagaggagtttaatgtggtgtggtaagaggcgtaaggagcactccaggcagaggatactgcacatgcaaaagctgagagcgaaagggaaagaacatgtttgggacagagaaactcattcaatgtggctggagagagggagagggtgccaggaagagacgtaataactggccacactcatgtcaaaggcctgtaggaagtacattccactcttttctctgcttcttcaagttaaacccagtgagtcttgaatatcaggaatttttaattattgccacgatttattgaaactgaagagtttcagaccccattcagatccccattccaacctgaatccaccttgagtgttgtgacaacagggcctctctcattgtttcattgagacgttagctatgcacaggcctcttctgcagcacagctgaagtcccagcctgggtacacacaaagccactgtcccccacagtccttcagggagatccttaaccctgagaagaataggaccatcagtagtcgagctagaagggagaggtaaaggagagacctgaaaaattcagcctagctgaatagaaaaaaaaaaggttttgtgggagaaaatcaaaagaaagaacaaatgattcaataagggcagatggaagggaggttagtgaacaactcagctgccatatcaccagtgcaatccttacttaattcctcagtctgtccagggtggtcagatatggttgatgggcgcagagagaggtgagttgcccacagccgcaggatccccaaacctgcctccaccagtccactcagcccactcagcctactctgttctggtcaacaaggtcacttgctcattgccaggaattgtctaaggaagggcatcaggcaaaatacacgatgctcacaaacaacactcaccacagacgtgtgtggagcacctcacatgcagataggcacatgccagtccatatcctgagtctggctgtccaaactcactgctggccaacatgacacaagccttgccttaccctcagagctataattgaagataaccctcttggttcaacgtttcaggccaaatatcagaatctgtctggagttttcttccccagggccacaaagtggtaggaaacagctgtctctgttctaagccttgaaccctcaccaagctatgattccccttccccagccctacccatttgtcatctccctcttctttgtttttctttggtagccagggggcaaagacagaacagatttaaaccacagggtactttccataaatgctgccccaggacagaggaggagctaaactcagggtccctagaggagcaacttctttccctcctggtggttagctgtctgcagccccccagctgccctgagccaggcctgctgcccaccggatgtctgaaccagctggcagaagttccactctctgcactcaatactctttctggcagaggcaaacatccctcaagaaggaatctgatggactagctcagaacctagattcaattaaaagacttgtgggtgaaaccccatttcctctgactgggctgggccccacttgttcagctggagttgctgccaggtgggctgcagacaggtagcatcctagggaggatgtcagcagcggtggtccgtctccgcccctgggtgagatgcctcctgcttcccttcactcccctgcccttactttttccagaactccccctgacctgaaaaataattctgcagctaggctggtcagtagcccaggattgaagtttaacagagatgaaaataattcccccagtgagttattttctgcccagcttttggaacaatagctcagagtgacaggcagggtggggcgggggaggctggccttgggccactaactggggtcactatccatttagggcccttcccatgtccactcccttactcttgctggcaccagattttatagaggtgggaccctagtcaaggactcagactaactgcctgccacacctgcctccacctgtggatccacatggggcatgagggcggcaggacagggaaggcccgcgggagccaggagtttccatcctccgtggctacaactcttacagaatgcaaggaagaaggagaaaacactgcgactttaccaagcctccaaaaggagattctataagactgttgtgtcagctgagataaatatttcaaatgtgttataaaaattgttacactctaaaattacactctataaaaatactagctattgcattactattatttttccaggcatttaagaataggagaggaggaggaataaattcaggtaaaaaggggaaggctgtgaaaaaacaccttgaacgattgcatggagcatgatccattcattcgttgtctaccaagcccatccccaaactttctccttttttttgtgccttaagaccctatcctctgttagtttccttttgatttttctcacacaacttttcttctaatacctatgaggaaataccttcctgagaagacagagtatgggagggagagaaggaggaggggagaaaggaaaggaggggaaggtattcttggaatatcttactctgaaagctttctttctaactcacaaggaagaaacactctgtattataaagctattatcacattctgggaggggtaccttctagtacgttagtaaggaattctacaggaacagggtttttcctatcccactctataacagttacctgttaaaaaaaaactaccagaggatgcagtggagcctgcagggcagacctgactgtgatgtttgctgtttgccacccgtccttccccaacaccaacagtgattacacatttcattttttttaaattggctgtcaatgttttagaaatcaagagtttacatttttgaaaaaaaatctgaatgtccagctttctatgaaaaagtcagataatctggccacaccaggctgaagctcctgccggaagcctgctgggccgagaggggctgctcccatcaaccagcgtgtgctctccagtccatctcaccgggtctgcatccctccagcctcactcatgacccacctggccctggccccctgaccagcacacactgacagcagagctcacggttagaagtgcaggctctggaggcagctggcctgggtgtgcccaaccctgaattctccctaccactagctgtgcaacaagaaccaatgaaatgcactctctaagcttctgcttcctcacctgtgaaatgagaaaaataacaccacctactgcatagtctgtgaggagtccatgagataatcacgtcaagtgctcagcatagtgcctggcacgtagtacctgctcagtaaacgttagtgcttattattgcgcacaattactgcaatgactaaggagaattcatctgagttgcagcccagtttttgaagatgatttaatgacacaaagcaattgcccttcaaccctcctttcttgctcaggcacctggtctacagacaaaaccatctagtgagtatatctgtgacatgttagttattgtgtggagcaggggcacttcagagacaggattcagatctgttctcggggctcggagtagagtggggggaatggacgatgacagcactgacaggtggagttacgcacagagctctccccacaagccctgcccaggaccacgcaggagcttggcattcaggaggacctgggggtgggtctgactcttttctccttctccttctaggctccaaaccttcggggggctttgctaaaagacacccaacctcgaattagttccactccatttccagtttcccaggctgtgcacgtggtttcaacaaagccggtcagacctcaaatggagttcattataatggaattttacctgaggcagcccctcccccacttcttaacatcatggcacccaagatatgggtgtgcttgccaaagaggctgggcagaagtcacttcctgcccctggcagaagtccggaaattcagagccgtttggaacaaagaactctgccccgaaggtgttttccagcatctccctggccagattggaactgccccattcaccctcgtaccacctgctgcgttttttccagccctcctagacaggaaggggaggagggaagactgagctgaatgaccaggacactgcaggaaaggcaatgcacaagtgaggaagagaacatgcactctggacttaagcctgaatttaaattctggttctgatttagtagctcaatgtctttgggcaaggaatttagcctcttaatctctatgaaccttggtttcctcttctataaaatgggtataattttaccagcctcgtaggattattgagaggcataaatgagaaaatgcatgaaaagcactgaacatagtacctggaacatagtgagttatagtaaccattggttattatgattgtcagctattacataatatggtaacctcacaagggtcaaaggttggtatagaaagagacactgggtggaattggggtgaggggatggctggagaaggtagagccctgtccctgatcccagcacaggcctgggagccaaagtgaggcccagggcagaagcacctgcctgcccggagctgacaggcacagactggataggtaattacaaagttgagagctgaggtggcccatgcaactgtccagccagccacattcctttgtcccatgggtggatgggtggtgaatatctggctgtttatgtggctaccaggatggtgagtgtagttaacacctcttttccccagtagtcctagcagggtattcgaccttcaaagggaaagggattctctacaggcatttggctcctttccccatggcatcgcctctgttccctccactccaatcctccagctaccccttgcttctcaggttaaacaagtcaaaaggccaaagaacaaggccagactctgaagagatggccagtagagactactaaacttcaccccatctcactggagcccttaaatgatcaagaagcccaggacagacatgaatccatcactgccccagccctgtgtgctttgattagccagcaaactcatggttcttatacttccatgtccttttctcaaaactgatgcccaaggaaaatatatattcctccccaggtattaattgagcacatagtatgggctcactgctgacaccaggctcttggttgaactgaggagaccaccaagtgtttgggaggatgtagaaccgtgggatccctcaagcactgctggtggaagcccagagaggaagggcttcaactgtacttagaggcccagcacagagctctctctgagacatgtctcaggctgtgacatgtatgtggtcacctgtacagagtgcagcagacaggcacacacatgagccagaaattgggtccctaggtcatgaataatacaactattatagctaatcattataactgtagaaactcatctaatgcaactttttcattttagaaatgaagcctgtatcaagtgttgaaaaggatggagaacaatggagactttcatccactgctggaagtgttttttgggacaaccactttggaaagctgtttggcaccctatagcaatgctgaacatagaattccatgggaggcagcaattccaaccctaggtatgtgccctacagaaattcttgtgagtttctcatgaaccagaagacaagtataacatgtacacccctagcagtactgtcctatcgtaatagctcaactggaaacaacccaaatgtccatcagtgagaggaggatatacaaatcgtggtgtatttttccaatggaattctacacagcagtgcaaactcatgaactgcagtggtgtgcatcgacatggatgaacctcagaaaactcatattgactcaaagaagagtgcatcacagagaacacacaggtatgcgaacttcaaagccatgtgaaatgaaacaacatagtgttttgtaaaatctacatagatgataacttacaaagaaaagcaaggaaacaattaaccaaaattcactttggggtggggagtaaggaaggggaatgcaaatggggagaggcagagggggcttttaaggtgctgtgaatgctccactcttaacttaggtggtaggtacagggtataggattctttaatctatacataaacatataatcttgtgtatgtgatatatcgcggtttttaaaaatgaacaaaaaagaattgaagaacccaagttgcagagaagctaagtaaccttcacaagctcatcagctaacaaatgacagagaaaccaatttgccaaatctgagtttagtcaggtgccaggacagccattcctgagttctaaacgggcctctcacaaggacaggcttctgggctagaaattttgaaaagaagtgcaagagtctcttttttccccactgttaaattcccagtgtcttgactagtacctggcacaccgtaggctcttggcccatatctactgaatacacatgcctttcaagggcctactgtgtgccaggcacttgacttacatcatctaatcctcacacagtcctacaagggagctattactatacccagtttacaggtaaggacactgagatttggacagattaaataacttgcccaaggtcacaagctacaaagcgacctcgccaagatttgaacccaagagtctaactcagaccctgtgtttctcctgttctgccaggccactagcttctaacagcactacctaaaattttagtcatctaccaaggaaccctgagacccacagggggtggggcaggctgagcattttctcttcctgcgacctctgtctccaggctctgacaaagcggtttgtatggccaggcccagggctggcaagccgtgtaaagcagtggttacaggctgactctgcagccttgggcaggtggctgcatctctttagaccttggtttccccactatgcctgctagagaacataactgtacttaccccaaagagaagctatgaggattgagggaggcaagcaaagcaatgtgcacggggcctggcatgaggctatcagaggaggctagagtccatttctccgtccagctgggctaggttcaggagcccttaagggatagccaggagagggaaaaggtaggcaaagtgagaatagctccccattggccaatgggacaatcagcacatagtaggttttcaataaagatgcctgtttgaaagattgtttcctatttgccttccagactattagagtcatatttgattccacacaatttctctgcacaatcctacctctgttgggttcttgttcttaaccagagtaaggtgcccaagactgccagagaggcatgaagatctaaaagtgctggcagagggagcctccttctgagaggccactgtccccagagtaacctttgggcagtccaagcctgttctcaggtcaacttgttcaaactagttagtacatctaacctctcagctcataaacatttactgcgggtgtataatgtacaagacagggcactaagtgccctgtggccatcccatgaatgcagaggtgggagagttccatgcaggttaagagcatgggcttctgcaaacctgagagggagtcgtgggtttcctcctcacaggctatgacagcttggcatgttgattaacctcacagagactccatttcctcatttgtaaagggaacataactggttcctacctcacaagacctagtgataggtctgggaggcacgtagcacagcacctgttaccaagtgagtgctcagtaagtagctgaagctacaactccagtaccagcaggtggcacacactggatgtgtcaccagcaaagcctcgggcctcatgggtattccacagtgcctggaatgtcccaccttgcataacacctccaagctccaggttgtcatcagaaggccagtgagaggcagcagcttctcaggaaccaactgccgagtctgcacagactccgctttcccgccggtgcagctgcccacaccctgcttaggaccaggactctcccctgtgcagaatgaggactttgtatggcatctggttctgggaacaccacttagtctattccctggcacaggacctgcagggcaggtttgcaaaagcatgacacacattccaactcacagagtactgactgcttctgccttccactcctgctattcaccaaccagacacccccatcctctcccagccagccttggggtggggcggtctcaccacctaccccccttgcccacaagtcacttcaaagacatgacttcccaagagatcttcacttgcacttttcatttgttggcagtgagaatgacttccttcctggcagagtaactgagagtcactacatggtcatcgtggcggctctgctccctccacgcctatgcccgatcacccacaggctggacctctggggatcccaccctttgcatctggaccatgaggacccaggacccagaaggcaggacagtttctcttccacatgtcgccacagcgggatgcaggcactgccatcaacgcctgtcacttggattgagcaagaacagcctctccccaccctggaccatttccccaatagtcagaccagaccaaagaggcaaactctagtgtctttgggaactgactctgtctcctgcaatgcagcttctccctggctttggcctccactttgcttttcatttccccggaacctgattataggtgacctatgtcctttatcagagtgggcgaggtttgcctacccttgccttcctggctgcttacctgctttacagccagactttctgtgggatagtgtggtccccagaggtctgggaagctggatgagcaaaatgtggaggctgtagatatggaggaagagggaagaggaaacgtgaggcccagtcttggctccactatgaaccccaatttccccaggggaagctgaagaggagttggcagaccttcctgtccctgtctgaggttggggtggggcaggaaaaccaaaggtgaggccagtcacaagtcaagggtgaagggaagtcacacgagtggtgggctgggtcccaggacagggtggccgggagcagtgccgccccagggaaaagacgagaattggctgataacaccagggagcaggctagggtgtcgggggctgtcctcagaattaagctacccctgttttcccttgagcattaagcctcccccaaccttatcatcccctcatcactgctgtgacctctgctgagtttggagtgatgatcactagggtgattaatattccatttttccctggaaagtttgggtttatgtccattgtcctggtataaccatgcatggcatcccctttcactctcagaagtatcccagtttgcaagatacattacacaggcactctttctagcatatctaggagggcactgacacaggaaaaggttagggacaaatcagagggaagcaaaatgacaagcaaggccttggtggcccagagtggcagccaggctggcttcagcccagctggatcctctcagaactggacaatagtggagggagagcctgagaactgctgcccaccctggggctcaaactgtcttggagtcaggggcctggtctggtgggttctgcttcctgctatccctcagagggcctggagtcatgctgggcacacaagaggctcttaatcaaatctggtcaattccttatttccctctacctgcatccaaaacagaattgcagcagggacaaatggaagctggagccctgtaattctttattcagcaacacaccaaatgtcatctaggtggtcctcccgtctctggctctctggcccctaggacctgactgctgcacaggcaacagcgagtttctagcagaggttccagatgcctattccagccaggacagcggtgcctccttaggatgtggggtaaggaatgaaacaatgggaactccctttcgtgtcttagataaccacctgatgtagtagccacctgatgtagcccactcggtcccaggcctttctccattcacagcctgggctttggacacctgctatctgttctgggggtagagtgtaggggttcaggaggtcctctcggagcttcctctggggcttagttacaaaagagatcagttttgaggtcaaataggggaagaatactgagaaaccataaacacaaactatcagggcaccccaaacagcacccgaccttccataatgtttatacaaacaaagtctgatggcctctgccgaagaggagtaaagggttgggaaggctttctaactctcattttttcccctcctttcttaccccattttctagtccctcctttagcttggtaagggtccaagtcacagctgatcaagaccagccaaacccaaagccatgggacccagccagagcatagactgtgaattccccagctttttgcagtttgagtcagccccacagctggattggcctcccaggactcttctcaaataggtccagagaggctgctgagtgggggccacggactctgcagggagggctacttctgttcaacgatctctagcacccaaaacaaaagccagggagaaatgtgcagtcttactaccttctggtctggctgcatgccagccctgagactgtttcagaaagactcacagttccctccagcacttggacagggaagggacggcaggtctctcaacacacaacactcttagtccatagaattgaggctccaatgttcagataacccatttctacctcagcaaatcaccctcactccctagcctgagttaaagccttctttgccaacaccatgacttctctggccccagactttcctaatttcttttgctcacccccttcactagcagagatgggctgctaatgagaccactaggcagaaatggaaggaagggctggaaaagcctgcagtgctgggatgcacctccttatcccaggagaaagatgagatgtagatttatcataaagccactatcccttcacggtcacctcctgctagaatcatctcatagccattccataagcactgctgtgttgggtatctgagcccctgcccatgaggaagaccaccttccagcagggagctggagcagagctgaactctgcccaggagagcttctgcaatgctcagaaaatgcctgcccaactgcttgcctgggctctggcccctttggctgcaactgagcccagacaggaggctgactcactcaccgcacgcatagaggaggaggaggaacaagaggaggaggaggaggaggaggagaaggaggaggaactgtgagaagggtctgggcttggagacctaaggctcccccagcccaggctaggtctcagactctggtccctgggtgaagagaaggaggggcagttgtacactggccctggagaccacaggctgttccctcctagatacttctgaatcttcctcaccaccacccacagatccagggcacctcacttttcaaacagaaactactccttgagccccttcctcatttaaatgcttgcccctgagttcctctgaacatctattgacaggctgtcctgaaaaaaaatagggccaattaggtctaaactcattggtagttcaaagaaaagtaaaaaaaaaaaaaaaaaaaaaaaaattacttaaaagacccaactccaccatcacaggtgaccatacctgggccctgtaagacaataaataaggttacacaccctccactccagcagttctgagcaccatcgacagccaatcgctccttttcttattcctccactccatgccaaggcgccccgacagaagaaggaaacaaatacttcttgttgcccaagtgctaagcactgtgttagcggagcatttctcctaagcgccgaggatgtcgctgctcccctcgccagcctggcacgaacttcagctttctcaaacctcagtgccccttagtgtcccagcctcatggcacgacagcccggacctcagtagccaagtttaccgctgagacttagactctaatgctcgcagccgggcgctcaggccccggtatcccagacgccccgaccccgagtccctatcctgagaccccctttcccgctgctcccgggttcgcacctggtccggccggcgggtggacaagctgttccgcgctcccggcgcacacggctccgctgccgccttttgacaagcag

SEQ ID NO: 2861 - DNA, 63495 bp, Homo sapiens; identical to SEQ ID NO: 2860
  source 1..63495: mol_type = genomic DNA

SEQ ID NO: 2862 - DNA, 63495 bp, Homo sapiens; identical to SEQ ID NO: 2860
  source 1..63495: mol_type = genomic DNA

SEQ ID NO: 2863 - DNA, 16278 bp, Homo sapiens
  source 1..16278: mol_type = genomic DNA
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaaggtaagcggtcgtgccctgctggcgccgcgggccgctgcgagcgcctctcccggctggggacgtgcgtgcgagcgcgcgcgtgggggctccgtgccccacgcgggtccatgggcaccaggcgtgcggcgtccccctctgtcgtcttaggtgcagggggagggggcgcgcgcgctaggtgggagggtacccggagagaggctcaccgcccacgcgggccctgcccacccaccggagtcaccgcacgtacgatctgggccgaccagccgagggcgggagccggaggaggaggccgagggggctgggcttgcgttgccgctgccggctgaagtttgctcccggccgctggtcccggacgaactggaagtctgagcagcgggggcgggagccagagaccagtgggcagggggtgctcggaccttggaccgcgggagggcagagagcgtggagggggcagggcgcaggagggagagggggcttgctgtcactgccactcggtctcttcagccctcgccgcgagtttgggaaaagttttggggtggattgctgcggggaccccccctccctgctgggccacctgcgccgcgccaaccccgcccgtccccgctcgcgtcccgctcggtgcccgccctcccccgcccggccgggtgcgcgcggcgcggagccgattacatcagcccgggcctggccggccgcgtgttcccggagcctcggctgcccgaatggggagcccagagtggcgagcggcacccctccccccgccagccctccgcgggaaggtgacctctcgaggtagccccagcccggggatccagagaaccatccctaccccttcctactgtctccagaccctacctctgcccagtgctaggaggaatttcctgacgccccttctcttcacccatttcctttttagcctggagagaagcccctgtcaccccgcttattttcatttctctctgcggagaagatccatctaacccctttctggccccagagtccagggaaaggatgatcactgtcagaagtcgtggcgcgggagcccactgggcgctttgtcacattccaccgaaagtcccgacttggtgacagtgtgcttcccttccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgacgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgctccctggccttggaaggggtatgaaatttccgtcccctttcctccttggggcccaggaggagtggagggtcccgggagaatattgtcagggggaaggcagggggtgtcatgggaatgggtgagggggctgaggtgcagaatccagggggtccctgcaggagccgcagtggtaagctgtccagctggaagcctggtaactgttgttttctcttgagaggggcttcctgtgaccttggctgtctctgggagcagggctggggtacctgagtggggtgcatttggggtgtgtgggaaggagagggaaagaaagatggacagtgggactctcccctagcagggtctggtgttccgtaggctagagtgcccctctgctctgcgagtgctgggcgggaggggagttggtgagagctggagacccccaggaagggctggcagaagcctttccttttgggtgctgtcaggtccgcatgtcttggcgtgttgaccttcacagcttctggcgaggggaggaatgatctgatgcgggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtgaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggttgtgtcctgttcgactcagaagacttggagaagccagaggctgttggtgggagggaagtgaggagggaggaggggctgggtggctgggcctgtgcaccccagcccctgcccatgcccatgccttgctctctttctgtcctcagtggtcccaggctgcacccatggcagaaggaggagggcagaatcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtgacccttcctgtgtgagctggaggcacagagggctcagcctaatgggatctctcctcccttccctggtttgcattcctttgggggtggagaaaaccccatttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggagggaaggccctggggtcttccttcccgcgagtttccctgacctaaatctggcgtggctgggtagtggccagcagtggtgatgcccagcctgttctgcctcctccttccccaccccaggagccctttccttggcctaggacctggcttctcagccactgaccggccccctgcttccagtgcgccacttaccccttccagcttcccagtggtctctggtctgggagaggcaggacaaaggtctttgtttgctggagaaaaggttgtctgcgataaataaggaaaaccacgaaagcctggttgttggagtgtacgtgtgtgctcccccaggcagtggaggccagccctccttggaggggcggctgcctgatgaaggatgcgggtgaggttccccgcctccacctcccatgggacttggggattcattccaaggggaagctttttgggggaattcctaccccaggtctttttaccctcagttaccaaccccttgcccaggccagaccttcctgctatcccctcctgggccacaagcctggccctcctctgtcccaattgtgatgaaggggcagttcaaaacttcttgattagtcatcttctcccctatcgacttggctttaaaaaatgaccttttcagacttctagtctcgttcactctttttgatgatgctttgccgtaacccttcgtgggtagagaaggattctgtgcccattggtggtctggataaaagaaatagagacctcacaggaagcagtggactggcctgtttccccactgttctttctgttttcacacctgtggccttctccccaccttcttcccaatcaacctattgtgtacatagcccccctcattgtcctttattcttctggaaagcagaccttggagggaggagtgagggggaggctcagctgtggtctctggggggtgggggttgggagctggggtggaagtccacgaagcatacacttaagatgctttggtgaagttctaaacttcatattacccaggctgaaaaaagagcacttgttcctagggctggaaatggaagccaaaacaccacctttttcagcctgtttcagcatctttagagatcagcccaacccacttacacagttgagcagagttggaggcctagagaggggagggactggcccaaggtcataccaactcatggccagagcctgggcctcctcactggccaggtgttatttcttccctctgggtagggaacctatttcagggacaggattgctatgtggtagtggtggtggggtgcgataggcgtggcaggctgggccacaatttggagtagtcatgccagagtcctgcatttatttattctcaagggccccgcctctgtggcccagaattaccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagcctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataataaatgctgtttttactgtgattattattgttgttatccctatcattatcatcaccatcttaacccttccctgttttgctcttttctctctccctacccattgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccttccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcacttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgtgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacagtgggaggggacatggggaatggagatggtccctcaccttcctggggcctcctgctctacgctaccccctcgggagcctcctgtccccagggcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaa

SEQ ID NO: 2864 - DNA, 16278 bp, Homo sapiens; identical to SEQ ID NO: 2863
  source 1..16278: mol_type = genomic DNA

SEQ ID NO: 2865 - DNA, 16278 bp, Homo sapiens; identical to SEQ ID NO: 2863
  source 1..16278: mol_type = genomic DNA

SEQ ID NO: 2866 - DNA, 16278 bp, Homo sapiens; identical to SEQ ID NO: 2863
  source 1..16278: mol_type = genomic DNA

SEQ ID NO: 2867 - DNA, 16278 bp, Homo sapiens; identical to SEQ ID NO: 2863
  source 1..16278: mol_type = genomic DNA

SEQ ID NO: 2868 - DNA, 16278 bp, Homo sapiens; identical to SEQ ID NO: 2863
  source 1..16278: mol_type = genomic DNA

SEQ ID NO: 2869 - DNA, 16278 bp, Homo sapiens; identical to SEQ ID NO: 2863
  source 1..16278: mol_type = genomic DNA

SEQ ID NO: 2870 - DNA, 16278 bp, Homo sapiens; identical to SEQ ID NO: 2863
  source 1..16278: mol_type = genomic DNA

SEQ ID NO: 2871 - DNA, 16278 bp, Homo sapiens; identical to SEQ ID NO: 2863
  source 1..16278: mol_type = genomic DNA

SEQ ID NO: 2872 - DNA, 16278 bp, Homo sapiens; identical to SEQ ID NO: 2863
  source 1..16278: mol_type = genomic DNA

SEQ ID NO: 2873 - DNA, 16278 bp, Homo sapiens; identical to SEQ ID NO: 2863
  source 1..16278: mol_type = genomic DNA

SEQ ID NO: 2874 - DNA, 16278 bp, Homo sapiens; identical to SEQ ID NO: 2863
  source 1..16278: mol_type = genomic DNA

SEQ ID NO: 2875 - DNA, 16278 bp, Homo sapiens; identical to SEQ ID NO: 2863
  source 1..16278: mol_type = genomic DNA

SEQ ID NO: 2876 - DNA, 16278 bp, Homo sapiens; identical to SEQ ID NO: 2863
  source 1..16278: mol_type = genomic DNA

SEQ ID NO: 2877 - DNA, 16278 bp, Homo sapiens; identical to SEQ ID NO: 2863
  source 1..16278: mol_type = genomic DNA

SEQ ID NO: 2878 - DNA, 16278 bp, Homo sapiens; identical to SEQ ID NO: 2863
  source 1..16278: mol_type = genomic DNA

SEQ ID NO: 2879 - DNA, 16278 bp, Homo sapiens; identical to SEQ ID NO: 2863
  source 1..16278: mol_type = genomic DNA

SEQ ID NO: 2880 - DNA, 16278 bp, Homo sapiens; identical to SEQ ID NO: 2863
  source 1..16278: mol_type = genomic DNA

SEQ ID NO: 2881 - DNA, 67560 bp, Homo sapiens
  source 1..67560: mol_type = genomic DNA
tttgggtactagtaatactattttactgaaaatctggagttgcacaaatagttctttagaacataaaactaaatggatttatacataacagttacattcagcatttaagagaggcagtacaaaaatgtgttctgcttttatctgatataaattgcatgtaataccatgatttaaacaatatcagttatattaactaatgccatgagatatatcttactcagaacgtctgatgtttcccataatagacagaaaaaatgcagttgtatgagcaactgagtttcttttcatcttcaaattcatttgtgatggtgggaagatctaaggacaatccttccattgaagaagtaggaaaaacagttacagcactgttctgaactcatcaaaaatgaaattaggcacatgtgcttcagcaacctgaaaaattaaagaattaaattattcatggtgttatagttgaacaattacaaaattttcatacgtaaaagaaaagatatccttggagcaaggtgaataatagaagaggagactcccatgggcggacgactccttgaaacagcccctttctgcttgtggtgccccctagactagcgtctcatttcttggcactgctaacatttgaggggatgcagtacagctctcccgcctccaaatctgagcttcttggctcttaaaggtaccttgatctgcgaggaatgttcttgcctctgggaagtactgacaagtactcaggtcacctaatacacttcattaactgatgaccaacaaggaagaacaggatggctggcaagtgatggggttggagaggtaggggagggcaggaatgagaatgagataccaaggccagaaggggaagagcaggaaggccttcagaggcatgcattcctgaactgttcttgggcaaagccctgagaagactaaattgggctcagttgggtagaatgtagaggtaggtgatctccaagtgctggagatgagtattttttagaagcagtgtttaattttttttctgatcataaaggtataacctgctaatgagaggaaatttagcaaatgcagaagagtataaaaattatttttacagtgggtggagggcaaggggagggagagcattagtataaatacctaatacatgtgaggcttaaaacctaggctgggcgtggtggctcacgcctgtaatcctggcactttgggaggctgaggtgggtggatcatgaggtcaggagttcaagaccagcctgactaacatggagaaatcccatctctactgaaaataaaaaaatcagcagggcgtggtggtacgcatctgtaatcacagctactcaggaggctgaggcaggagaatcacttgaaccagggaggcggaggctgtagtgagcccagatctcactactgcactccagcctggcgacagatggcacatgtataatacctatgtaacaaacctgcacattctgcacgtgtagcccagagcttaaaatttaaaaaaatatttttttaatcttaatcccttaaagaaaataaaaactggcaacttttgtaatgaatttttccagtttacttacatatgcagacagacacacacacacacacacacacacaatcaaaattaggatcacataatattgtgtccttctctacctctgctaaatcttatattatgaacatccttgggcacatatcttggtaaacctttgcacatatatccagcaggtaaaattcctagcagtggaattgctgggatcagggtaagtatattacaaatgtttttttaaaatagataaagctaaattgccctcctcaaaggctgtcaatttacattccaattaatagcacttacaagtcccatttctccaaatgcttccgaataatgggggcccaacattttacctttcaccaacctgataagtggaaacagtaattttcgtatttggatttttgtcccttgaatccgaaggtttgtcatttctattttcttgaaaactgcctcttaatttcctttgcccttcccctgctttttttctattggcttggacatctttttcatactgaacttgaagatttgaagagcacactataaatcaagaaactagtcctttgttggtatttcctcttttgtcttttgttttttaactgagacactgacacagaattaattacattcagcatttataaaaaatcaagtctctaaatctttttctttatagtttcttcttttggttttatacttaggaatttctgagagctgatacatatttgcctaaaatttcggctaatttatttgtttcatatttcacactaaccctttatctgtaattaattttgataacataggagatgtaaaggggactaagttgctatttttttaactgtgtgaacttacatctattgactaatattccctttctctcttaatttgagatgctacttttccttatgtaccattgtatgcacagggtgtgtttctaggctacatattcttgctcattgttccttctatttagttgcataccagtagcaccctattttggtttctacagttttacagtgttttaatacttgatataatattttaatatcttttttttaaaaaaggacttgcctaagtcctatgacattttaaaaaatatattctttgaagttaaaaaagtacctgaaatcttgattgtaactgcagtaaacctataaactagatagaactattatctctgtaatattcgaggaccctcattcagaaacatggactttcaaattttatatttaaaatttttatagttttttaataaagtgttctttcatatttcttatagaggttattcttagctatatcattgccttgttatttctgtgaataggtcctttttcacactgtattttttaatcgattgatgtatttcatacatttattctgtagccagcttgttttctgatctctgtattattttgatagtttttcacatgattctattgggtattcaaggaagacagttatgcagcaatcccactactgggtaactacccagaggaaaagaagtcattattcaaaaaagatacctgcacatgcatgtttacagcagtacaatttacaattgcaaaatcgtggaaccaacctaagtgtccatcaatcaatgagtggataaagaaattgtgatatatacatacgatggaatgctacgcagccataaaaaagaatgaattaacagcatttgcagtgacccggatgagactggagattattcttacaagtgaagtaactcaggaatggaaaaccaaacatcgtatattcctactgatatgtgggagctaagctatgaggacgcaaaggcataagaattatacaatggactttggggacttggagggaagaatgggaggggagtgaggataaaatactacaaatatggtgcagtgtatactgctcaggtgatgggtgcatcaaaatctcacaaatcaccactaaagaacttactcatgtaaccaaataccacctgtatcccaataacttatggaaaaatagaataaaaaaggaagacaattaatctcaaataatacagagtttgtcttctttccaatatgcattttattttcatttcatttcttattgtcttgcacctgtataacaaaagtagttgcaagagtctgtatagttgtcatgacactgtgacagtcctggctttaatgggaatgccactaacatttcactattatgtactgacattgctagttaattttaaaagttcatctttggctcatgttgtaagaaagtatctttgattcctaacctactaatttctaaaaatcaaatgattttcagtatctgctgaaagttgtatttttcagtatcaagctctccactttgagctaaaatttaacaaagtggaattactaatgagaaagggataggaaagaatgtcttggcaggtaaaaagtagtctgccatttttggaaacagtgctcatatatacatttagttgtggcatgaacttaactgtgcttgctgtgggaaccaggtcagtggagagagaaagaacaaaccaccatgattatttctttcctctggccacttaaggaatccctcctggcttgcctatttcacttaactcctgaaccagatgagttgctgacaggagtacatggtggagaggaagaagaggcgggaggggcattgtgttaaactctgcaaggcaattcccatggtggaaaaggcaaggacatttcagagctgggggtagagcagtggcgagaggcgcagaggcatctactgtgaacgacctattgggcttcactcctgatgaatccagggccactattattagcatctttttacaactattaatattgttctttactatctatcacttaccctcctgggtagctttgtgtaccgaacataatcctccaggaacagaagggcacccacaacatctgcaggaatttcaggtatcttctggctgtgatagagaacagtttagatcaattaactgctttgcacatcataagcccttttggtcagaatcctgaaagactaaattaccaacagattacctaatgaagtcaaagatgaacaaaaacattgagcatgctcttaattcctgtcaagttgttaccttgctcatgtattttcaggagcccaccccatagggtaaatgtgagcttctctatacggtttccatgggcgtttacaacacgatccctgctatctatccagactcatctccctctgtttacatgattcaatacctagcaggtcccatactttcccatccctgcacacttttttttttttttttttgcgacagacttttcactcttgtagccaggctggagtgcagtggtatgatctcggctcactgcaacctccgcctcccgggttcaagtgattctccagcctcagcctcccgactggctgggattacagatgcacgccagcatgcctggctaattttttgtatttttagtagagacggggtttcaccatgttggccaggctggtcttgaactcctgacctcaggtgatccacccgccctggcctcccaaagtgttgggattacaggcgtgagccaccgcacctggcctgcacactgatttgaaagtaaacttctagacattgttcgagtctcagcttgggtacttctcctgtggaatcctccctgattctcctgggctgtcataatagttagcagcattctccaagcctcttaatttttcaatggtgtgctgggttcccatcaggagtataaactcctcgagggcctaggtcatatgttcatctttgtttctccagcatctggaaatgtgcttggcatgtactgcatatttgacggtatcaaataaatacagcatctagcaatttttcatatgggattttactcatgtattcattcattcagcaactacagtgccaagcactgttccagagctgggaatacagcaaagtacatgccaggctccttatagagctaacgttccttcttgtttacatcaaaaggagtttttaggtgttaaaacgatttccaattcctgtaccaattggcattttctgattaacaaataacttttagtactattaatacattactggttaatttcgctgatgaactttgctttttgaatgggttaagaatgactgtacctggaaaaattctccctgctctcaatctttcaatctgtgaccagggctatatttgctctgcttggagcaagagaaaggaaggaattcccatgcgtcacaggttccttagattcctttgctctgctgaatcagaaagcctgacttacagctggtctcctgtagcctgatcaccaccctcagggttgccaataacatgctggactagagccacacttaagcctttactgccattagtgaaaaagaaagagaggaagaagaacctgtccaagttgacagctagggagctacaattgggacagccagttgtgtggaggttacttgctaatcacctccgcaccacctgaactggagtccttcccctcctctctgggagcctgggccagaggcgctgggtttttatgagcctactgctttccttgccaactgacctcacttcgtgattgttacaatttcatttttgagactttgagttctcctctatttttcaattgttaaaaaatcttgtttctgaagcaagtcttaacatctatcccaggaaaacaccagtgtttgttgttcgattcattaactaagaggaggaggagctggcctgactgcagctcacgggaaataacgacattggggtttagaaagaatgcaaaatcagtaggagccactggtatgcactggatgtcaagaaacccatcactgcaaagccgagatcacgccactgcactccaacctgggcgacagagcgactctttctcataaaaaaaaaaaaaaaaaaaaaaaaaaggactcatcactgcaattgtagctgctgtactgtccacagagggcccagaatgaagacgtgtaatactcctctgtgccaaggggagggctgtgcttggaatctcaatacaagtttgggaagccacattttaagatggtcaaaaacagactggaacacccagaaaaagtcactcactatggtgagcagcctctaaactgcaagacatcgggaacaggtggaaggggcttatctaaacattgagaagacctaagacaacagatggcatacaaaatcggaagtgatgttgcaaaggagggagactgcattattctgtatgatttcaaaaggtaggaaaaagctcagcgagtgaaacatccagagacacaggttctaataatcacaatcaggaactttctaatgagaacaagacttagccagtggactgtgctgcctggagaggtagcacaagccccctcggtgagagtgttccagcagtggctgcatgactacctgtcaaggatgtcctagagctcattcatgcacttagtgggaggtcaattaaatgacctcgaaaatcatttccagttttaggacttagtagtattttgtgtggacttagaagatcactttggttcgttttattttttttgagatggagtctcgctctgtcacccaggctggagtgcagtggcatgatctcagctcactgcacctctgaggcctcctgggttcaagcaatcctcctgcctcagcctcctgagtagctgggattacaggtggccaccactacatgtggttaatttttgtgtttttttagtagagatggggtttcaccatgttggccaggctggtcctgaactcctgacctcaagtaatctacccaaagtgttgggattacaggcttgagccactgtgcccagccgctttgattcgttttttacattatagtggcaaaaatgaccaagcaaacatgacagcaaaggttatgtagccaggctgaccctttaggatagcagagaaggaggcacaggacccagcatctcatggaaataacttttttttctttatcccagaaaagccacatttaggggcaggggaaaagaactggcaggaattaaagttttataagcattgtatcaaatagcaactcttgtgaaatttgcttctctacatgcagacactgcccaggctttgacacactgatatgttctctgactcccactgaagtgagtggaatcatctcttggcagtggcccagcaggagtgcaggggctcgctgagattgaagagctgcatccaagagtgcagaggaacagggctgcactttcttccccatggtagttactattcatggtcctgagtcactcctggaaaatcaatgtgagtagaccggatggagttcccctggcagggtgactaaggatggacacacctgtaattgctctaaacaaggaggtatgccctgacttgctttacagagaagggtgagcaaccatttcccatctctattagggcgataagaggaatttggtaatgtgaggtttaagttaggttttgtgacaagaagtcccacgtagtcctggttggtcttctgtaccttgtacactgctccaccgtggagcagataaactggccaatcagcgccaggaactgctcggtgtaccgggaatggaactgcttcagcagagtgagcagtcccaggacaagtggtggccaatcaaccgggtcggtcggttttcggcagaccattcctgcaagggaacaagttgcaacaccatatgaagtacttgccttcagcaacattcattaaataccaacgctgtgaaggtcaaaatgtttggggcccatattctcgctggcagatgatattttggagggaatgacaattctgggccatattttgaattagccacaggattggtagggcattccaggggtctgaaggattcaaaaccaataaaacggttactaaattttgtaattatcattactggttcttttgaattactcaattaacatatattattgtagcaatttttaaagatacagataaatgtaaatgagaaaaaaaatcactacaactgacttctgttaacggcagcatgacatactagataccctgaactactatcttaagtgaaaagctggataaaatacttttagggtatctttaaacaaatgttgagtaatatatatacataaagaatctgcagaaatcaagagagtggaagaaggatatttatgaagtgaatgagtatcaaagctggcctttacactaacgattttttaaaaattggagatggggtcttgctatgttgcccaggctggagtgcagtggctattcgcaggtgcaatcacagcacattatagccttgaattccagggctcaagctgggactataggtgtgtaccactgcacctggctctacactaaagatttctgccaaaatgtggagaccctgacctctgcctgggtggctgcatgggaaaccagagacagagattagggtcttccagaagaaacacaatgttgaaaaagaacagtgttgggaaggtttaggttgcctgatttcaagctctctatacagtttcaataattaagacactatggcataagaacagacaaatagatcaatggaacagaatagagtctagagatagtcccacccttctatgagtaattgaatagtcacaaatataccaaataataaaaaaagataaatcttttaacaaatggtactgaaactggatagtcttatgggggaacgacaaaccttgacccctatctcatactgtacacaaaaaacaattagagatgaaccactggcctcaatgtaaaagcaaagactacagaactgtaagaaaaaatatcgaagatatctttgtgaccttgaagaaggcagagatttcttttttttttttttgagacggagctcactatgtcacctaggctggagggcagtggcacaatctcggctcactgcaacctctgcctcccaggttctagcgattctcctgcctcagcctcccaagtagctgggattacaggcgtgtgccaccacgtctggctaatttttgtgtttttagtagagacgggtttcactatgttgaccaggctggtctcaaactcctgacctcaggtgatcctctcgtctcagcctcccaaaatgctgggattacaggcatgggccactgtgcctggcctggcagagatttcttagacaagacaaaaaagaataattataaaggaaaaaaatggataaactggacaccatcaacagtaaaaacttctgctcattaaagttaccagtaaaaaaatacatagataagtcacaatattctcaaaacatatctaataaggaacttgtatccataatatatacataactactacaactctgtaataaaaaaaaaatttaaaaacgagcataagactagaacaggcacttcgcagagaaggatataaggaatggccaataagcacatgaaaaagtgctcaaaatcattaatcatcagggaggcaaattaaagctgcaacaagataccatagatacccatcaggatggctaaaatgggctgggttcagtggcttatgcctgtaatcttggcactttgggaggccaaggtgggtggaacacttgaggtcaggagttcgagaccagcctggccaacatggtgaaacctgtctctactaacaatacaaaaattacccgagcatggtgatgcatgcttgtagcctgtaattccagctactcaggtggccgaggcagaactgcttgaacccaggaggtggaggttgcagtgggccgagattacgctactgcacttcagcctgggtgacagagtgagactctgtttcagaaaaaaaaaaagaatggctaaaatgaaaatgactgacgccaccaaataatggcgaggatgtggactacacatatactcactcttggtgagagtgtaactggcacaaccactttggacaaagggttggcagtttcttatcaagttaactggttagacagaccctcaggtcccatatttgacttcttgtgaagaccggaaaatcttccccaaaccagagaagcctaaacaagtgatcctgaataacctaacctaggccttggcaattcagaacatggaggaagaatcctaacaggactcagtatggagaaataatcctttccaggtggaaagcaagagtgatgttaacaacaaacacttctacaactagcactacaccacgaagcttctttcttcaaacacagaccaagccaggtatgcatttcataggccaatgctgagaacggtgtttacaaggttaaataaatgtttttcggatatacagtttcaaggctctctttacagtttcaataatcaagacattattggcataagaaaagacaaacacatcaatggaacagaatagtctagagatagtctcacccttatatgagcaactgaatacccacaaagataccaaacaattgttccttcctcagtcctactgtaatttagttcctgcattaacacatcagtcttattgatgagaagaattatagtcagttataaacaccacatttctaggatacataaagattttgttgtgttatgttttaagatctgggaattccagggagagtgatactttccataagcagctttacaatcaaggtgccaggccctaatcatatacacaatgaaaaaaaaattagaatgagaagtcaacaaaaagttattctttaatgaaaagaaggttctttctgcactgacagttcattatcaagaatcatatattcctattgaataataacatagaacagagagagaacatgaatctctgaatcttcagatgaacctttacattacacttgggatggccctttaaattgattttgaccaatatatagaaagggactcagcacctgttgggcactcagtttgcggtgacttggccaaagtcacataggtgataagtggtgaagccagattccaaacacacattggttccctccctcctacagcaagtattgtttgaggagatcatgctctgccttctgtgacaatcacaggcattgtcatggaagcagtgtctagaatcaatgattacttttgaatgagagaataaaaacattaaagagattccacattttcaccctaaaaaagcttatgaaataggaaagtactgtaaggaagaaatatatttaggaatctctagttaagaaacaatgattacatttgtagaaatgctcttataatgcttttaaagtaaactaaagtctatagtggatttttaaaaatgtcatttagctggatacaaagtttgaaggcagaggaaacactttgttatctattatgtaactacaaaaatattctgacgaatgacaaaaataaattagggttatattcctggagagaacagacatattgaaaggctttggtgtctcttgtttgtacagaatattctgacatacaatcatacataaagtattaaatgttcatgtataaatattagtcttatctccttaactatattgttacttttcccatcatggttccagatacacagctggcacatgcatcctgttgaaagaacagaacatcaaccaaaaaaagtttctttcacaccacaattagctgcctaaacattaaagaagagaatcaaaacaaaggtccctcacattctacaagctggacaatgaacccttactgaggtagaccatactttgttgattttaaatccactgtctagggctgggcacaatggctcacgcctgtaatctcagccctttagttgccgaggcaggtggatcgcttgagcctaggagtttgaaaccagtctcggcaacatggcaaaaccctgttgctacaaaaaatacaaaaaaattagctgggcatggcggtgtgcacctatagtcccagctactcaggaggctgaggtggaaggattcttgagcacgagaggtcaaggccatagtgagctgagattgtgccactgtactcccatctgagtgactgagtgagaccttgtctcaaaaaataaataaaataaaataaataaataagtgtacttaaaaaaaaaataaatccggccaggtgtggtggctcatacctgtaatcccagcacttagggaggccaaggtgggcggatcacctgaggtcaggagttcgagaccagcctggttaacatggtgaaaactctgtctctactaaaaatacaaaaatattagatgggcgtggtagtacgtgcctgtaatcccagctacctgggaggctgaggcaggagaatcgcttgaacctgcgaggcagagactgcagtgagctgagaccacgccatcgcgctccagcctgggcaataagaacaaaactccatctcaaaaataaataaataaataaataaaaataagaataaacccactgtctacagttcataaaaaggcattgtatttcaaaggcataaagactcgaatttcataaacataaatttaactaagaaaagatctcatatccgacataggcattctatacaaaaagctatttagttaaatgttaatctgttggtattgttactcattgcaaataataaatgttatacgtacccagatttttgttgtattgaagttttggcaactgagcgatcaaaaatagaaagtttacaattggaaaatagggtaagcgctttgttgttatgtatatctggaaagagaaaggtaagaaaaatagatggttaaatcacattgcacaataccacagaacaggtttccaaatgaaaatcttccattttacttcaatttgctctttggctttcctgaaatgtggatggttccattaatttgctgccttcagagttttatttaacacacctggccctggccacataaatacctgtatcataatttgcccttctgggaagaaaacaattttgcttagaaagacttttcccctgaatcctgttaatgtcattaataaagggagggaggaatgagtgatgagcaagaatgggaggggaaggcaaaatgaagagcagttgaggaagagctggaggtgaatatagggggagtgtgggagagagaagagagagagagggaaagagggaagaaggagaggaggagggagagtgaagggaaaagatccatgtagcagcgagtggtggtatctaagtagaaagagagcaaagttcttcttgtcatttgctgtcccctaggcaatgtcacagagcagtctcccagatgtcacggcagaaactacagtcagggcgtacatggccaggtccagactgccagctggccgattccataggagacagggtagcacacgggtcagaagcaggggctctggtcagactgcctggctcctccacttgctagctggcctctctgagcctcgggttcctcaactcataatggcgtatttcatagggcttgttgtgagatgaagtgagataatccacaatcagggttaagacagtgcacttgttatgcagtaaatattcaagacattagctactattcaggtttataatcttttatccaaaacacaagggataatacagctttcagaatttcaaattttacagatttagaaagataatataggggctggcgtaatgcactataatcaaagttactataatcaaagtctgcatcaaaatatatgaatgtttacagtaaggaggataaataactagtataaacagccttatgtcagctcaggacagattttgccatgcaaagagatctggcaccgagttatgaaaaaactttcagttcttagaggttttctgagctcacaactgcagggaagagtttgtagcttctatgatgagtgggattactgtcagccacaaggggaagcacctttggcaagacagatcaatgctaccattttgggtttgttgggccttgatgactgaacggcaaaccccagtgaaacccaaaactaatctcttacacggaggcagcaccttcccctttgtcatgagctttcaccagcgctatagcacttgattctcacagacctgagccaggcggggaaagtgtgatgattgcttagaaagggcagggaactgaatggaatgaaggctctggggtctgaacccaggttcctctggtatttctgcacagtaatctgttacctgggccaaataccattctgtacccccatccccgccattatatattttaattactcaccttattcagtgggttgtgaatgccagctgcctccagataggctgtgatttcatataaaagtgtgttatcttctttggggtaaggaagtgaagggtcctgatagtgggcttcaatgtctgctaggagagccctaaaggaagaaaaaccctggagataaacattagtgagtaaatgaatttatacaagagttaatatagggcagtgatgtaatcttttcaagcctcagtttcctcatctgtaaaatgagagcttgatctcgctaattctcaaccatgcctgtgattggttttaagtggaaaatttgacctagaattacttcatcttttggaatcaacctcaatcaaatgcattcaccattcaaattttcatgtattgactgaactgttcttaatacctgctttgtcaaaagcactgacttggtgagtgagaagcacagattatttatctgtaagtaggcagcctcaaatgacagcaggttgctggtgaggcggaggatatgagttccctctaggacaggcctccataaccactcttggtaatcaacacacttccaactgccctctggatgatgagtgatcagccctgtaaaaagccagttgcggattttggtaataattgctttctaaaatctgtgcaagtatctagcagtgtctggtgtgtctctcactcgctctctctaatgaattcatttgttcagcagacatgtattgaatcatgtgatcagtacctgtctgctgaatacacgaatccattagagagagtgagtgagagacagagataaacggagggacaatactgaggaaagaggctccgaagacagatttgattatccgtggcaaggaagcctgtaaattcagaccttccacccaaaaataacttaaaagagtaagaactgaagaaactggggtgcgtagataataaacaatccaagcccacggatggctgtttcaaaccctggcacttacttattgagattctccagagcagctgccagatgtttagaatcaaaccgacaagaataatttaattcattggcaatctgttgtctcagaatctgcatctgcccaacctgtgcacaagcaagagaaagaacaggtagtgcattcaagcatttcagagtgacagtgaggaggtaaacacaaagatgacaattcttcactgggccttcacatcactctacaggaaaaaaaataaggatttcctgaactgatctcttggctaagaccagcactggatctaatgaagcaccagaggcccttcaaggaatgtctggatggattcccataccccaacctaaaaataccccaaagtctatgattcacaaagtgatctattaatgttcagttgttcatgtatcaaagatgtcttttttgaagctatatttttaaccttttggaataagtgctccaaatttagtagctgctgtgagaagtcttacttacttccttttatttatcctaaatggaactttctcaagctctaggaatgccatttcacactagtattctcaaattgggtgaatattaagtctgtccatgccactcaggattataggttctataattatctggattacaaaataatctacataaaatctttcacgaaaattttaacaatgatagccccttaatccagggttcttaattttttttgtgtgtctgatatggtttggctgtgcccccacccaaatttcatcttgaattgtagttcccataatccccatgtgtcatgggagggacccagtgggaggtaattgaattatgggggtggttacctccatactgttctcgtaatagtggatgagttctcacgagatctgatggttttataagaggcttttctccttttgattatatttctctttcctgttgccatgtgaagaaggacatgtttgcttccacttccaccatggttgtaagtttcctgaggcctccacagccatgctgaactgtgagtcaatcgaacctctttcctttataaattacccagtcttgagtatgtctttattatgtgagaattgactaatatagccttggacccctttgggaatctggtgaagcctatggacaccatttcagaataacgtttttgaatgtacaaaataaaacatagagggtaacagtggaagccagttgtaatgaaatataattaaccattcaaagaacaaatctgtgatatagagttatgctaggatggtgtattaactacagtactttaaaagtagctatgagcataaatgatacttggagattatctgcaatggttggatgataggaagcgatctttgggtcaggcttgagagttcagtttgccctcataatgttgtctgcatcataaggtcaacagcacactctaactttttctgcctataaatgtcttcttttctactcggacaaagtattcctaaaagactggcaaaggggagtgagggaggtggggagaggagggaagacagtattataatgcaagcagcaataaggtggaaataaatgcatttcctctgagttgctgggggcagagaagagttaaggaaaagacaggggctcacgcctgcaatcccagcactttgggaggccgaggcaggctgatcgcttgaggctaggagttcgagaccaagcctggccaaaatggtaaaactctgtttctactaaaaataaaaaaattagctgggtatggtggtggacacctgtaatcccagatacttggaaggctgaggtatgagaaacacttgaacccaggaggtagaggttgcagtgagccaagattgtgccactgcactccagcccaggcgacagagtgagactgtctcaaaaaaaaaagaaaaggagggtggccttctctaagaatgagcaaaagttacttagctaaatggagcttgtaatggtcaaaagtattaaatgacctcagatgtattatttttgaccactattcatacaagactattactctatttatgtgaaaaacgtcaatccaaaaatgctatttataaataggaagtgtttgaatttatagagtagcattatttaaaaattagaatgcagcaaatccaagaaaatagtaggttctttcaggccacataaaaatgtccctgaaaccctgtatctggcccatataattctttgcttaattttctatgtgtagtatactctgtgtcaaggatcctcttgaaaatatcaatctagaactggaaatagaaataaagtcagtttaatataacttgctctcgtttactgcacaatgaatctttgttagtgacattttctatttttggtactcacgcacttcaagctttaataagctgctgaagaggctaaggagcctgggatggatgagaaacttattctacctactcatttgcctctttggagatatctggcttatcactctttctccaagatttttctagagttgcactattgagtacagcagctcctagcgatgtgtggctatttatatttaaattaatatgaaataaaattaaaaattgcatttcactgtcccacaacccacatttcatgagctcaatagctacacagggctaggagctgctgtcatcatcgaatagcacagaacatttccattgttgttccagattattaacactggctccgtgactgtacgcaccctaattcaagacaaaaagacaaatttgtcctttggggctttatttaaagatcactgactcggtcacagtcacgtggctgttactgaattactggcaactataaccaatagttggaatagctactggactgagaaccctccagtaagcaaggggaaaaccttccagtttcttggaagaatccctgtaatccccctaacgcctcctacagagttgggactcacacctgtccaaactcgggtgattctttattcctcctaaagggttttccagcaattagaaacttggcctgggaagcgcttaatatctgacaatcatgaggctaggggaaggcagacccacatcacgagaggatatctagcagagccatgggctccttgccttacctgttctgtttaatgatccaaacaacaacaacaacaacaaccactcaccaaaattatgggaaatatattgtgaatttggctaagataccaatgagtgctgtctcaatgagaaacttatataattgggaatcagagaatggaacttttcaaaattcccttagcattctagaattctagacttttctacagtatgtgatatttttgaccacaaaccagttttctaccaggaagtctactcttccctgctagattgtgagttagctaaggagaccggtcatgtttcatttaactctgtctttcacagcaactgacaatgccctgggtataatgggtgtgcaagaatgggctgtgatgatctcagattatcagatgatgaaagaagactcgcagaagatgcaggggtccctgggagctcctactgccgagtaaaggcaggaaactaggcagctggattctaaaataagttagacttccatccagcaaattaatctcttcgtctttcttattcatttccaaagtaagactgctttctgcagagtataaggataatttatgccccaaagaacctggcttcctaacatctatgcagacacaagagggcagagagacaatgttctgttctaacagcagcttggagcagatgaggtgtgtataaatgaactttgttatgtaaaaagggagtattactgtgcaaggaaaagttcaattttcatatataaaagcacctctagccaaaaggcattttacaaagagccagttttcttgaacaaaaggaaaacgctaggctcctaaaaagcctaatcaagaacagatccagaaacggagataaacaaaatgaattttaaaatgataaactgaagtattaaaatatttttgatttaatgacaaaagaaagaagagtagctttttttgggcaacaaagttacaagaaaataaaaaatttaaaaatgtaagtattgactgtacaccctctcttctacaacataccttcattatagcctcgagatacgcagtccaaatcttctgtgttttggcaatggcggaaaaataaattttatttgaatttgctgaaaagttaaaacataattttctctttagtacattcgtaaaggctacagtgtcatccccgcctcaggtagtttcaggacactcaccgacaatactttttaggggactgacagcattcatgagggtttttaaagtgtcctgaacagttctgtctctcaggataattttctgaaacatactgaggaaattctaaaaacaagaaggcacggtcaaagaaccaaacataatgaattaaacaagcaaattctccagttacctaaaatgctatgcagaacagaggctgggcctaagtcacacaaaacctctaaacaggatgacagcaaaaagaagcaacttcaggttcctgttagaaacatcccttgctaggaaaagtcactggcttcaaggattaaaaagtcttatcttcccaagttgaaacttacaaaaacagtctaatcctaaaagtactatgctggccaaacaaattctagtttattcccagctctgatctacccagtaggtatcatatgcctaaagtcagtgtaagaaatcatggaagaaaggttaagtgagttcaaactgcccactaaaatatgttcttgcctctcccccagggtggcagaaaacaggcatgaaagtcaaaaggctcacctgtaactcttttacaatcataaagcacagaagcctgtctaagccatttagaccaaaggttcccaaggtggtctggatttctgagaagaggcggctgctggtcacttcctgatgagttttcatatcataccaagtgttcagctggtctatgtgacatgtcattctaaaatgaaaacaatgcaaaaaccccagaatggctcagaattcatccttaaagagatgttaggactcaacaggacatgcggcaccaaatatgaagaacaggagttacatgatctgtgttttctaacctctgtattcaggcacccaatgcgtcttcccagtgacacccaatggaacaggaaggtaaaattcagtctgacccccttttcctgccctatgccatatcattggtttcagtcatttatttccattgagttagggtgttgacttggaatcatgctgagaagacaaggttaggttcagctgtcaggctggaagactttagagcccatttgtctctctatgcagccttcctttaaatttccagtttggagacaaaacaaggccttgtgtcatttccatttgataaaaaaggaacctagaatctccatatgctacctaacatttgagactatgacgacaaagcaatttgctttttcctcccagttccttaaacttgtagatgccatcttctggtcctctccaaatgattctttttagactcagaagtgtgatgatgacagtgacaacaaccaaccatatttactgggcacttattgtgcaccaggtgctgtgtgtgctaagacctttccatgtgctatttcatcctcataatagctctgtggaatacaaaccatttcatcctcattttatagataattgaggctctcataggtctgaccaccacccttaaccaccatttcaatggttttcaaacactgagagagggaccctgagtccctggtagagcttgtctgaaatacagatgcccagcttccattcctgacgaatctgatttaatagttctgggggagagctctggcctttgcattttcagcaagctccacagatgacatatcctattgtccaaagccaccacatacctttaccagaaggaggcgtgagaaggggttgaaagagcctagaagcaagggaggttttaaatcaggaagtaaatagggagaacaaaacaagaggattcccaaactgcttacaacttccatctgcttgcttcaaagactccttctgccaccaagtacactctgatgtgtcactggggaggcccccaattctgatgataaaattcatatatgatgtggaaattctggtcacacttaatcctctctgcctgcactaatagggcactgggtggatagttttctaaaaaggcttcggtgattgaaggctaccaagaaagaaggagctatacaactttttgaatcacttactttttttgtcccatgagtcaaaattccttatttctgctagaaattttggaataaggttatgcatagtttctcaactttcacaagtttcgaaggacaaaatactggattagaaagaagacagcacaaaggatccaggtcctaagaagatttaactcacacaagatcaactacacgtgcctgggtggtcagagaacaaagatcatcgcttttttcctgggtaattccaccaacccttctgctcagtgagcctgtgcccaggggtggacatgagaacctgctcttccccaagctgatcttagtaccaacagcttctcctgaggctcaaatgaagaaaaaggaggaaaactggctcagctggacttactagaggcagcatgctagtctctgccgtggtgctcacctaaaatattctcaggagcagttttaattaaatgagattttcacccagttactgctgaacgtagagcccacataacccgtatgtagactgtgattggctgtatacaaagctatgcagtctgcctttcacagtacaatgcctaggagctgggctctggagtcagagggcctggagtgtattctgggtccgtcatttattaactgtgtgatgctgggcaaatgactaagcttttctgtgcttcagttacttcatctttaaaatgggaataagaataatgcctataagattgctgtaaatgggttaatgactggatgtgtataatgtgctgagaagagtgcatagataagtgttcaataaatattagttgttgctatcaaaagtgcttgtgtgttgagctaagaatcgttttgtggagacaggggggcgggggagagattagattcttctaaggagcgcacaacctagatccctcacatgcaaagttcacgctcctatgagaatctaatgctcctatgagaatctagtactttgggagaatctagcacgctcctatgagaatctagcactttgggaggccactgatctgacaggaagtggagctcaggtggtaatgcttgcttgcccatcgctcacctcttgctgtgcggtcaggttcctcacgagtgacagaccggtatcagtctgcagcgcaggggttagggacccttgccctaaagggtcagaatatgagttgacaagtgcaggacccccgtgactggaataggggctgtgccacagggccacagatgcagatgagactgcctgcagtattcagggctctgtagaattcaggtacacctactttgggtctgtgatccgcaggatttctctgcagagtcgaccaataaacgttacagactcatccacaggggtaaacttgggtattggaatatgagtggactggtacatgctttgccaatcttgaatctagaaaacaaaaccatcaatatttagtaaacctttgataagataacctagttatcccttttccatataattttacaaagataatattgcataaagagtgacaataaaggttgttttttttttttagatggagtctcgctctgtcccccaggctggagtgcagtggcatgatcttggctcactgcaacctccaccacccgggtgcaagcgattcttttgcctcagcctcctgagtagctgggattacaggcacccgccaccatgcccggctaatttttgtatttttagtagagatggggtttcaccatgttggctaggctgatctcgaactcctgatctcaagtgatcctcccaccttggcctcccaaagtgctgggattataggcgtgtgccaggtctggctaatttttgtgtttttagtagagacaggctggtctcaaacacttgacctcaggtgatccacctgcctcggcctttcaaagcactgggattacaggtgtgagtcactgtgcctggcttggttttttattttagagacaggatcttgctctgttgcccaggctggagtgccgtggtgtgatcacagcttgttgcagcctcaacctcctgggctcaagcaatcctcccacctgagcctccaagtagctgggactacaggcatgagctactgtacctggcctgtttcttggttttgaagaggaaacttctaaaactgcattaataatagtctcccagaaataccacatataacatttataaaaaacaaagaaacattgtgaaaaggtgaggtgacaaacgagaagcgagaactaagatgagacatgggaacttcggctttctgtcttatgagttgacatgcatccatgtaatataaaaatccaaaatatcataaggctggaatagacttaaacttttgaaaatgtcacccaaatcatgtcagttcccacatgaaaacttgcagagtggctccttgttaactacttactaaaatcaaacttctcaattttggcacttatgcatttggtattctttttttacccaattaaagaaataggcaaaggacttttatgcacatttttccaaagaagacatacaaatggccaataagctgttcaacatcattggcattagagaaatgcaaatcaaaaccatgatgagataccttcatgtgcactagggtgactataattttaaaaaattgaaaataacaagcattggttaggacgtggagaaactggaaccctcgtacactgctgttgggcacataaaatggtgccgttaccgtggaacacagtttggcagttcctcaagaagttaagcatagaactacccattataggtcctagtaattccactcctcagtatgtaccctgctgaacacaaacaaaggagtcctaaaagtcttttgaactgttaatcacttgggttataacaattacaacaaacagcttcattctgtagccatttaatgatgtctgccttcttaggacagtgagctcccggaagttacatgccatgtccacttttctgcaaccctcctggctcctgaaagtactctgaaggtactgagactatctagtaaactttcttgttgacatttctgaggtttgggatgtgtactctaaacatgagaaataacaaatatagtcaagaattttaaaatttattagataccttcgttcttagaaagttattacactcttgctccacgttgtaatttatgatacgagatacttcttcctgccaaatcttcagaccataaatgttgacatagtcctgtatgtattcaaaagaacgatggaatccatccatggtcgctcccaactctttcagcttgggcatcaattcacttggctgtggaaaaggggaaacataaagctcttacactggagtagattgtcaactattcgttctaatatctaactagactttaaatagtatagcaggccagatgcggtggctcccacctgtaaccccagcactttgggaggcttaggcaggaagatcacttgaggtcaggagttcaagaccagcctggccaacgttgcgaaaccctgactctactaaaaaaatataaaaagtagccaggtgtggtgtgtacctgtaatcccagctacttgggaggctgaggcagggaactgcttgaacctgggaggcggaggctgcagtgagctgagattgtgccactgcactccagcctgggagacagagcaagacttaatcttaaaaaaataaaaaataagccaggctcatgcctgtaatctcggcactctgggaggctgagatgggtggatcacttgaggtcaggagttcaagaccagcctggccaacgtgatgaaaccccatcaaaaatacaaaaattagccggatatgatggcaggcacctataatcccagctacttaggaggctgaggcacaagaatcgcttgaacccaggaggcagaggttgcagtgaatcgagattgtgccactgcactccagcctgggagacagagcaagactttgtctcaatcaatcaatcagtcaatagtacagcagctaagagaccacagtcatagtttaagatatactttaagttttggaatactcatttcctacttcatctaggatgactgacaactgatgtcagacattcagcaaataaatgatttcactcatttgggaaggaagcctcatataaagaaataaaaaaaaagaatgactgtgatttctctgtcatttaataaatctatctagtctcagaatacttaaaacattttaaattgaatttactatgataataaagatcctaaatagagatttcaggcctattatttttctcctgagaaaaatgaccatattccctagcagataaagcaaaataaaaaattataacctttatagttcctatctactttagggttaccaaattcttttaactataagaagtacttctgaatcataaaatcagtttaattctgaaatgggatcaataggtggaggaaagaagcactggttttaaaaatatgaagttttaaatataaaatctaaatttcatatttatactataaatttataatatgaatggattataagatcaaaaagcacatcagttgtttgtgttgaaaatcacatatttgatatacgttagctaggaggtaaggtcttgttcgcgataggttaaaaatggcattctagtccatgctgcaagctgggcggagaagaggacaggcccactctggtcactgggtaccttggctcgagggttgaatatcagtcccctatgcagggcaaaggcaacgcgcttcacaagctctttccttattccatcttccagcaactgctttggatccacctaagtgccaatcaaaagtattaaatgatagttacgaaaaattcagtcctaacgaaatccagaggaaagatggctttcagaatctgcagtggggcattttcctacctcctcactaaatgatttgaattttttcctttcctgtccctgtgatcttgcacagcttggatggaattattaaacctgtcacctttttaggactctgtttatttcagcaaagttcatgatggtaattttacaacaagacatttcaaagacggtgaataaggaaagttttaaatggcctcacattctaattaatggcccctctttttggagttttaaatggcctcacattctcattaatggcccctctttttggaggggcaggatgaaggacctatgactgaatttacagatgcatgttcttcctttagattttatttctaggcaccttatatccacatgagcaaactcagatttgaggtcgggccactctgtaaattgaataattatcttttctttcagcattcttggaattagggagataaaataagaaagcaaatctgctatctaactctacaagcttactttgctaattatttctcctataatgaaaaggttttgttattcctttaaaaagtctcttatcagatccataaaacatcaaatgatttttacatactcccttgaattctctgagacttgtttcttttacttttaatttgtaaagaaccattattttaaaaggtcataaaggcaattaatgggttccatccagttttgattgtatttaaatttcaaataagacaactgcaagggggttacaaaaacacaaaagccagagaaacacattaaactacgtcaagatcgttcaatcagggaaatccagactgtggagcaactgaaggtgaaaggccctatgttcttcaacagatgaattaaagggaaagaaaggaaggagggccgggcgtggtgactcacgcctgtaatcccagctctttggaaagctgaggcaggcggatcacccaaggtcaggagttccagaccaacctgaccaacatggagaaaccccgtctctactaaaaatacaaaattagtcgggcgtggtggcacatgcctgttgtcccagttactcaggaggctgaggcaggagaactgcttgaactcgggaggaggaggttgcggtgagcctgcaccattgtactccagcctgggcaacaagagtgaaactctgtctcaaaaaaaaagacttaaaagacataacatagtttttcaaatgggcaaatctaagctatagtctggaaattaatgacatatagtttcactggataataaaactatacacaggaggcctgagatgaggtcagggtgcatgagggggctttcaggagtggggctcactaaatcctatttcttaagtggtagtcagaatgacttgtgtttaccttgtaataacctaataggctacatcattctttctttagttttcagcatctgtgctttattatacaataaaaaggtaaattataaagatatagtcaatgagtacagaatcaaagaagtatcatgaagctttcaaagaaatattccttacaagaacagatttactaaaagagttcaatgctttcgtgaatctaaagatcgcatgcggctcttctaatccttcccgcattctcactaatctgtggaagtgttcacagctaagagaaagccatcttcacacaccccttcctcacatttctattcccttcccctgaagttaacaacagtaactgttttcatatggatcatccagacctttctccattcgtttatatacataaatatccatccttacacatatatttaatttcaaaaatctaaatgggatcatatacatgtatatgtacagagacacgcaagtatatcacacacatatattatacatatatacacatagttgcatgcatgtatatcacacacactacacacacacacacacacacacacacacacatacatacatgtttttctgcaatttgcttttttcattttccaccttggagattttccagtactaaattctttttgaatcgctctagaccaatccacagtacgaatgcaccatggaatatttaaccattcccctactgatgatggatgtttagattacagatgctccttgacttaagatggggttacattccaataaaatcgtcgtaagttgaaaatatcagaagtcaaaaatacactgaatatacctaatctaccaaacatcatagtttagcttaccctacttcaaatgtgctcagaacacttacattagcctacagttgggcaatatcatccaacacaaagcctattttataataaagtattgaatatctcatgtaatttattgaatactatactgaaagtgaaaaacagtatgggtatcatatgaagttgaatcattttaagtttgagacgacctgtatttctttttttttttttttgctgcctctaacaatgaatgcttatatctctgtgtatatctcacttgttttaagtcaatatcaaccaaactgaacctacactttttataagtgtttgaaacacaacctcaacactctgaggttaaagatcagcgagggccacaggattacttttaaaagcccttagttgttattggtagactagcagagagagtctactgggttgaatgtagttggtcagcagagtattccttctgctgttataatctgaaacactgtgggaaaagatcagtattttaccaagcagtcttggtaaaattcttttgataattattgttaattacctgtaagaggttttattacatccttcttacagtggtcactttgcagtcctaggatttatcatcctgtgtgtaagaagtgactaaaatgcatgtacattctctacacatcaattgaattcacctgggatcaggcctaaagcatgtttagcaaattctattaatattctaggaaataccatggtatttcctttagcatacttccagaaaacacataccaaagttccatttaggtacatttcctctattttctttgattttaataatgcaaatattaatatggcaattaggaatgttgagattctactgatgtcagatatatagaaaaataaagaaaagcaccataaactatatgaatgggcccatcgctactcaccataacattccaaattaaaaaagcaatgagatactttatacctcttgggagaacaaaattagaaagtggataatatcaagtattggtgaagatataagccgttaagtcccaatggccttctgatatttccaacttgtgatgagtttattgggatgtaacaccactgtaagtcaaggaacatttgtatctcaacatccatcagtggtggaatagtaaatacaccacggtgcattcgtactatggattggtctgcggccacttgaaaagaatgtagatttcagaggaactcttgcacaggtctggagtggggatatgctcagagacgttcatcatgacattggttgtgataatggggggcacaggtgtctgtcccaagctggatggttaagaaaaatgtggaattctatgcagcagtaaaaagtaacctactatctgacctatagcaatataaataaattgcaaaagcaataaccagtaagagaagctggaaaaagaatgagacttagagcacaatatggttgagataaatcaaaagcacatgcacacatcaaataatgccatatgctaaaaataagaatacttgcatatgtaggaacaattaccaaatccacaaagttggtgctatgggtaatggaaatggaagcagggatccaggagaagaaaaaaataaacaaacaaaagatgacaggagcttgcatgccccagtgatgatagtggtctgttaaaagacggatatgggccgggcgtggtggctcatgcctgtaatcccagcactttgggaggccgaggcgggcgggtcacgaggtcaggagatcaagaccacggtgaaaccctgtctctaaaaaatacaagaaattagccgggcatggtggtgggcgcctgtagtcccagctactcgggaggctgaggcaggagaatggtgtgaacccgggaggtggagcctgcagggagccgagattgcaccactgcactctagcctggatgacagaacaagacccttgtctcaaaaaaaaaaaagggatatgattatcttagctctctgtacctggggtgtgaaataaaagtactaaaaatgaaggaaggaaaacagagagagagaagaataaagcaattttgactaaggaaattgaatttttttttttttgcttttcccaaaattcaatcaaatatatttttcttggatttaaacaactctttgataaaacagtactagcaccacacattttctgcagaactacaagataaagaaattcccactaccttcaagtactaagagaaataaagattacaatgctttctcttcctccatcaataagtgagtaaaacgggctgggcaccgtggctcatgcctataatcccagcactttgaaaggccacgacagatggatcacttgaggtcaggagtttgagaccagcctggccaacatggtgaaactcgtctctattaaaaatacaaaaattagctgggtgtggtgttgtatgcctgtagtaccaactacttggggggctgaggcatgagaatcacttgaacccgggaggtggaggttgcagtgagccaagattgcaccactgcactccagcctgggcaacagagagagagagactctgtctcaaaaaactcaactaaaataaaataaatgagtaaaatgaagaccgaaattggaatgtcaaacagccagatgatgtcactcccttttgcacacatgataattaccacaaaaacccaaacagctaagagtcatggtgcgaggccacgcagactaacaaaactgttaccttgatgatgccaaccaaagtcgttttcatcattaagatgccttcagtaaaaatggaaatagcatgagtaagcttggcaacctataacaaagaaaaagaggtatgaaaaatcactgtctaatagtcctggaatgaacaaagataacaggaaaagaacttgtagctttaggacacctgtgtccacatattctggacagaaatgaggctctgtggtacaactgaaagcccactgttagacatattgggtaacagagtcagaagacaacagtttattctttcatgtttgacaaagcatttctcctttaggcttcattttctcatgtctaaaatttggggcagaattcaatgatctagatgggcccttttggctagaaaagactatgagactgagaaggtaacctccccttccctggcctccccattatttgcaagcaatagcagcagacattgataaggtaggcaggtgctagctatactgttgaatcagaataaacatggaaatatcaagcttgataatctaagtccctgacatatttcttggacttgtatcagaatgggaaattgacactgtacatcatattttcaatcttcacttgattttacttttgatgtctttaaattctaagctcagggagaaaaaaaccagaggtgcttggggagaagaacctctgaggctgctgaactattattgagtgagcttaaaatctgcccaaaagaaatggttaatggaatatagattattttgagctgctcaaaaaggaacatgaatatgaaaagtcaggtcatctagctcaaagagaacaagggctgctttagcaagactgttataggaaaaagtgaccagctaagcctcatttcccctgagaatactgaggcgaacaaggccttaagtgacaccaggaaaatgtcaagaataaaaggtgtgattgtactaaaatcataaaacgcgtttaccattgcaaatgtgagacaacaagtcagaattggtctggtggtccccagaatatggcaggtgacacaggcctgtgatatttcatgactgttagtttttaatatgaaaaggcagaagtcagagggacacagcacctcgtatcgtgggcctagctgagcatagtccctcagcttgtctttgtccaggcgggtaggcacttcaataatgtcgtgggtctgaagctttatgatctttagaagagatgtaaacatgctttctgggatgatctgcaaaaccttcagtgaaaaggaaagcaggaaacgcaatgaacatctgttttacttttcttggctgacaaatattaggatgcctaatttgtctatatagggggatgctgaaaaatgtaaaagagctgttttaataactgctggcaggcacagggctccattcctttaaacattaattgcttacagaatataaagctaatccttctaaaaatgctgcaaaagactgtatcattcccattttacagattttaaaaagatcaaggttcaaaaatgttaagtaacatcactatagaggactggctagaatgcgacaccagtaaattttgaattcaggctggtctggctccatgctccatcagaatttattaaaacgagaatcaaaattcccatgaaaacctgaactgggctctgaccgggagatgctggatctagatcaggctcttttaccagatatggctctgtgattttgaagaaactattataatctctgtttctacatctataaaatagatgtgaataccaccaacacttaaaacacagaaataaaagttcctggcaagtaaaaacatctgtacatccacagtagcaataagggtaagtttatttttaggtgttgcaaatttctggaatcaaatttttaaaagggaaagagacacggatatacttttggggggcctaagcatactttttgtatttaaaacagcagttatctggcaagagtaaatatcaccctgatgcatttcttacttttctcacataggataccaactctccagaatagtactgtgacacgctgagcaggtcggggctatttgcctgattaatacgaagaaggggcagatcgagggcagaggcaagctggaagaaaaataaggtatatctgtttcttgtttcaaaaagagtcctagaaatctttctttccagaaaatgtaacatacaacaaaacatttgggttttacccaacagagggcattaatagtttctgacaatacagtttttgaaaaacccaagttaactgtgatggcagtggttcttaaactgtgctccctggaccagtagcttccgcatgacctgggaacttattagacatgcaaattactgggctccactccacactgacttagtcagacaccctgggggtgcggcccagcaatctgtgttacaaccagccccgcaggtgattctgatgcatgctcaagtttgagagccactgtgccacagaaaagagctactcctgtgtggaaatcaagacgttctgattgacgttctgatagaatctgattgacagattctaccgaatctgtccaatctaatatgccgtcaagtgtaagaagtgccattattttatgtgccattcagaaaaaaattaaatgctgacaactaaactatgatatgccatcaatgataaaacccatccccagttacagaaatgttaaaatatgaaaagaattgtagtagctaggcgcagtggtgcatgcctataattaaagctacttgggaggctaaggcaggaggatcgcttgagcctgggagtttgagacacagcctgggcaacacagtaaaaccccatccccctcactcccacgtcccaaaaaaaggtgcatctcagaattgatgtacatggtacatggtagctctgtcaggagacattgagtaggctgggcgtgggggctcacacctgtaatcccagcactttgggaggccaaggcaggaggaacatttgaggttaggaattcaagaccagcctggtcaacatggtgaaaccccatctctactaaaaatagtaaaaattagctgggcatggtggtgaacacctgtaatttcaactacttgggaggctgaggcaagagaatcgcttgaacccgggaggaggagctgcactccagcctgggaaacaaagcgagattccatctcaaaaaaaaaaagaagaagaagaagacactgagtagactctttgttcatttaccacgaactgaaattaccatgagagcaaggactgtgcctgttgttcaccaatattccctgttactgtagatattagtactagtttgtagcagaggctcagtaattttttgaatgaataagtaaaaggacttaattcatgcctagggaataaaggacacaaaggactcacatttttagtacacagataaaacttaaaaaaaaatctattcttcacctaaaaatagtattcctgaagacattccaacttacattaattaaaactttaaatatttctggaatctttgaaattatgctctcgtggaaaaactgctaacaatttcagtctataaaaatattgaaattatttaccttcctaaaaggataaaatcctgggctgaattaatgaatgaggtatgaatgaaggccaactctttcctagcaacagagaatctcactgttttttgcttacctttaggaaggtagctctgagtttagtaaccatggatggatttacccttatgctttcttgcatgatggatgtgaaactgtaaaaagaaaagaaacggtaagaagatgttcctagggcctttcatctacagcaaatgtcaggctgcctacattacctgtcaatcaactgccaagcgaaagaaaggtccccaacgatctgcattgtgatcagaacctcctctttaatgttaatggttctgatcatttgatgaagaaactttcgagtatcggcaagaaactgacatacttgcagattggattccaactggtggaattcttgaacctgtgttacagaaatatacttaatttaaaaatcctgaatggactctatggtgctcatttgttcttgaaaacacttcaaataaagcacactacttctgacaatttcttgataaagtttttatttcaaattataaatttcagaaacgtgagccaagctattaaaaaatgcacaagtttctaggattagaaaatgttccgctgcttattgtgtatatcacaaccatgtgttggaatttgtgtattattaagttcttttgatgcacttttaaaaacaaaacaatgattctacaatgtcttgaaattttaatgtatataactgaagatgcctgggttatatgacaaaataaataaggcaaatgataaaaagcatttgagatttacaaagttgtttacgatcatattatagactaaaaaaatccaaacaagcaaagtagaaataatacaagtgtgcaattgttctggaataagaaactttggtagaattattttactgtgttgctgtttatagcgaccatcctaaaaaccttgcagaaataagaaaaagcctgtaagaaaatattccaagtgaaaacagtattaattatatctctaaaaatatataatcataccaattggatagggttatagattatgagtaaaaatgatgttttaaataatagagttggccgggcacggtggctcatgcctgtaatcccagcactctgagagcccgaggcaggtggatcacctgaggtcaggagtttgagaccaacctggctaacatggtgaaaccccgtctctactaaaaatacaaaattagctgggcatggtggcaggcgcctgtagtcccagctacccaggaggctgaggcaggacaatcgctggaacccaggaggcggaggttgcagtgagccaagattgtgcccctgcactccagcctgggtgacagaactggattccgtctcaaaaaaaaaaaaaagagtttatgattatttttctgctgcttttagttatcattttaaatctagttaaatacacaattaaaatttaagagtggtgaggtataatttttttggtacaatcatttttgagttgaaagaaaaacaataaactatttttttcagaaaagaaaatatatcacttataagcatatgaccattatataattattttcatttttgtgtattcctttctggttttttcccccaaggcacacacttttttacaaccctaaaaatggtatacacatgcaattttgtttttgcttttacctccttatcacaatttgcccaatgtttctatattatttttataattatgtttctaagattacatgtttcctcaagttacaatatcgtaatttttgctaccattctcttcatactagttatttatttccccaaatttaggacagtatacgttacaggaaacatattaattcacatcgcttttacttctgatgaaatagtctctcagctatatttacaggaacagactgctgggtgggtcataaggtgtgattcatgatccaagaacctgcatttaaaaagcgtttccttacctcttccaaagcttgtatcagttgtacagtttttctgcccgcagcagtagaatcatcataatttaaagacaatatttgttttgagatctctctgaaccaagcttgaaggttttctagtaatacagaaataagaaaatactgaaatcctcgaattcctgtagctgtggctttgaatttaactaaataatcttttataaattcagttcttcagagctttaaccgtgggcctaacactaggaattttccaaacgacaaaaatgcctggagcatgcgacatagtagaataaactttctacataaatagcttagtctacagcacttggcagacaaatactaaaggctcaagtgcatgctataaagtgtagaggtggtggtggcagtggagaagagttggaaaggaactgaaggatgaccctagttaccagggagaattttctggagaagcgaggaaaagtaaagatcagatcatcggagagatgaagaagggaattgtatccagatgaaaggcagacacaggcagaggcttcagggcaagaatgacaagagcatatcttggagggcaaagaagagaccaatatgacagaagtgtaaggtgtgactggtgagtcacagggatgtctgaacaatgcagggggtgccatttgcacttaggaaccggcagacatttcatacagtagagaaagagaagggtgtccacatgctctgattaccctcagtgtgtcaggcaaagttctaagtatttgatcttcatagcaatacagggaggtggaaattgttagccatttcccagataaagaggctgatgctcagagagactgagaatgctatacagggtgacacggtgactaaatggcagagccaggatttacaattatctgtccaggttcaaaaactctgtgctctttacctcaccaagttgatcccctaaagttttttttttgtttgtttatcaatggggtggtcccacgttattaaaaggccttaaagacttacgatctaagttatttcaagaattggcatgacaaacactcatttttgaagatttttgtagggctgaggggcagcgatggagtagtagaaagagcatgaaatttggggtctgagatgagtgagacccaggctctccacctttgtaccttcagcaaatgattacatttttaagcctcagtttccttatatataaaataaggattaagatgtgtatcttacagggttgtaaggatgagaaaaaactgtgaaagtatgtcctaagctgtaattaaactatacagctggaaaaaaatgtaaaattgttatttcatctctgaaacaaagttggtatttgtaagggcctaaaagacactatcacagagattaatgcactaattctaggcagctaaccgggtcagattgttacacgtgattgttttgcaggtcacaatatgataaccataatattcattctagacttcaggtttcatatcacaatatggtgacctgcaaaacatgtttctagtttatatcacatcgttatacgttggctggcttttccctataggaacaataatacaatttggaaatatatttttgaccaaccactcagcatcaaagaaataaacaaaagctaaaatacagtaatcacaagctcatactgattaaaaataatagtttttaaacaagaagctacactactaagcaattctacagtataattaacttcatcagaaatagatctgatagttaaaacaaaattaagcgttaaaaaaatagtttgtcaccataaaattcagaatggttttttgggagcagttagaaatttcttatttataaaaaatttgaaatgatgccagaactttcctataaataaaatttcctagaagaagtaggatcaaaatcattaaagtaaaattttagtttgtgttttttcaaaactagtctgcagtaccctcttctgctactagatagcaggtgcattcgtgaacaagaatcaagcaaaatcagaagaattttagatatcatctatgctggtagattatgacattcttgggtgacgtattcttcttgagaagatcatgagaattatagatcctttcccccctttccccaaatcactaaactgacacattagttttgcataccatggagatggaggccaactgtgactctctaaactcttgtctatgaactggagttaccaaaacccctggtttagcataacctcacatttcaaagataagatataaaacctgaactctaaaatgaatatgaacattgcccaagagagcagagagctagacgcagccaaaactaaccttcagatctttattagcaacactaaagatggaatatcataggatacaataatgagaacataaagtctttttaacctgccagtttccaaggtttcaaataacctgtgcacacattccaaacacaccagtatttcctcttcagtaattaccatttttctccactctggttaggggtttcactcctgaaaagacatcagcaagctcagtcatccgctccgaaccctctttcttgtaatgctcccatttggtttgcttttctgaaagcatttgcttgaacatctgttgaagcaacagaaaatatttatttacttaagagaaaaatccagactaggcagcttatgaagagagcttgaggaaacccaatttaaattttaaataagaagctacactataaattaacattgaccctgatgtcatctcctcaggcactgatactttgcagaaattcagggacaaagccagaccacctccaaaacagtagttctcacaccaacaccaacagcacataagcaccaccaggaggctttaaagttttcagattctcaaggcccacccccaaagattctcgttcaggcggtcttgaatagggccagaaatccgcatttttaatgtgagattaaatttgtgaccactgctctatggttccttctaggcaacaatgtctgcaattctaacgtaaacagtcagggacagtttgtgtattaccttctccaatgactggggaatgaactagattacctgcaaaagttctttgttttattatacaagtttaattgtttatttttatttatttatttattattatacaagtaattgtgtttattgttatttatttatttagtttttgagagacagggtctcactctgttgcccaggctagagtgcagtggggtgatcatggctcactacaaccttgaactcctgggttcaagtgatcctcctgcctcagcctctcaagtagctagggctatgggcatgcgccactacacctggttaattttcttatttatttattttttttttttttgcagagatgggggccttgctatgttgcccaggctggtgtctcaaactcttggtgtcaagtgatcctccctccttggtctcccacactgttgggattataggcatgagccactgtaccgccttaattctgtttattaattcactccttcataacatttaaattctacaaagtcttgggcagagaagaaacgggtgtaactcagggttgggttttttttttttctgaaacaaacttaaaaaacatacttatttctcactaaaggacacgccatctcagacaagggtagatggtcttttacaccgggctcttaggaggtaaacaggcatgaactctgatttctcgcttaagaaattcctcacttgccagcatcataataaatcttgaaaagctgagcaatgggatagggagactccatctgcaggtggagaatcagggctctgtggaattttgcggggcctgtagaggaagaatcttagtgatctggcagaatgactaaccaataaaatgatgacggagaggatgaggaataatgaaattatttatagagtctaccctaactttctgagtccctcggatcaatcaatgccatttgataatggcaaagcaacaacataagagcaccctgaagccttcgtaagagactacatggcgtcaagcccttcaaacactcattcacatgaactcacaggtttcacatctcacaggatggaatttgggataggggatggtccctgaattaggaaatgtgctgtcatataaagattagaaaaaacacaggtccaattactgtgtctataggatagtcagaaagtgactctatgaactgtgcaggatgggaagtaggacagaggaagcacaggttaaagaacccagctgaaatgtcagaaattcaaatgtatcatttctttgagcaatttgtattgggtattttttttttctttttaccagagctttcctgaagacctctaatgaggtggtactcctttatgctgtcttgtttcctgtctacctggatagacagaaggaagctgtccattctgtttcaatagattccagagaacagacttatcattagaaatacaggcttggtcagtcagatagcctaggtctgtcctgatttccactcaacaatgctgaactacatattatctatagaactcttgggtccctggggctctagttcataattctaactggtctgagggcatttctttcattcctttttttttttttttttaggcagagtcttgctctgttgcccaggctggagtgcagtggcatgatctcggctcattgcaacctctgcctgtgttttcaagtgattctcctgcctcagcctcctgaagagcttggaatacaggcacgcgccactgcacccagctaatttttgtatttttagtacagatggggttttgctatgttggccagactggtctcgaactcctgacctcaggtgatccacccgccttagcctcccaaagtgctgggattacaggtgtgagccactgcactcgactgggcatttcttccttgcgggcattttttcatttgcctttgaaaggccacttttgctttgacctggttcctgttcttggatctttcctgttttctcatcttggcttaatctgtctttcttccctcactatactgacagggcagctcctagacggtagggacacattttgttcatatttaaatttccagcacctggcaaagaacagagtaggtattcaataactatttgctattcagagggaaaccattaaaattattaatagatcaaaaaggagcagcatttatctgatttgataaaattatgcccagacaaatcactgaaaacactaagcacaggcattatcattatgttagcagtcagtatctattttttctgagctacttagtaggggaatatagtatcctcagaaacctagaagataaagaaacatctaatatactagtaaccatactgaagcaagatgaggatctgttccgaatgggtataaatgtctgggctagttcctgggcccacctgatccaagcccccagggatactggttataaaacctgagcattcccaggtacccatcatttttattatgcccatacaggcttcttcagaggtaagactaacctcagcatttccttcagtgaactcagatgcctgaagtcctcaagatgaccttgtacaaatgcaaatcacccaccccagttaataccctttccagtggttctcatggctcttaggataaagaccaaagtcctgcaaggcctagtatgggctgactcctgcctacctttcagcctcatttcacactacctttctctcactctctctcctccagccaactggtctttcaggtctttgaattgtttatgttcctcctcaccaaagacgacttgatattcttcctgtccctggaatgttctccatcacgctccctacctttgtctacctaacactaacagatcccttccccaggccccttcagaagctcttgcgtctcttctcatggaagtctaccaggatgcaacaggatactttattctaggtacctggagaactacattcctttccttcagagcaaatatctgagttcatatttacatttttattagtgtgattctgtttttttgagacagggtgtcactctgttgcctaggctggagtgcagtggtgcgatcttggcccactgcaacctccgcctcccaggttcaagtgattctcatgcctcagcctccccagttgctgagactacagccgtgtgccaccatgcccagctaatttttgtatttttagtagagatgaggtttcaccagcctgctggccaggctgatctcgaactcctgacctcaggtgatctgcccacgtgggccttccaaggtgctgggattacaggcatgagccactgcacttggcctagtgtgattctttgattaatgtctatattccccattaggctataacctctaccatcttgagtacctttccccatcactgtatccccagtgaaaggaggcactacaggcttgttaaatgtttattcctgtcctttaactataagaactatctcaacagctcaaatctgtaccttgaatcagagacagagcaagcaatcctagtcttttttttaaaaaatatttttaagcataaaaaagctaagactgtggtgatattcattcaaatatttttacctctttgagtataaactcaaattgtgcagtatctaacagcagctggaagaggatcctgggattgtaccgagagtctgttagaatctggtccttgatttgacgaaggcgtttgttgtttgggtcacaggctagaaacaggaaaagtgttacctgcttactaaatgtgtagaaaatatctatgaaataagataaattattaaatattttccttcattttaaccatttaaaaagtaataagcaaaatgtatatcaataaaagatggtgaaatatagtacatctatgccatggagtacaattaaactgttaaatgacagttgaatctgacatggagtgccatccttgaaagattgttgaatgacaaaaagcaagctgcagaacagtgtttccaaattttgtgagcattctgcggtttgtttatagcaactgtctaaaacgaatgggcagagcctccttgtactacttcatagctgggtggcttcctcacgtcctgtctgttcggagttgcttttgctttagacattgatccctgccattcagtaacggactgctatccctagagaggcctgtttgcaaggttggctcttggctggcatctgggaacttgaatttcacgaagagctgccatcattttgagaactcacaagatcagctcactaagccttaaatgattgtacaaacaacgttttccttctggaagtctggaattttggtacatgctgggcagaggctacctatgtaagcagcccccaatagaaaccgaaggaagctgagtctaatgagccttcctggttgacaacacttcatatgcattgtcatgactcactgctgggggaattaagtgtgccctgtgggactccactgggagaggatgctcggaagcttgtgcctcattcctccaaattcactccgtgtgcccttttcctttgcagattttgctttctatccttccgctataataaatcatagctgtgagtactactagatgctgagtcctctgtgtccctgtagtgaatcactgaagccagagtggtcgtggggaatgcccgacacaacaaggaagggttcctcacacaaagatgagggacccccaaacaagaagcagcagacctctggccatcctgcttcttgtagaggccagagggcatggcaggcagtcagagttttctgaactatccactacccaggcactaggccaaggtcacaaaattaggcagtgattgacccaaggtaaaaatactggatgtcctaattcttagatgatcctatctgccaagctaaaccatttcaaatgaaataaacgccaagttaaaagaatagaataaaaaatattgatatttgcttagattggtttataaggccaattacttatctaagaaagagtaagtagaataaggcaaaatacttacaaggcaaagctactgctgcggtttcaatgcgtcttccaaaagttcacatgttagacacttggttgccattgtgtcagcgttaagaggtagagcccttggcaggcaattgtgttatgaggggtccaccctcatgaatggattaatgccattatcttgggagtgggttagttattccaacagtggctttgctataaaagtgagctctctcttgcacccactatcttgcccttctgcctatctggcatatattgacccttgctagatgctggcaccatgctcttggacttcccagcctccagaaccatgagccaaataaacttctttatacatttcctactctgtggtattctgttatagcagcagaaaatgaactaagacaaataaagtcaaaataaaaactctaagacttaaacagactttgtcaaaaagttcacagctgataggtataaggtatatggtagttacactagtattacatgtgccccctcctgccttcctagtcctgcccccatcaatatctcaggatgtctggcaggtacagaacaacaatgttgtatagatatatgtatatgtcatgggtggttttgttgctttagttatgatgaagcctgtggaaggtcatcttatatgctgatttctaagttactccatcaggaggagactcgtgacaacctggaaaagaggctcagttttcatgggaaactgcaaagttctgatttttcatgaatttgccagaactatgtgggaagaaatatattggaactggtgacactgattacacaaagtgaaaattttcagctccatatttacctaactaaacaaaaatcaaacaaactcagaaggagctccagttgtctttatactaattttaattaaactagaaatctcctgattttaatctgctttcatgtttgcatagggaatgtttaagtacccagttgttggacaaacactctgtattcctcaatgtgctttaacatttagcttcttggtataaaccaggtttgcttctggggttcccagggcctgaccatctctctcagatctgacccttaaggattcatacccagagaactgcagagccatcagaactttggggtcaaacttcagtagccagccagcctttctcatcccttatttcctcagagaatatttctttacaaggttctgtacaagcatcctaagactgggaaatgcctccagcaactcaacaggaggcaatgagactaggcctgcttttctgaacaccatgactgaaattccacaaaagttaactaagcagttgcttttcccatgtgtgactcacaatcagataggtcaatcatttgtttctgataaattacgaccctgtgcaatcaggtcagacaattgccaggcacaaacgcaaaagacaaatgtggctgaagataaaaccacagacctctggcaagccaaggttgtccctggcatgggtgcgaattcaggagactgccggctttccgaacatagacagggccgtcaggcagagtcacacagaagatgaagatgaggctgagtcactagaaaaccccagttggttttatgacaggataaagtgagggcttgagttgtttatacgcttgtgaatgcaagacttttggtaaagaagattaaaagctgagtcaatgtagtaaaatcctcaaattagaactggagtttatgtaaaaaataaactcaactaattaaaaacagattcagggattaaaaacttcagccatcgtgttcatactgtgggtaaattgtaaatggatataggccaacaaacaagatgatgaaacaaactggaaagcagctctcaggataaaggtttaagaagctggagagaaggctgaggggaaactccacacattttcaaagatacgaaggatgaggaagtccaactgctgttttcactgtggaccacccataggaagtggaagcagacggtagctagaaggactgtgaagtcatcttggctggaagagctgtgagacaggggctaccatgttacaaaggaaggctacagagaagtcttgtgtgcacagttttttaaagagacacagtcttatctggaagaacaaagaagtgctgcacacagtgcctgtctcagagttggtcctcaaggaaagtttgttgagtgaaaaacaaaaagcagagggcttcacaggcctgctgaatgacacacctcttaggggtaggggtatacagtcctggatgagggaatgcattggttaattagtgttgatccagcatttacgaagaataagaaactgtgccagccctgaacaagctcagagatgttaattcaacttacttatttttctaccattaaaccagaggttgaagcatttctcacaatctgaacttgatggtcaaactgtgtgaacagaaggtctcggaggagaccatgactcataaaaagctaagatccaatctaccttaaataagcactctggtccagccaggtcatcaactcagtgggcccatatgtttttctgtactttcaaaatcgtatcacttattccatcatttctgtagtctagaatttcttctgctttttgcttcaaaacctcatcacacgcctggttggctcctgattcctgtatggggtttcctgacctcctctgctcccctatcccaagcaatgtttccctctctactctgaactcaaatcacaccaactgtctgtttgacacacctggtgtctgtttactgccttggaccttgaattagtttcccgctgctgctttaacaattaccacaaactcagtggcttaaaacaacacaaatttattctctcaccatcccagaagtgacaaatctgagatggggctcactgggctaaaatcaaggtgatggctgcgctgggctccttctggacattctaggggaaaagtctgttttcttgttttcagcagctaaaggctgcctgtattccttggcttgtggccccctccatctttaaagccagcaatggccagtcaggtttttgtcacaatgctatctctctggttctgacacttctacctccctcttcctgatttaaggacccctatatttacaggctgggcatggtggctcagacctataatcctagcactttgggaggccgaggtgggcagactgcttgggctcaggagtttgagaccaccctggccaacacagtgaaacactgtctctacaaaaaaatacaaaaaacttagccaggcatgatggcacacacctgtagtcccagctgcttgcggggattgcggaagttgtatcgcttgagcccaggaggtctgagtgagctgagattgtgccactgcactcaaacctggggaacttgagatcctgtcttaaaaaaaaaaaaaaagtggggggggggggcgggctcttattttattattcttttttgagacgtggtcttgctctgtcacttaggctgcagtgcagtagcatgatcttggctcactgcagctgcaacctcccaggctcaagtgatcttcccacctcagcctccccagtagctgggactacaggtgtgtgccaccatgcccagctaatttttttactttttgtagagatgggatctcactgtgttacccaggctggttctgaactcctgggctcaagctctcctcctgccttggcctcccaaagtgatgggattacaagtatgagccaccacacacagcaaggacccttatgattacactgagtccactgggataatccagaaacatctccttaaaggtcagctaataggcaacctcaatccccctttttcatgtaatatatctaccggttcagggactagggcatgaacatctctgggtgtgggctggaaggcactattctgcctaccacagatctgcagttctattttttcatatgtctacatttgatctccccattctgatcagtgacaagctccttgaacatgagagataaacatcctcttattccctagcacctaacagtacctgacaggggagagcttttcaggtatgctagtggcctatccaagttgacaaaaaatgactaactttaaaaagcaacttgattctcatccaaggcctctctccctgctaaaccactctgcatcgtgaagtaggtcctgattctgagagtctttatgtggagtaatataaacggccaccccttttgtgcattacctgagtctgctgtatgaagcatcagccatcggatggcaacattgcagtctctcaggcagttcagaagctttgggatattgtccagaaccatctcctcccttaaataaccttcttttagaaattgctgcacttgagcatgcactctttcactgacagtagcatatctgcttgccttgacaaataagaaacttgaattacatttaaaaagtcatttatcttgaaaataaatcacattcaaatgaattcactgacaaatagtaacatttctatataggatgaatgacatatggattacagttatagggctcgaagataacatttctataagatgaatgacatatggactacagttatagggctcaaactttaacatttttatataatttctgtacaagatgaatgacatatggactacagttatagggctcaaacattaacatttttatgtaatttctatataagatgaatgacatatggactatagttctagggctcaaagataacatttctatataagatgaataacatatggactatacttattgggctcaaagacaactggcttattgaacatatttgaaaaaagcactggacttagaattctgagactacatcctagttctggctgtgattaaactttggtgtgacttggggcttaacccctgtgtattggtttcttcaaatttcaaacggagacttggaccaggtggttcctcagaactcttctattattaacttagatgaaaaagaaaataaagacagaagttcaattgcttgttcttgctaatactgttgacaaagaaggcagaacagagcagaaacacttaaaatataagacttcttctacaggcttatgaaagcttagcaaaaaatacaccttagtatatcaaaaatgaatttccaaaccagctttttggaaaatttggtcattctgctttacttaaaggaagtcaaatgttaaacatcattaacctcatcaagttagttgaaatctgtggtatcaagaaacctcttaaaaatgtcacaaatgagaaaatgcaattttagaaagggattttagcaatgaaaaattaatgatctgatgttgctaagtataaaagtgccactttctctaatatatttctaggagatgtgccaacattgaaattattttgtgcattatttatggaattcaatttacttgaataaaacatgatgaagttttttgagtcaatattgttttatccacacaggaaactcagtaactgagccaggatgaggaacataaccatttagaaatatcaagtatgctccccaagattttatctttattcctctacttacttggatgttcccttctgccttgtgtaagaacaaaagagatagaatataaccgtttaacctttaagatgaatgtcttgagtcttgttgcttatttagcacaacacaaatgataaatttaaattacagtgacaggacatattatccatattcagttatcatcttcatcattcatcctacttataaaaacatattaattccagctattggtacaaccaactctggccatgagaatatagtctttaagcaaaagtaaactaagtcatttggggcatatgccatgcttctttgtcttagggtactgactcttccttgggatcctaatcttcaatttacatatactatataacaaaacctacaattacctatcttattctaacctataaaattcaccttttattaatcattgcattaaattatctaagtgattatcttccaaattccttgggaaatctacttagcttatttgctacttcataaactaggcctgcagttatcagagaatgtccccagattagaacctacctgttctctgacatttgaaaggtccagggtattatttaaagcagtttttgcagctttgtaaggttcccaagcatctactagattaactgtgatccccatgtaaatactaattacctgaaagaggagacattcagaatttgttaaattcctactcacttcaaggcaaagggttgaatactaaagttatagaaggcaatacccactccatgtttaaattccattccaatgaaaaaccaagattttccaaatatataggtaagtgttcctgattgttaagtaagtgttcctgattgttaattcacgttaataggtataaagatctctttacacctattaacgttgctttttgaaattctctattgtgtaatattaatgttttctcaccagttgttttattggttggcaattgcctgggatatctttttttaaaatcccttcattttcactgtgctagggtattttttcaggtgtgtatcttacaggtttcatgtaattggattttggtctttcttaataataaatatgtctttaattatagtatcatggtcaaaacttctttattaaacttaggaacctgaagccacactatcagtgttttcctcttggctgctcaactctgagctcactaatatgattcacagttggccaggaaccaccacttcctaatgtaggctgttctcatactaccaataaattgaaggcccctcataacgatagtttatgtgattcaacagccgatatagaagcagaacaaaatctgctacatgcgaatataatccaactccctgcattttgttaaagcctctttgttttcatatatttcatttcatatatattatgaagcaagctttattcctataagaatatttttaaatgaaacaatgcttacaaaggtacaagcatatccttgcaataatataaactttagtaaccccattacagttagcttataggtaaaactttattattaaagtgaaattcctattcacaaagtgacaaattagatgaatttggctatcttagattcagaaaatggaaaagaataaataaattcttacacaacttagttgtaatctcagtagctaaagcaagagacattttaataaatgatttaatcttgagagtatccattttagaaaaagactagtgggttcttcaggaagttttactgactcatttattccttcatgttataattataaaattctcaatacagttagagcaagtttacctaagtgatgttatgtcccattatttacaacattacaacctgtgggttaaaggccaaaagaatgggaagttagttctctaacacatttactgtagaggaaaaaaattagcaatacttgcccaattatctggaaagtatttatccactatctctctcatttttgcttgatgggtgtgaaggatggaaggctcaaagtagagaatcacgtacagcatggcagcttggtttgccagggctgtgctgcgatgctccggcaaaggatacgctgagacctgcaatgtcaagacgacaccccgagaaagctgttggcaacatttgcacgtagacatgctcaaattaaactctctggttgtaagacacatcagtttttccaaagcccatcacctttcaggatcctggacactggaagcccttctcagactgtaccattgcttgccaaggtcttccttcttattcctaacaccataatattctcttcttccagcccttgaccgctgcaattctaagtcttttcttaaaaaaaaaaaaaaaaagtcccattcctgtgtctcccaccacttctccatttttgtatctttcctgttggagacaacccttagaactgacaggctccactcactgttgctattttctcactttctgtttattattcaactcactgaaattcgacctccatcatcatcccagtggaattccctacggtcgctcatgacctcacaaccatccaattcaacggcttctttttaagactctcacttaaattctctgaggaatgaaatctctccttctctggtttcctagataccactctctcttctcaatctcctttgctgagtcctcatcttctgccttttaaatgttggtgttccccaggggttcatcccctcacgtactagaaatctttggatgcacaaagcacatatcaccttgagctaccacaagcaaaaaggagagaaattgttataagggcagacatagccatgtcacatgaaacctgcaggcaggtatgtggccaggccacaggaagcggctggggctgggaaccggaatgccttcgctctttctccccttgatgtgttggcccaccttttctctccctccaggctactcgccatatacatggcagaatgaggctgcccacaaactcccaattttgcatgttgtggataaactccaatccagaaactgtttctcaggcccaattccaaattacctggagacagaatctgttccatcacccatgaccagggatgggggaggtgcaggacagagagtggggtggacacacagcacaatcacagcttaacccttgtgctaataaagatcatggggcaaggaggaaatggaagcacattgccttcagaaggacgtggaatgagaggcaatcaggaatgagatgctctgaattgacacagaccaaattcaagttatggttctgctacttagtaacaggaatttaaggaaattatttaagctctccaagtcttattcttctcaacagcaacatgggggataatgccatctactttacagggctattgtgaggaacagagaaaatggtatgggaacaaaacctcctttgtggctggtttggactgaattctcaatgaatggcaacaattattatggagacctggcatctgtgggtagcttctgattttgaattgtcttaaaacaacaacaacaacaccaccaacaaaaaccctcttatttatacttaacatattcacacaaaaaactaacaagctacctaaagaactgcacagatcaggttcattctgtgataaatgatatccacagttatcacaggcctctttactccctaattataatttttacaaatatttaaatatataacatctaaaattatgttttcttcagaagaatgaagtcaaatggtaattttatttggcgttttttaaaaggaagtgactactacacatactggcaaggggagtggggcgattttcaaatgctgcatgatcttcacagccttgctcaggctgcctcctttcctggcactcctcttaccttccttttgtcacctgttgtgaccttgctgccactgctgcatgctccagtggcaccctgtgcttaccctaagataacacccatcttgctttactataatcctgtcatctgcctttcctaagctacaagctcagtaggggcagggacatggcctgtcttcttcggtgatgggtccccagcattgcgcatgtgaatgggcacgtatcacatactcaacaaccatttcttgaatgaatgactaaaagaatgcatcttcttcccaatagctcaaattccatcttctccctgaaatatatgattctggcaaaattaataaccctctttcctttatcatcctggggtgtagctcaaaaggttttaaaaggttctacctgcttttactcttttgggaaagaaggaaggaaaggagtaattaaagagggaagtgaaatcagtctgttaaactgtcttaataggtcttaatagatttaattcccacctggttgtaaatatcatcagatctcagtcgaccaatgaccatactgatgaaggattcgttgataggcactctctggaaatagctctcgggatagttggatggtcttttggcacctggttggctagaataacctgtacttcgaagcagcttacaaatatcgtccatatttgaatcagcagaagatcgagcagcactgagtcatattcacaatgggaaacaaagacccaaaacacacatattagaaactgaaaagtccaataaagtagaattccattctactttgactcaatatagtttcagatatgatcacaggtccatctatatcctcaatatatcctcaagattcaaaattatgtgtatatatatgtgtgtgtgtgtgtatatatatatatatatatatatacatttttttttgagatggagtctcgctatgtatgtatatataaccttttttttttttttttttttttttgagatggtgtcttgctctgtcacccaggctggagtgcagtggcgtgatctcagctcactgcaacctctgcctccaggttcaagcaattctcctgcctcagcctcctgagtaactgggactacaggcatttgccaccgtgcctggctaatttttgtattttagtagagatggggtttcaccatgctggcccaggctggtcttaaatgtctgacctcaactgatccacccaccttgtcctcccaaagtgctgggattacaggtgtgagccactgtgcccggcctcaaaattatatttttgaaagcctgtttagaagatgggtattcatactatgtaaaggtccataatcccttttccaaaatccttaggagtggatttgtttcggaatatagcatttttcaaatagtaagagtcatatggcatatagatcatacacaatacaacactccagcagggtctgaattggcatctcatgatcaacataagtgaataattctggaggaaaatttataaatatttacaaaagtgagataagtgaagactatatatagcctcacacctattccaggcaagttttgactccaaatgatttcagcttacatcaggttttgctgccaaatgaattactatgtatatgtacatgtgtgttgtgtgtatactcgtgtatatatattttttcagagctctttggatttgaaaattgtgggtaaagaatgtgaacctgacattttacaaattaaaaaataatttaaaaatattatgtcaatttaaagtaaaatatatctaacttttttcttggcaagctgttccttctacagagatctaataaacaggtctgtgatttttccgggtggaatagtaagctctgaaagaaatgaactagattcaaagaatcttagacttggatatgacctgctatttgctgtaaggatctcttttgccacgactgtgacttggaagtgttcagtgtcacttcaataataaatgctcacattctaatgaattagctgttgtaccaaaggggacaaagccatattttcaaaactgggcttcataagccaatatttttttcttcttctttacactgtgtatagtttttgtttttccaggtactctcagaaatataggaaaggccattcaaatctcatttttaaaaacatggatgttaaaacagcttggtcaaactgacatgaatgaacactgctagaacactcccttcagctgaaaggaaaaggctagttgaggagcctaagactaatttgctgctgaggacacagtagtacctggtattgccgaaaagtataatgtccccaaagaacccccttctccttgtctactttgtcctaatttttaagtttgaaaatgttaattctactctttacatctttagctcaagctcctgactcctccttcttgacagtttcttctctgaatcttgactatctccgacattgacctggtattccatttttagctcattcaaccaattgaaaatctgtgcgttagacactaaaattaaaaagttggttaaggtggctcctgttttcaagaccttacttcctgaagaatcacagttctgtatagataaacacaacaaatgatttgtggatatgtgctgttgcttgatttgtttttgtttctatgtaaacatgggagagaattcactttcaacctgactctgaatgacaacttttcaaagtcatcaaactgaaatgacaacagaaagcacacttatttccttatatctgccaaggagtaatatttgaaaacttaaacaacaaaagcaaaaataatcttcattagatttctaagattctttgaaatttagcctcaaggtaaagaaagttcacaattcagactcctttttaaaattggagttatcattagggacagcataatccatacttctaataatctataatatatagaatacttgatatgtaatacatagattatataatttataatcattatgaaatatgtaattgttatatacctacaatatgctcacaagacataagaatcttactttttttttttttttttttgagacatagtctcgctctgtcacccaggatggagtgtagtggcatgatcttcgctcactgcaaccttcgcctcccgagttcaggcgattctcctgcctcagcctcctgagtacctggaattacaggcgcccaccaccgtgcctggctaatttttgtagttttagtagagacagggtttcaccatgttggccaggctggtatcaaactcctgacctcagatgatctgcctgccttggcctcccaaaagtgttgggattacaggcgttagccactgtgcccggctgaatcgtatactttcttatctattcttggattactgctgttcacagtataaggaatatggggacatacactgcattttaccgacagcagcgtttcggaagtgtagtcctagcccaggaatacctgtatcggtagtaagaaaccagcatcctctctctgacttctccttcaatcttttggtcaatgaccagtagcataactccatataagtacagtgcttcacactaagaagagaagaggacaaaagccaaaatcactagattatacattcttagggagtaaagtcggtaatcatgaaaaatattgctttgctcacacttcttcaaaaagttttagatttcaaggaaaaggtaggtttcctccaaggagctcttaccttcttgccgaatgggccttgaaaagtttatgtaaaacagattttaattcatagtgataatttttcagttgacctattttggctatgttgcttgggacaccaaaatagcaacccaatattgtgtatacctcttcatcataaaatcattcacttattcaatcagcatttcttaaatggttagtatgtactaggtatcaggacagatggctgggatgcaaaaagtaaagaagacagaattcttacaccgaggaggctcataacttccacataacttttaactgttttaaattctgttcaaagtctatgttctaaactcagatatggacctgccagttagaagataattaaaagctcatttcgcttctctttaaagaatggtatttcgtatatatttgtgacttaaaagaaaaaaaagtgatactatgtttgatattcttgaatttcattttaaataatcattattacttactagaagttgttttccatcttcattgagaagcacagtttctaaggtttgctgaatataaaccccttcattgagatcatctagatatctagaaataaaaccacagtgcaagttattaatttataatagaaactttaacatctttaaagaaggaaagatttttaaaagataaggcaggatgccaggcattctggccttccactagttcatggtccttcatgctcttaagaatacagtcttataaactgatttagggccacagtttgatatttatcgctgttccaagtaaaagaaatattccctagtcctgatttgtgaattacaagtatctaggagtaaaggcagaagaacatggaatatctagtctaaaagttaatgagtaatgaattcttaagaagtgtattaagagacagaaagttaatgataaagataagttctttttcccacttttcacatataatacactaggatatgataataaataacaggattggaaactatatgacttagttaaactaagtttattacaacacctcataagagcaggacattatagtaaaacttcaaaattcttaagatgaccagtgccacaggtaggaaaagacaactatatacagtataaactaaattaggaaattttgtagtaactcagagagatttacacgttgctatgtgtccttttccctctccactatttactaccagaataagctattcctaaatagatcaatacctgtttaagtctacaatatatttatgtacactttgaaatgctaaataaaatctggtcacaatttctatgttgttttcacgaaattcttcatctaaatcctgtagctctggcttagcatccagtttgctttcccataattctggaccctgagaaaaaaaaacacatgtgaaatgtcaataaaagcatacttgttggtgacaatttctaaatagtcttttaaaaatttgttcttatgttattagacatcccaaacttaaagcagagcaacagaaagtagtgaagataatagaagcctagatataaaatccctttgagagaaatgaatttgaattggacccaagattagcatgcttttaagtatggggcccttcaatgtgaaatatcaaagttatcttttaaaaatacaattatattgtgttagggctttgacataatactttcaacttattttcaagttagtagctaatattaagtttagtcgaaaagctcttctctttagctttttccataattccttaaccttacagagtttcatggttcccagagaaaacacgcttttgtagaaaagacaacaataaaaatgctatagaggaagattaccttaaaatagctgaaatcaaatatgatatctccatatttctgttgatcagctctgtcttttaacctgaacacagcaggaataaactcagagagtctcaaaagttcagcaatgatggcattaccacaggaaacaatccttaggattgcttggccacagaggttgttctcggctagaaagtccaacattgtgaggcggaccgactactctgtgcctggacactggggatgattaactggcctcagagctggtgtctgtatattattagatgaaaccaggtgtgcagagagattggctcctccattaaagaacctgtatccccaaaaaaagtgtgaaaatctcaatttgtttaaggaagcacatgtgtacacataagaaacacatttttctcccaaactcactaaaaaaattttaagaaataatgagttcctttataggggaaagggtgtttatctgtcactcttcatattttccatgtggagggactttgctagattaacactcttggcctcttcttcaacatgttagtcacttctcttgagaaaaagatatgatacagctcatctctgtgctagggagaaggaaccactgggcatgtgtggttccaatgtaccctgattatacaagctatctcctactatttgatatattagcaaataatttcaaacgctataaagagagctcagagacaaatccctgtacatcattttgaggcatttgtccaattatttcccagaaatggaactgcaagcttaaggtaagaacatgtccaagattccttttaaaattacagatgctaggttctgcaaaattctgtgaagatgatttataaatactaaatcaaactggtccaaaagtctcataaaattcagcacttaggtatctagcactgttagcagaatccattacttgcttctcttgtattccaatgcactctctgaggatggttagatcacttagcatactgaatattatcgttgcttacagctcattctgaaagttcttgaaggcaaggattgatctttacccaaccactccttgctgaatacctctttgccaggctggatatgaagatgtttaaacatctcaccttctagtccagtggttctcaagcctggctgcttaagggaatcacctagcatcttagagtttctggtaagtaggttagaggtagtcctaagcatctctgtttttaagaatctccccggatgattctgatgtgaagccaggatcattaaaagagtagagaatgactggtcttatagaaaactgcagcaggcaaacaggaaattaacaatatttatctttgtgccctttgtgctgaactcattccttggcactgacaagtataaggagtgcataaataatactagggttacaagaggtgatgtctgtcctctctagctgcctgctatactgctggagatgagccctgaagaaaaaaaatcagagagatgaagtgcttcagtgtgtctttacaataaagaaataagaagtgtaacatacatttaattgtcagtatggagcatttattaggtgttctgttgggaaaggtattcttatactgggtgatctttagtaaagtgacatctaggaattcggggctagagaaagaaacctagcatctaaaaagaatgacctattttagtatgtaacacttaaaaacttttccatggtaaatgacttagaagatggatttgaaatccaaagggcagacacagggttgatttctaaaacatgcaaagggatctcacaagctgtcaaagagagaacagagagagaagcggaggcagaagccaagtaacaaggaaaagggaaaaaaagatgtcactaggaatgaaaaccaaccaaccaacaaaacatacatgtgatgttttcctgtacacataagtctttgagcatgtcactacccaggttgtgccttctaagcatcttctgtaacacagagactctcgataaaactgcttcctgacccatccctttccttcccactagcttcctcctacagccagtgcagatagcaggggtgagcagatggtagaaggcgaagggcaactggagaaggaagcgagaaagacttacacaaatgaaataactcctcggacttgatgaggtttcagaaagttcttgaagtaggtaatttgtctcattacgctactccttcttacattcccctctgcccacagacttgagtaccccttcttgttcaggcctgtgtgccttcccctgcaacaatcatttttcttagttctaggggcttggaaagcaatctgattataataatgtggtaactggttgccaaagatggctcccaacaattccttgccatgaagtcagcccatacagcaccttaagtgaagggctgaaccttattttccctctcaatgagtctggattgcattttattagtttgctgggctgccgtaacaaagcaccacagagagggtgacttaaacaaccacatttattttgtcacaattctggaggcgagaacttcaagatcaaggtgttggtaggactgttttcttctcaggcttctctcactggcttgtagccagctattttcctcctgtgtcttcgcatggccaccccattgctcatttctttgtatagagatgggagtctcactatgtagcccaggggagtctcaaactcctgggctcaagcaatcctcccatctcagcctcccaaagtgctgagattacaggcatgagctaccaagcctggccctcctttgtaaatttctgtgtccaaatttcctcttcatacaaagataccagtcatattggattagggcctatcctagtggcttcattttaacttaaccaccgccttaaaaatcctgtctccaaatatagtcacattctgagctactgagtgttaggaattcaacatataaattttggggggacccaactcagctcataacagcttgtgccttccttccttcaacccaaagaatactgtagaattaactctctaccaattccaggcctaagccttgagaaggcctggcagtatctccttttgctctctttgggtgtccgaagctgccatgtaagatgtctgggtatcttgctagagagatcacaggagttacaaagaggaaagaccatgctgagagggaaaagtcctgacacagaagagaatgaagaaagccagcagacagcagaaactgaagtgccgacgtgtgacttgggttgacctggtccactcagcccccagctctttaagtcttcctagctgaagtgctagacatataagggatgaggctattcggcttctgcagccagcaaagccctctgtgccttttcccaattcctaatgcacaggatcatgataaatttttaacatattgtattgttttgggcaaataagtcttggggtagtttgccatagtgctgagattcagttttgaggactaacagtacaagttgtcaatttaaacagcatgctgatgctgttattgtgatatttcattttctataatgctgtgcaatatagtcattgcttttgtataataatgtccatgtagctatttctgtattgtactactgcattttcctccaatccccatcttttcagttctctgcttccgctgattattgcaatttccttacaggaattgtgccatttgtcttatctttggaaaaagagagctatgtcctaaaaaccactagaagtcggtgagggaacaacaagtaggtgagggaacaatctttagaaatgtttttaggcctggcaacggtggctcacacctgtaatcctagtactttagaaggccaaggtaggaggaatgcttgagctcaagagttcaagaccagtctgggcaacaatagcgagaccttgtctctactaaaaatcaaaagaatatcagtcaggtatggtggtgcgagcctgtagtcccagtgacaagggaggctgaggtgggaggattgcttgagccctggaggttgaggctgcagtgagccatgatcgtgccactgcactcttgcctgggtgacaatgagaccctctctcaaaaaaaaaaaaaaaaaaaaattttctcacatgtcaagtataggagattcttgctattaagaatagttcatatctgaaaaatgctagagtgattacaaaatacagaaaaatgtttcataaaaaggagaagaaaaagttttgattacaaatgtatcttgaaatttgtgaaaatgagctttatatattaggctgtgataagtgccgtgaagaaaaaacataataaaggatggggcatatgctagtttccatagagcacctcgggcagaagtcagaaggaaatgagagagcaagcagtatggatatctgggtatggtcagcagctttctaaagtggtccctaatgatctctgcctcctggtattcatgttctatgtaggttccttcccttgagtataagctgacttactgactccctcctaaagaggagaatagggccaggtgtggtgactcactcctgtaattccagcactttgagaggctgaggcacatggatcacctgaggttaggagagccgggatcaccccggctctactaaaaatacaaaaattagccaggcatggtggcaaaaacctgtaatcccagctactcgggaggctgaggcaggagaattgcttaaacccaggaggcggaggttgcagtgaaccgagattgcaccactgcactccagcctgggtgacagagtgagacttcatctcaaaaaaaaaaaagggggagggggggaaggaaataggatagaaacaaaagatacagtgcacttctgagattagatttcgaaaagactaacttctggcttgggcaccctctgtagcttgctagtccaggggaagcaacatatcatggtgtgagagagccctggggagaagcccatatgacaaggaactgaggcttgccaaaaaccacctgagtgaacttgaaagtagatcccttataatcccagtccagccttcagataagaccatagctccttgttcccagcctgactgcaatgttctaaaagccccagagccaaaggcagccagctatgccctaccctccggaccatagatgctataaagcttattgtcttaagccactgggttctggcatagtttattatgcagcaatagataatgatcctaataatggcatcccaagcagaggttacaagtaagtgcaaaggccccagggcaggaatgtgctagatggctagcaaggtggctaaagtggctggagcagagtcagctaggggcggaaacagaagaagtagactggattggatctgagagccaagaagccactacagctgtctagaactcccatgaaggtaccctgtaatacacattaaggcatacattattaacaagttcttttagtttcctctgtgatacttgcttgttaaaccacactgatctctaacaggctgaatttcagataatttcatttcattttctgcatggatatggtctggcttgggaaagcagagagggaaaggggaaataatggacagtgggcaaaacagtcacatactaaagccctctgaagaccaccaaactaacccagaaggtctaagtaggatgaaactttacaccaggagtgtccaatcttttggcttccctgggcaatattggaagaagaattgtcttgagccacacataaaatacactaacaccaaaaatagctgatgaccttaaaaaaaatcgcaaaaaaatctcataatgttttaagcaagtttacaaatttgtattggggcacattcaaagccattctgggccgcatgtggcctgcaggcctcaggctacacaagcttgctctagactcatgaagaggaggacaagctatgattaacaggtccaatggctacccgatttgggataccatgacagggcaacaatgtggccctgggaaaaacaacttaaagcaaagtaacattacttgccctttactctactctctcccaacatacagaaggacagacagactcagcacctgcatgcacacattcggggaagcttcagtctgggataacgacagagatcaagactttcgtgtgtcaatctcttgttttaatccttagtcccttactcaagaattacgctgtagacaactttaaaagaacatgaggaggataataataaccaaatatgttcggcaatagtaaaacaaatattatgggtctttattacctaggtaaatcacctttctaaaattctatatataaactttatattaaatttttaatgcaaaagcatatgagttatatttaatatacttttactgaaatgaactcactgcttgtaatctgttttgccccatgaagggcacttgtgttttctatttctaataatgcaagcatctcctgctaagtttttgaagatggaagaagttaaaacaagattagctgaaagaaggaaatcacttagttacattttatgtactagacctcctaacccggactagttatattttccatgtaacaaatggaatttccataatttgtacaaatataatttggctagagtatttggtaaatagccccctcgttggctgaaggactagtcctgaagaacagaatctaagaaccatcattaaaaatgcctaatcaagttgcagctaagaggtaggtggatggctttacaaagtgttaagactcagctaagtcttaaaaaaccactttagaattaggtccaaataaacactgtagaagaagctatgttaaattatcctttcagaggttctcttggtgctagggatcaagaacacttgaagatcagttttctcaatacaggctatattattattggcatgaaatccagagatcccactatattttcttattttcttttacaagtgccggtaacttcatttttaataatttggcgtggaactgtgattttcagtttgggaagtaatcctaatcaaaagacatgctttcaagaataaggcatgacatccttacaccaattaccctgagtacagaataatatttcttaaggaaatcgaattgtcgtggacaaacagtttaccctcttcagaggacaaaagaaggcaggtctatttttagcctttcgcaaaacctcagttccataaaggaagcactggtctccacaaatccattatcacaaacaaaatataacggttgctgatcaagataaatgcaagctgcatatattttccagaaaagttctgaaatgaggctgaacctgaaatcctgggaaaggcaggtgaaggacaattagagaaggtgtcccttgtagtgcacaaagacagtaaaacttcgccctcactacgcctcacctatgtttgagggagctccatgcgcttgcaatcaggagacccagttttatggctctgtgactttttttctttctcctgtccgatcataatcctgattccgatcccaggaatcagggccctgggaactttttttttttcccccaaatgcaaaggattttgacatcagtatgtcacaggtgaaggcattaaggcgcggcgagcagcaatgacttgcccaaactcacagcccatggcataactagaatgcaaatccacgtctgtcagcctgtaaaagtcctcactactagcctttcagttttctcaaaagcaaagagaaataacgacgacatccatacagcagtgttcccggaaacttggaaggatgagattcggaccaagcagctgaacggtgcttcctaaagcgaggaaggggtgtgcaaaatgatttccccctaagcggagacgaagagctggattacagcccccgccccagaaagcccctaagccctccatcccgagtcccccatccaggctgcacgcgactctgcagacctccccgtggccagcgcggcccagcggggaggggaagggggccatgcaaaaatggggcgcgctcactccatccccactcacctgtcagccgggccgcgccacggcgcacgcgcagggccggaggtcgcgcgcggagccggcacccagtttccacccctccctcaaggcggcggtcctcttctatccgcagtcccggacctggagcgggtcagaccccgacttccgcccctgactccccaggcggtcacatgaccgaagcggctgggagcagggaggggcatcatgt

SEQ ID NO: 2882 - DNA, 67559 bp, Homo sapiens
  source 1..67559: mol_type = genomic DNA
ttgggtactagtaatactattttactgaaaatctggagttgcacaaatagttctttagaacataaaactaaatggatttatacataacagttacattcagcatttaagagaggcagtacaaaaatgtgttctgcttttatctgatataaattgcatgtaataccatgatttaaacaatatcagttatattaactaatgccatgagatatatcttactcagaacgtctgatgtttcccataatagacagaaaaaatgcagttgtatgagcaactgagtttcttttcatcttcaaattcatttgtgatggtgggaagatctaaggacaatccttccattgaagaagtaggaaaaacagttacagcactgttctgaactcatcaaaaatgaaattaggcacatgtgcttcagcaacctgaaaaattaaagaattaaattattcatggtgttatagttgaacaattacaaaattttcatacgtaaaagaaaagatatccttggagcaaggtgaataatagaagaggagactcccatgggcggacgactccttgaaacagcccctttctgcttgtggtgccccctagactagcgtctcatttcttggcactgctaacatttgaggggatgcagtacagctctcccgcctccaaatctgagcttcttggctcttaaaggtaccttgatctgcgaggaatgttcttgcctctgggaagtactgacaagtactcaggtcacctaatacacttcattaactgatgaccaacaaggaagaacaggatggctggcaagtgatggggttggagaggtaggggagggcaggaatgagaatgagataccaaggccagaaggggaagagcaggaaggccttcagaggcatgcattcctgaactgttcttgggcaaagccctgagaagactaaattgggctcagttgggtagaatgtagaggtaggtgatctccaagtgctggagatgagtattttttagaagcagtgtttaattttttttctgatcataaaggtataacctgctaatgagaggaaatttagcaaatgcagaagagtataaaaattatttttacagtgggtggagggcaaggggagggagagcattagtataaatacctaatacatgtgaggcttaaaacctaggctgggcgtggtggctcacgcctgtaatcctggcactttgggaggctgaggtgggtggatcatgaggtcaggagttcaagaccagcctgactaacatggagaaatcccatctctactgaaaataaaaaaatcagcagggcgtggtggtacgcatctgtaatcacagctactcaggaggctgaggcaggagaatcacttgaaccagggaggcggaggctgtagtgagcccagatctcactactgcactccagcctggcgacagatggcacatgtataatacctatgtaacaaacctgcacattctgcacgtgtagcccagagcttaaaatttaaaaaaatatttttttaatcttaatcccttaaagaaaataaaaactggcaacttttgtaatgaatttttccagtttacttacatatgcagacagacacacacacacacacacacacacaatcaaaattaggatcacataatattgtgtccttctctacctctgctaaatcttatattatgaacatccttgggcacatatcttggtaaacctttgcacatatatccagcaggtaaaattcctagcagtggaattgctgggatcagggtaagtatattacaaatgtttttttaaaatagataaagctaaattgccctcctcaaaggctgtcaatttacattccaattaatagcacttacaagtcccatttctccaaatgcttccgaataatgggggcccaacattttacctttcaccaacctgataagtggaaacagtaattttcgtatttggatttttgtcccttgaatccgaaggtttgtcatttctattttcttgaaaactgcctcttaatttcctttgcccttcccctgctttttttctattggcttggacatctttttcatactgaacttgaagatttgaagagcacactataaatcaagaaactagtcctttgttggtatttcctcttttgtcttttgttttttaactgagacactgacacagaattaattacattcagcatttataaaaaatcaagtctctaaatctttttctttatagtttcttcttttggttttatacttaggaatttctgagagctgatacatatttgcctaaaatttcggctaatttatttgtttcatatttcacactaaccctttatctgtaattaattttgataacataggagatgtaaaggggactaagttgctatttttttaactgtgtgaacttacatctattgactaatattccctttctctcttaatttgagatgctacttttccttatgtaccattgtatgcacagggtgtgtttctaggctacatattcttgctcattgttccttctatttagttgcataccagtagcaccctattttggtttctacagttttacagtgttttaatacttgatataatattttaatatcttttttttaaaaaaggacttgcctaagtcctatgacattttaaaaaatatattctttgaagttaaaaaagtacctgaaatcttgattgtaactgcagtaaacctataaactagatagaactattatctctgtaatattcgaggaccctcattcagaaacatggactttcaaattttatatttaaaatttttatagttttttaataaagtgttctttcatatttcttatagaggttattcttagctatatcattgccttgttatttctgtgaataggtcctttttcacactgtattttttaatcgattgatgtatttcatacatttattctgtagccagcttgttttctgatctctgtattattttgatagtttttcacatgattctattgggtattcaaggaagacagttatgcagcaatcccactactgggtaactacccagaggaaaagaagtcattattcaaaaaagatacctgcacatgcatgtttacagcagtacaatttacaattgcaaaatcgtggaaccaacctaagtgtccatcaatcaatgagtggataaagaaattgtgatatatacatacgatggaatgctacgcagccataaaaaagaatgaattaacagcatttgcagtgacccggatgagactggagattattcttacaagtgaagtaactcaggaatggaaaaccaaacatcgtatattcctactgatatgtgggagctaagctatgaggacgcaaaggcataagaattatacaatggactttggggacttggagggaagaatgggaggggagtgaggataaaatactacaaatatggtgcagtgtatactgctcaggtgatgggtgcatcaaaatctcacaaatcaccactaaagaacttactcatgtaaccaaataccacctgtatcccaataacttatggaaaaatagaataaaaaaggaagacaattaatctcaaataatacagagtttgtcttctttccaatatgcattttattttcatttcatttcttattgtcttgcacctgtataacaaaagtagttgcaagagtctgtatagttgtcatgacactgtgacagtcctggctttaatgggaatgccactaacatttcactattatgtactgacattgctagttaattttaaaagttcatctttggctcatgttgtaagaaagtatctttgattcctaacctactaatttctaaaaatcaaatgattttcagtatctgctgaaagttgtatttttcagtatcaagctctccactttgagctaaaatttaacaaagtggaattactaatgagaaagggataggaaagaatgtcttggcaggtaaaaagtagtctgccatttttggaaacagtgctcatatatacatttagttgtggcatgaacttaactgtgcttgctgtgggaaccaggtcagtggagagagaaagaacaaaccaccatgattatttctttcctctggccacttaaggaatccctcctggcttgcctatttcacttaactcctgaaccagatgagttgctgacaggagtacatggtggagaggaagaagaggcgggaggggcattgtgttaaactctgcaaggcaattcccatggtggaaaaggcaaggacatttcagagctgggggtagagcagtggcgagaggcgcagaggcatctactgtgaacgacctattgggcttcactcctgatgaatccagggccactattattagcatctttttacaactattaatattgttctttactatctatcacttaccctcctgggtagctttgtgtaccgaacataatcctccaggaacagaagggcacccacaacatctgcaggaatttcaggtatcttctggctgtgatagagaacagtttagatcaattaactgctttgcacatcataagcccttttggtcagaatcctgaaagactaaattaccaacagattacctaatgaagtcaaagatgaacaaaaacattgagcatgctcttaattcctgtcaagttgttaccttgctcatgtattttcaggagcccaccccatagggtaaatgtgagcttctctatacggtttccatgggcgtttacaacacgatccctgctatctatccagactcatctccctctgtttacatgattcaatacctagcaggtcccatactttcccatccctgcacacttttttttttttttttttgcgacagacttttcactcttgtagccaggctggagtgcagtggtatgatctcggctcactgcaacctccgcctcccgggttcaagtgattctccagcctcagcctcccgactggctgggattacagatgcacgccagcatgcctggctaattttttgtatttttagtagagacggggtttcaccatgttggccaggctggtcttgaactcctgacctcaggtgatccacccgccctggcctcccaaagtgttgggattacaggcgtgagccaccgcacctggcctgcacactgatttgaaagtaaacttctagacattgttcgagtctcagcttgggtacttctcctgtggaatcctccctgattctcctgggctgtcataatagttagcagcattctccaagcctcttaatttttcaatggtgtgctgggttcccatcaggagtataaactcctcgagggcctaggtcatatgttcatctttgtttctccagcatctggaaatgtgcttggcatgtactgcatatttgacggtatcaaataaatacagcatctagcaatttttcatatgggattttactcatgtattcattcattcagcaactacagtgccaagcactgttccagagctgggaatacagcaaagtacatgccaggctccttatagagctaacgttccttcttgtttacatcaaaaggagtttttaggtgttaaaacgatttccaattcctgtaccaattggcattttctgattaacaaataacttttagtactattaatacattactggttaatttcgctgatgaactttgctttttgaatgggttaagaatgactgtacctggaaaaattctccctgctctcaatctttcaatctgtgaccagggctatatttgctctgcttggagcaagagaaaggaaggaattcccatgcgtcacaggttccttagattcctttgctctgctgaatcagaaagcctgacttacagctggtctcctgtagcctgatcaccaccctcagggttgccaataacatgctggactagagccacacttaagcctttactgccattagtgaaaaagaaagagaggaagaagaacctgtccaagttgacagctagggagctacaattgggacagccagttgtgtggaggttacttgctaatcacctccgcaccacctgaactggagtccttcccctcctctctgggagcctgggccagaggcgctgggtttttatgagcctactgctttccttgccaactgacctcacttcgtgattgttacaatttcatttttgagactttgagttctcctctatttttcaattgttaaaaaatcttgtttctgaagcaagtcttaacatctatcccaggaaaacaccagtgtttgttgttcgattcattaactaagaggaggaggagctggcctgactgcagctcacgggaaataacgacattggggtttagaaagaatgcaaaatcagtaggagccactggtatgcactggatgtcaagaaacccatcactgcaaagccgagatcacgccactgcactccaacctgggcgacagagcgactctttctcataaaaaaaaaaaaaaaaaaaaaaaaaaggactcatcactgcaattgtagctgctgtactgtccacagagggcccagaatgaagacgtgtaatactcctctgtgccaaggggagggctgtgcttggaatctcaatacaagtttgggaagccacattttaagatggtcaaaaacagactggaacacccagaaaaagtcactcactatggtgagcagcctctaaactgcaagacatcgggaacaggtggaaggggcttatctaaacattgagaagacctaagacaacagatggcatacaaaatcggaagtgatgttgcaaaggagggagactgcattattctgtatgatttcaaaaggtaggaaaaagctcagcgagtgaaacatccagagacacaggttctaataatcacaatcaggaactttctaatgagaacaagacttagccagtggactgtgctgcctggagaggtagcacaagccccctcggtgagagtgttccagcagtggctgcatgactacctgtcaaggatgtcctagagctcattcatgcacttagtgggaggtcaattaaatgacctcgaaaatcatttccagttttaggacttagtagtattttgtgtggacttagaagatcactttggttcgttttattttttttgagatggagtctcgctctgtcacccaggctggagtgcagtggcatgatctcagctcactgcacctctgaggcctcctgggttcaagcaatcctcctgcctcagcctcctgagtagctgggattacaggtggccaccactacatgtggttaatttttgtgtttttttagtagagatggggtttcaccatgttggccaggctggtcctgaactcctgacctcaagtaatctacccaaagtgttgggattacaggcttgagccactgtgcccagccgctttgattcgttttttacattatagtggcaaaaatgaccaagcaaacatgacagcaaaggttatgtagccaggctgaccctttaggatagcagagaaggaggcacaggacccagcatctcatggaaataacttttttttctttatcccagaaaagccacatttaggggcaggggaaaagaactggcaggaattaaagttttataagcattgtatcaaatagcaactcttgtgaaatttgcttctctacatgcagacactgcccaggctttgacacactgatatgttctctgactcccactgaagtgagtggaatcatctcttggcagtggcccagcaggagtgcaggggctcgctgagattgaagagctgcatccaagagtgcagaggaacagggctgcactttcttccccatggtagttactattcatggtcctgagtcactcctggaaaatcaatgtgagtagaccggatggagttcccctggcagggtgactaaggatggacacacctgtaattgctctaaacaaggaggtatgccctgacttgctttacagagaagggtgagcaaccatttcccatctctattagggcgataagaggaatttggtaatgtgaggtttaagttaggttttgtgacaagaagtcccacgtagtcctggttggtcttctgtaccttgtacactgctccaccgtggagcagataaactggccaatcagcgccaggaactgctcggtgtaccgggaatggaactgcttcagcagagtgagcagtcccaggacaagtggtggccaatcaaccgggtcggtcggttttcggcagaccattcctgcaagggaacaagttgcaacaccatatgaagtacttgccttcagcaacattcattaaataccaacgctgtgaaggtcaaaatgtttggggcccatattctcgctggcagatgatattttggagggaatgacaattctgggccatattttgaattagccacaggattggtagggcattccaggggtctgaaggattcaaaaccaataaaacggttactaaattttgtaattatcattactggttcttttgaattactcaattaacatatattattgtagcaatttttaaagatacagataaatgtaaatgagaaaaaaaatcactacaactgacttctgttaacggcagcatgacatactagataccctgaactactatcttaagtgaaaagctggataaaatacttttagggtatctttaaacaaatgttgagtaatatatatacataaagaatctgcagaaatcaagagagtggaagaaggatatttatgaagtgaatgagtatcaaagctggcctttacactaacgattttttaaaaattggagatggggtcttgctatgttgcccaggctggagtgcagtggctattcgcaggtgcaatcacagcacattatagccttgaattccagggctcaagctgggactataggtgtgtaccactgcacctggctctacactaaagatttctgccaaaatgtggagaccctgacctctgcctgggtggctgcatgggaaaccagagacagagattagggtcttccagaagaaacacaatgttgaaaaagaacagtgttgggaaggtttaggttgcctgatttcaagctctctatacagtttcaataattaagacactatggcataagaacagacaaatagatcaatggaacagaatagagtctagagatagtcccacccttctatgagtaattgaatagtcacaaatataccaaataataaaaaaagataaatcttttaacaaatggtactgaaactggatagtcttatgggggaacgacaaaccttgacccctatctcatactgtacacaaaaaacaattagagatgaaccactggcctcaatgtaaaagcaaagactacagaactgtaagaaaaaatatcgaagatatctttgtgaccttgaagaaggcagagatttcttttttttttttttgagacggagctcactatgtcacctaggctggagggcagtggcacaatctcggctcactgcaacctctgcctcccaggttctagcgattctcctgcctcagcctcccaagtagctgggattacaggcgtgtgccaccacgtctggctaatttttgtgtttttagtagagacgggtttcactatgttgaccaggctggtctcaaactcctgacctcaggtgatcctctcgtctcagcctcccaaaatgctgggattacaggcatgggccactgtgcctggcctggcagagatttcttagacaagacaaaaaagaataattataaaggaaaaaaatggataaactggacaccatcaacagtaaaaacttctgctcattaaagttaccagtaaaaaaatacatagataagtcacaatattctcaaaacatatctaataaggaacttgtatccataatatatacataactactacaactctgtaataaaaaaaaaatttaaaaacgagcataagactagaacaggcacttcgcagagaaggatataaggaatggccaataagcacatgaaaaagtgctcaaaatcattaatcatcagggaggcaaattaaagctgcaacaagataccatagatacccatcaggatggctaaaatgggctgggttcagtggcttatgcctgtaatcttggcactttgggaggccaaggtgggtggaacacttgaggtcaggagttcgagaccagcctggccaacatggtgaaacctgtctctactaacaatacaaaaattacccgagcatggtgatgcatgcttgtagcctgtaattccagctactcaggtggccgaggcagaactgcttgaacccaggaggtggaggttgcagtgggccgagattacgctactgcacttcagcctgggtgacagagtgagactctgtttcagaaaaaaaaaaagaatggctaaaatgaaaatgactgacgccaccaaataatggcgaggatgtggactacacatatactcactcttggtgagagtgtaactggcacaaccactttggacaaagggttggcagtttcttatcaagttaactggttagacagaccctcaggtcccatatttgacttcttgtgaagaccggaaaatcttccccaaaccagagaagcctaaacaagtgatcctgaataacctaacctaggccttggcaattcagaacatggaggaagaatcctaacaggactcagtatggagaaataatcctttccaggtggaaagcaagagtgatgttaacaacaaacacttctacaactagcactacaccacgaagcttctttcttcaaacacagaccaagccaggtatgcatttcataggccaatgctgagaacggtgtttacaaggttaaataaatgtttttcggatatacagtttcaaggctctctttacagtttcaataatcaagacattattggcataagaaaagacaaacacatcaatggaacagaatagtctagagatagtctcacccttatatgagcaactgaatacccacaaagataccaaacaattgttccttcctcagtcctactgtaatttagttcctgcattaacacatcagtcttattgatgagaagaattatagtcagttataaacaccacatttctaggatacataaagattttgttgtgttatgttttaagatctgggaattccagggagagtgatactttccataagcagctttacaatcaaggtgccaggccctaatcatatacacaatgaaaaaaaaattagaatgagaagtcaacaaaaagttattctttaatgaaaagaaggttctttctgcactgacagttcattatcaagaatcatatattcctattgaataataacatagaacagagagagaacatgaatctctgaatcttcagatgaacctttacattacacttgggatggccctttaaattgattttgaccaatatatagaaagggactcagcacctgttgggcactcagtttgcggtgacttggccaaagtcacataggtgataagtggtgaagccagattccaaacacacattggttccctccctcctacagcaagtattgtttgaggagatcatgctctgccttctgtgacaatcacaggcattgtcatggaagcagtgtctagaatcaatgattacttttgaatgagagaataaaaacattaaagagattccacattttcaccctaaaaaagcttatgaaataggaaagtactgtaaggaagaaatatatttaggaatctctagttaagaaacaatgattacatttgtagaaatgctcttataatgcttttaaagtaaactaaagtctatagtggatttttaaaaatgtcatttagctggatacaaagtttgaaggcagaggaaacactttgttatctattatgtaactacaaaaatattctgacgaatgacaaaaataaattagggttatattcctggagagaacagacatattgaaaggctttggtgtctcttgtttgtacagaatattctgacatacaatcatacataaagtattaaatgttcatgtataaatattagtcttatctccttaactatattgttacttttcccatcatggttccagatacacagctggcacatgcatcctgttgaaagaacagaacatcaaccaaaaaaagtttctttcacaccacaattagctgcctaaacattaaagaagagaatcaaaacaaaggtccctcacattctacaagctggacaatgaacccttactgaggtagaccatactttgttgattttaaatccactgtctagggctgggcacaatggctcacgcctgtaatctcagccctttagttgccgaggcaggtggatcgcttgagcctaggagtttgaaaccagtctcggcaacatggcaaaaccctgttgctacaaaaaatacaaaaaaattagctgggcatggcggtgtgcacctatagtcccagctactcaggaggctgaggtggaaggattcttgagcacgagaggtcaaggccatagtgagctgagattgtgccactgtactcccatctgagtgactgagtgagaccttgtctcaaaaaataaataaaataaaataaataaataagtgtacttaaaaaaaaaataaatccggccaggtgtggtggctcatacctgtaatcccagcacttagggaggccaaggtgggcggatcacctgaggtcaggagttcgagaccagcctggttaacatggtgaaaactctgtctctactaaaaatacaaaaatattagatgggcgtggtagtacgtgcctgtaatcccagctacctgggaggctgaggcaggagaatcgcttgaacctgcgaggcagagactgcagtgagctgagaccacgccatcgcgctccagcctgggcaataagaacaaaactccatctcaaaaataaataaataaataaataaaaataagaataaacccactgtctacagttcataaaaaggcattgtatttcaaaggcataaagactcgaatttcataaacataaatttaactaagaaaagatctcatatccgacataggcattctatacaaaaagctatttagttaaatgttaatctgttggtattgttactcattgcaaataataaatgttatacgtacccagatttttgttgtattgaagttttggcaactgagcgatcaaaaatagaaagtttacaattggaaaatagggtaagcgctttgttgttatgtatatctggaaagagaaaggtaagaaaaatagatggttaaatcacattgcacaataccacagaacaggtttccaaatgaaaatcttccattttacttcaatttgctctttggctttcctgaaatgtggatggttccattaatttgctgccttcagagttttatttaacacacctggccctggccacataaatacctgtatcataatttgcccttctgggaagaaaacaattttgcttagaaagacttttcccctgaatcctgttaatgtcattaataaagggagggaggaatgagtgatgagcaagaatgggaggggaaggcaaaatgaagagcagttgaggaagagctggaggtgaatatagggggagtgtgggagagagaagagagagagagggaaagagggaagaaggagaggaggagggagagtgaagggaaaagatccatgtagcagcgagtggtggtatctaagtagaaagagagcaaagttcttcttgtcatttgctgtcccctaggcaatgtcacagagcagtctcccagatgtcacggcagaaactacagtcagggcgtacatggccaggtccagactgccagctggccgattccataggagacagggtagcacacgggtcagaagcaggggctctggtcagactgcctggctcctccacttgctagctggcctctctgagcctcgggttcctcaactcataatggcgtatttcatagggcttgttgtgagatgaagtgagataatccacaatcagggttaagacagtgcacttgttatgcagtaaatattcaagacattagctactattcaggtttataatcttttatccaaaacacaagggataatacagctttcagaatttcaaattttacagatttagaaagataatataggggctggcgtaatgcactataatcaaagttactataatcaaagtctgcatcaaaatatatgaatgtttacagtaaggaggataaataactagtataaacagccttatgtcagctcaggacagattttgccatgcaaagagatctggcaccgagttatgaaaaaactttcagttcttagaggttttctgagctcacaactgcagggaagagtttgtagcttctatgatgagtgggattactgtcagccacaaggggaagcacctttggcaagacagatcaatgctaccattttgggtttgttgggccttgatgactgaacggcaaaccccagtgaaacccaaaactaatctcttacacggaggcagcaccttcccctttgtcatgagctttcaccagcgctatagcacttgattctcacagacctgagccaggcggggaaagtgtgatgattgcttagaaagggcagggaactgaatggaatgaaggctctggggtctgaacccaggttcctctggtatttctgcacagtaatctgttacctgggccaaataccattctgtacccccatccccgccattatatattttaattactcaccttattcagtgggttgtgaatgccagctgcctccagataggctgtgatttcatataaaagtgtgttatcttctttggggtaaggaagtgaagggtcctgatagtgggcttcaatgtctgctaggagagccctaaaggaagaaaaaccctggagataaacattagtgagtaaatgaatttatacaagagttaatatagggcagtgatgtaatcttttcaagcctcagtttcctcatctgtaaaatgagagcttgatctcgctaattctcaaccatgcctgtgattggttttaagtggaaaatttgacctagaattacttcatcttttggaatcaacctcaatcaaatgcattcaccattcaaattttcatgtattgactgaactgttcttaatacctgctttgtcaaaagcactgacttggtgagtgagaagcacagattatttatctgtaagtaggcagcctcaaatgacagcaggttgctggtgaggcggaggatatgagttccctctaggacaggcctccataaccactcttggtaatcaacacacttccaactgccctctggatgatgagtgatcagccctgtaaaaagccagttgcggattttggtaataattgctttctaaaatctgtgcaagtatctagcagtgtctggtgtgtctctcactcgctctctctaatgaattcatttgttcagcagacatgtattgaatcatgtgatcagtacctgtctgctgaatacacgaatccattagagagagtgagtgagagacagagataaacggagggacaatactgaggaaagaggctccgaagacagatttgattatccgtggcaaggaagcctgtaaattcagaccttccacccaaaaataacttaaaagagtaagaactgaagaaactggggtgcgtagataataaacaatccaagcccacggatggctgtttcaaaccctggcacttacttattgagattctccagagcagctgccagatgtttagaatcaaaccgacaagaataatttaattcattggcaatctgttgtctcagaatctgcatctgcccaacctgtgcacaagcaagagaaagaacaggtagtgcattcaagcatttcagagtgacagtgaggaggtaaacacaaagatgacaattcttcactgggccttcacatcactctacaggaaaaaaaataaggatttcctgaactgatctcttggctaagaccagcactggatctaatgaagcaccagaggcccttcaaggaatgtctggatggattcccataccccaacctaaaaataccccaaagtctatgattcacaaagtgatctattaatgttcagttgttcatgtatcaaagatgtcttttttgaagctatatttttaaccttttggaataagtgctccaaatttagtagctgctgtgagaagtcttacttacttccttttatttatcctaaatggaactttctcaagctctaggaatgccatttcacactagtattctcaaattgggtgaatattaagtctgtccatgccactcaggattataggttctataattatctggattacaaaataatctacataaaatctttcacgaaaattttaacaatgatagccccttaatccagggttcttaattttttttgtgtgtctgatatggtttggctgtgcccccacccaaatttcatcttgaattgtagttcccataatccccatgtgtcatgggagggacccagtgggaggtaattgaattatgggggtggttacctccatactgttctcgtaatagtggatgagttctcacgagatctgatggttttataagaggcttttctccttttgattatatttctctttcctgttgccatgtgaagaaggacatgtttgcttccacttccaccatggttgtaagtttcctgaggcctccacagccatgctgaactgtgagtcaatcgaacctctttcctttataaattacccagtcttgagtatgtctttattatgtgagaattgactaatatagccttggacccctttgggaatctggtgaagcctatggacaccatttcagaataacgtttttgaatgtacaaaataaaacatagagggtaacagtggaagccagttgtaatgaaatataattaaccattcaaagaacaaatctgtgatatagagttatgctaggatggtgtattaactacagtactttaaaagtagctatgagcataaatgatacttggagattatctgcaatggttggatgataggaagcgatctttgggtcaggcttgagagttcagtttgccctcataatgttgtctgcatcataaggtcaacagcacactctaactttttctgcctataaatgtcttcttttctactcggacaaagtattcctaaaagactggcaaaggggagtgagggaggtggggagaggagggaagacagtattataatgcaagcagcaataaggtggaaataaatgcatttcctctgagttgctgggggcagagaagagttaaggaaaagacaggggctcacgcctgcaatcccagcactttgggaggccgaggcaggctgatcgcttgaggctaggagttcgagaccaagcctggccaaaatggtaaaactctgtttctactaaaaataaaaaaattagctgggtatggtggtggacacctgtaatcccagatacttggaaggctgaggtatgagaaacacttgaacccaggaggtagaggttgcagtgagccaagattgtgccactgcactccagcccaggcgacagagtgagactgtctcaaaaaaaaaagaaaaggagggtggccttctctaagaatgagcaaaagttacttagctaaatggagcttgtaatggtcaaaagtattaaatgacctcagatgtattatttttgaccactattcatacaagactattactctatttatgtgaaaaacgtcaatccaaaaatgctatttataaataggaagtgtttgaatttatagagtagcattatttaaaaattagaatgcagcaaatccaagaaaatagtaggttctttcaggccacataaaaatgtccctgaaaccctgtatctggcccatataattctttgcttaattttctatgtgtagtatactctgtgtcaaggatcctcttgaaaatatcaatctagaactggaaatagaaataaagtcagtttaatataacttgctctcgtttactgcacaatgaatctttgttagtgacattttctatttttggtactcacgcacttcaagctttaataagctgctgaagaggctaaggagcctgggatggatgagaaacttattctacctactcatttgcctctttggagatatctggcttatcactctttctccaagatttttctagagttgcactattgagtacagcagctcctagcgatgtgtggctatttatatttaaattaatatgaaataaaattaaaaattgcatttcactgtcccacaacccacatttcatgagctcaatagctacacagggctaggagctgctgtcatcatcgaatagcacagaacatttccattgttgttccagattattaacactggctccgtgactgtacgcaccctaattcaagacaaaaagacaaatttgtcctttggggctttatttaaagatcactgactcggtcacagtcacgtggctgttactgaattactggcaactataaccaatagttggaatagctactggactgagaaccctccagtaagcaaggggaaaaccttccagtttcttggaagaatccctgtaatccccctaacgcctcctacagagttgggactcacacctgtccaaactcgggtgattctttattcctcctaaagggttttccagcaattagaaacttggcctgggaagcgcttaatatctgacaatcatgaggctaggggaaggcagacccacatcacgagaggatatctagcagagccatgggctccttgccttacctgttctgtttaatgatccaaacaacaacaacaacaacaaccactcaccaaaattatgggaaatatattgtgaatttggctaagataccaatgagtgctgtctcaatgagaaacttatataattgggaatcagagaatggaacttttcaaaattcccttagcattctagaattctagacttttctacagtatgtgatatttttgaccacaaaccagttttctaccaggaagtctactcttccctgctagattgtgagttagctaaggagaccggtcatgtttcatttaactctgtctttcacagcaactgacaatgccctgggtataatgggtgtgcaagaatgggctgtgatgatctcagattatcagatgatgaaagaagactcgcagaagatgcaggggtccctgggagctcctactgccgagtaaaggcaggaaactaggcagctggattctaaaataagttagacttccatccagcaaattaatctcttcgtctttcttattcatttccaaagtaagactgctttctgcagagtataaggataatttatgccccaaagaacctggcttcctaacatctatgcagacacaagagggcagagagacaatgttctgttctaacagcagcttggagcagatgaggtgtgtataaatgaactttgttatgtaaaaagggagtattactgtgcaaggaaaagttcaattttcatatataaaagcacctctagccaaaaggcattttacaaagagccagttttcttgaacaaaaggaaaacgctaggctcctaaaaagcctaatcaagaacagatccagaaacggagataaacaaaatgaattttaaaatgataaactgaagtattaaaatatttttgatttaatgacaaaagaaagaagagtagctttttttgggcaacaaagttacaagaaaataaaaaatttaaaaatgtaagtattgactgtacaccctctcttctacaacataccttcattatagcctcgagatacgcagtccaaatcttctgtgttttggcaatggcggaaaaataaattttatttgaatttgctgaaaagttaaaacataattttctctttagtacattcgtaaaggctacagtgtcatccccgcctcaggtagtttcaggacactcaccgacaatactttttaggggactgacagcattcatgagggtttttaaagtgtcctgaacagttctgtctctcaggataattttctgaaacatactgaggaaattctaaaaacaagaaggcacggtcaaagaaccaaacataatgaattaaacaagcaaattctccagttacctaaaatgctatgcagaacagaggctgggcctaagtcacacaaaacctctaaacaggatgacagcaaaaagaagcaacttcaggttcctgttagaaacatcccttgctaggaaaagtcactggcttcaaggattaaaaagtcttatcttcccaagttgaaacttacaaaaacagtctaatcctaaaagtactatgctggccaaacaaattctagtttattcccagctctgatctacccagtaggtatcatatgcctaaagtcagtgtaagaaatcatggaagaaaggttaagtgagttcaaactgcccactaaaatatgttcttgcctctcccccagggtggcagaaaacaggcatgaaagtcaaaaggctcacctgtaactcttttacaatcataaagcacagaagcctgtctaagccatttagaccaaaggttcccaaggtggtctggatttctgagaagaggcggctgctggtcacttcctgatgagttttcatatcataccaagtgttcagctggtctatgtgacatgtcattctaaaatgaaaacaatgcaaaaaccccagaatggctcagaattcatccttaaagagatgttaggactcaacaggacatgcggcaccaaatatgaagaacaggagttacatgatctgtgttttctaacctctgtattcaggcacccaatgcgtcttcccagtgacacccaatggaacaggaaggtaaaattcagtctgacccccttttcctgccctatgccatatcattggtttcagtcatttatttccattgagttagggtgttgacttggaatcatgctgagaagacaaggttaggttcagctgtcaggctggaagactttagagcccatttgtctctctatgcagccttcctttaaatttccagtttggagacaaaacaaggccttgtgtcatttccatttgataaaaaaggaacctagaatctccatatgctacctaacatttgagactatgacgacaaagcaatttgctttttcctcccagttccttaaacttgtagatgccatcttctggtcctctccaaatgattctttttagactcagaagtgtgatgatgacagtgacaacaaccaaccatatttactgggcacttattgtgcaccaggtgctgtgtgtgctaagacctttccatgtgctatttcatcctcataatagctctgtggaatacaaaccatttcatcctcattttatagataattgaggctctcataggtctgaccaccacccttaaccaccatttcaatggttttcaaacactgagagagggaccctgagtccctggtagagcttgtctgaaatacagatgcccagcttccattcctgacgaatctgatttaatagttctgggggagagctctggcctttgcattttcagcaagctccacagatgacatatcctattgtccaaagccaccacatacctttaccagaaggaggcgtgagaaggggttgaaagagcctagaagcaagggaggttttaaatcaggaagtaaatagggagaacaaaacaagaggattcccaaactgcttacaacttccatctgcttgcttcaaagactccttctgccaccaagtacactctgatgtgtcactggggaggcccccaattctgatgataaaattcatatatgatgtggaaattctggtcacacttaatcctctctgcctgcactaatagggcactgggtggatagttttctaaaaaggcttcggtgattgaaggctaccaagaaagaaggagctatacaactttttgaatcacttactttttttgtcccatgagtcaaaattccttatttctgctagaaattttggaataaggttatgcatagtttctcaactttcacaagtttcgaaggacaaaatactggattagaaagaagacagcacaaaggatccaggtcctaagaagatttaactcacacaagatcaactacacgtgcctgggtggtcagagaacaaagatcatcgcttttttcctgggtaattccaccaacccttctgctcagtgagcctgtgcccaggggtggacatgagaacctgctcttccccaagctgatcttagtaccaacagcttctcctgaggctcaaatgaagaaaaaggaggaaaactggctcagctggacttactagaggcagcatgctagtctctgccgtggtgctcacctaaaatattctcaggagcagttttaattaaatgagattttcacccagttactgctgaacgtagagcccacataacccgtatgtagactgtgattggctgtatacaaagctatgcagtctgcctttcacagtacaatgcctaggagctgggctctggagtcagagggcctggagtgtattctgggtccgtcatttattaactgtgtgatgctgggcaaatgactaagcttttctgtgcttcagttacttcatctttaaaatgggaataagaataatgcctataagattgctgtaaatgggttaatgactggatgtgtataatgtgctgagaagagtgcatagataagtgttcaataaatattagttgttgctatcaaaagtgcttgtgtgttgagctaagaatcgttttgtggagacaggggggcgggggagagattagattcttctaaggagcgcacaacctagatccctcacatgcaaagttcacgctcctatgagaatctaatgctcctatgagaatctagtactttgggagaatctagcacgctcctatgagaatctagcactttgggaggccactgatctgacaggaagtggagctcaggtggtaatgcttgcttgcccatcgctcacctcttgctgtgcggtcaggttcctcacgagtgacagaccggtatcagtctgcagcgcaggggttagggacccttgccctaaagggtcagaatatgagttgacaagtgcaggacccccgtgactggaataggggctgtgccacagggccacagatgcagatgagactgcctgcagtattcagggctctgtagaattcaggtacacctactttgggtctgtgatccgcaggatttctctgcagagtcgaccaataaacgttacagactcatccacaggggtaaacttgggtattggaatatgagtggactggtacatgctttgccaatcttgaatctagaaaacaaaaccatcaatatttagtaaacctttgataagataacctagttatcccttttccatataattttacaaagataatattgcataaagagtgacaataaaggttgttttttttttttagatggagtctcgctctgtcccccaggctggagtgcagtggcatgatcttggctcactgcaacctccaccacccgggtgcaagcgattcttttgcctcagcctcctgagtagctgggattacaggcacccgccaccatgcccggctaatttttgtatttttagtagagatggggtttcaccatgttggctaggctgatctcgaactcctgatctcaagtgatcctcccaccttggcctcccaaagtgctgggattataggcgtgtgccaggtctggctaatttttgtgtttttagtagagacaggctggtctcaaacacttgacctcaggtgatccacctgcctcggcctttcaaagcactgggattacaggtgtgagtcactgtgcctggcttggttttttattttagagacaggatcttgctctgttgcccaggctggagtgccgtggtgtgatcacagcttgttgcagcctcaacctcctgggctcaagcaatcctcccacctgagcctccaagtagctgggactacaggcatgagctactgtacctggcctgtttcttggttttgaagaggaaacttctaaaactgcattaataatagtctcccagaaataccacatataacatttataaaaaacaaagaaacattgtgaaaaggtgaggtgacaaacgagaagcgagaactaagatgagacatgggaacttcggctttctgtcttatgagttgacatgcatccatgtaatataaaaatccaaaatatcataaggctggaatagacttaaacttttgaaaatgtcacccaaatcatgtcagttcccacatgaaaacttgcagagtggctccttgttaactacttactaaaatcaaacttctcaattttggcacttatgcatttggtattctttttttacccaattaaagaaataggcaaaggacttttatgcacatttttccaaagaagacatacaaatggccaataagctgttcaacatcattggcattagagaaatgcaaatcaaaaccatgatgagataccttcatgtgcactagggtgactataattttaaaaaattgaaaataacaagcattggttaggacgtggagaaactggaaccctcgtacactgctgttgggcacataaaatggtgccgttaccgtggaacacagtttggcagttcctcaagaagttaagcatagaactacccattataggtcctagtaattccactcctcagtatgtaccctgctgaacacaaacaaaggagtcctaaaagtcttttgaactgttaatcacttgggttataacaattacaacaaacagcttcattctgtagccatttaatgatgtctgccttcttaggacagtgagctcccggaagttacatgccatgtccacttttctgcaaccctcctggctcctgaaagtactctgaaggtactgagactatctagtaaactttcttgttgacatttctgaggtttgggatgtgtactctaaacatgagaaataacaaatatagtcaagaattttaaaatttattagataccttcgttcttagaaagttattacactcttgctccacgttgtaatttatgatacgagatacttcttcctgccaaatcttcagaccataaatgttgacatagtcctgtatgtattcaaaagaacgatggaatccatccatggtcgctcccaactctttcagcttgggcatcaattcacttggctgtggaaaaggggaaacataaagctcttacactggagtagattgtcaactattcgttctaatatctaactagactttaaatagtatagcaggccagatgcggtggctcccacctgtaaccccagcactttgggaggcttaggcaggaagatcacttgaggtcaggagttcaagaccagcctggccaacgttgcgaaaccctgactctactaaaaaaatataaaaagtagccaggtgtggtgtgtacctgtaatcccagctacttgggaggctgaggcagggaactgcttgaacctgggaggcggaggctgcagtgagctgagattgtgccactgcactccagcctgggagacagagcaagacttaatcttaaaaaaataaaaaataagccaggctcatgcctgtaatctcggcactctgggaggctgagatgggtggatcacttgaggtcaggagttcaagaccagcctggccaacgtgatgaaaccccatcaaaaatacaaaaattagccggatatgatggcaggcacctataatcccagctacttaggaggctgaggcacaagaatcgcttgaacccaggaggcagaggttgcagtgaatcgagattgtgccactgcactccagcctgggagacagagcaagactttgtctcaatcaatcaatcagtcaatagtacagcagctaagagaccacagtcatagtttaagatatactttaagttttggaatactcatttcctacttcatctaggatgactgacaactgatgtcagacattcagcaaataaatgatttcactcatttgggaaggaagcctcatataaagaaataaaaaaaaagaatgactgtgatttctctgtcatttaataaatctatctagtctcagaatacttaaaacattttaaattgaatttactatgataataaagatcctaaatagagatttcaggcctattatttttctcctgagaaaaatgaccatattccctagcagataaagcaaaataaaaaattataacctttatagttcctatctactttagggttaccaaattcttttaactataagaagtacttctgaatcataaaatcagtttaattctgaaatgggatcaataggtggaggaaagaagcactggttttaaaaatatgaagttttaaatataaaatctaaatttcatatttatactataaatttataatatgaatggattataagatcaaaaagcacatcagttgtttgtgttgaaaatcacatatttgatatacgttagctaggaggtaaggtcttgttcgcgataggttaaaaatggcattctagtccatgctgcaagctgggcggagaagaggacaggcccactctggtcactgggtaccttggctcgagggttgaatatcagtcccctatgcagggcaaaggcaacgcgcttcacaagctctttccttattccatcttccagcaactgctttggatccacctaagtgccaatcaaaagtattaaatgatagttacgaaaaattcagtcctaacgaaatccagaggaaagatggctttcagaatctgcagtggggcattttcctacctcctcactaaatgatttgaattttttcctttcctgtccctgtgatcttgcacagcttggatggaattattaaacctgtcacctttttaggactctgtttatttcagcaaagttcatgatggtaattttacaacaagacatttcaaagacggtgaataaggaaagttttaaatggcctcacattctaattaatggcccctctttttggagttttaaatggcctcacattctcattaatggcccctctttttggaggggcaggatgaaggacctatgactgaatttacagatgcatgttcttcctttagattttatttctaggcaccttatatccacatgagcaaactcagatttgaggtcgggccactctgtaaattgaataattatcttttctttcagcattcttggaattagggagataaaataagaaagcaaatctgctatctaactctacaagcttactttgctaattatttctcctataatgaaaaggttttgttattcctttaaaaagtctcttatcagatccataaaacatcaaatgatttttacatactcccttgaattctctgagacttgtttcttttacttttaatttgtaaagaaccattattttaaaaggtcataaaggcaattaatgggttccatccagttttgattgtatttaaatttcaaataagacaactgcaagggggttacaaaaacacaaaagccagagaaacacattaaactacgtcaagatcgttcaatcagggaaatccagactgtggagcaactgaaggtgaaaggccctatgttcttcaacagatgaattaaagggaaagaaaggaaggagggccgggcgtggtgactcacgcctgtaatcccagctctttggaaagctgaggcaggcggatcacccaaggtcaggagttccagaccaacctgaccaacatggagaaaccccgtctctactaaaaatacaaaattagtcgggcgtggtggcacatgcctgttgtcccagttactcaggaggctgaggcaggagaactgcttgaactcgggaggaggaggttgcggtgagcctgcaccattgtactccagcctgggcaacaagagtgaaactctgtctcaaaaaaaaagacttaaaagacataacatagtttttcaaatgggcaaatctaagctatagtctggaaattaatgacatatagtttcactggataataaaactatacacaggaggcctgagatgaggtcagggtgcatgagggggctttcaggagtggggctcactaaatcctatttcttaagtggtagtcagaatgacttgtgtttaccttgtaataacctaataggctacatcattctttctttagttttcagcatctgtgctttattatacaataaaaaggtaaattataaagatatagtcaatgagtacagaatcaaagaagtatcatgaagctttcaaagaaatattccttacaagaacagatttactaaaagagttcaatgctttcgtgaatctaaagatcgcatgcggctcttctaatccttcccgcattctcactaatctgtggaagtgttcacagctaagagaaagccatcttcacacaccccttcctcacatttctattcccttcccctgaagttaacaacagtaactgttttcatatggatcatccagacctttctccattcgtttatatacataaatatccatccttacacatatatttaatttcaaaaatctaaatgggatcatatacatgtatatgtacagagacacgcaagtatatcacacacatatattatacatatatacacatagttgcatgcatgtatatcacacacactacacacacacacacacacacacacacacacatacatacatgtttttctgcaatttgcttttttcattttccaccttggagattttccagtactaaattctttttgaatcgctctagaccaatccacagtacgaatgcaccatggaatatttaaccattcccctactgatgatggatgtttagattacagatgctccttgacttaagatggggttacattccaataaaatcgtcgtaagttgaaaatatcagaagtcaaaaatacactgaatatacctaatctaccaaacatcatagtttagcttaccctacttcaaatgtgctcagaacacttacattagcctacagttgggcaatatcatccaacacaaagcctattttataataaagtattgaatatctcatgtaatttattgaatactatactgaaagtgaaaaacagtatgggtatcatatgaagttgaatcattttaagtttgagacgacctgtatttctttttttttttttttgctgcctctaacaatgaatgcttatatctctgtgtatatctcacttgttttaagtcaatatcaaccaaactgaacctacactttttataagtgtttgaaacacaacctcaacactctgaggttaaagatcagcgagggccacaggattacttttaaaagcccttagttgttattggtagactagcagagagagtctactgggttgaatgtagttggtcagcagagtattccttctgctgttataatctgaaacactgtgggaaaagatcagtattttaccaagcagtcttggtaaaattcttttgataattattgttaattacctgtaagaggttttattacatccttcttacagtggtcactttgcagtcctaggatttatcatcctgtgtgtaagaagtgactaaaatgcatgtacattctctacacatcaattgaattcacctgggatcaggcctaaagcatgtttagcaaattctattaatattctaggaaataccatggtatttcctttagcatacttccagaaaacacataccaaagttccatttaggtacatttcctctattttctttgattttaataatgcaaatattaatatggcaattaggaatgttgagattctactgatgtcagatatatagaaaaataaagaaaagcaccataaactatatgaatgggcccatcgctactcaccataacattccaaattaaaaaagcaatgagatactttatacctcttgggagaacaaaattagaaagtggataatatcaagtattggtgaagatataagccgttaagtcccaatggccttctgatatttccaacttgtgatgagtttattgggatgtaacaccactgtaagtcaaggaacatttgtatctcaacatccatcagtggtggaatagtaaatacaccacggtgcattcgtactatggattggtctgcggccacttgaaaagaatgtagatttcagaggaactcttgcacaggtctggagtggggatatgctcagagacgttcatcatgacattggttgtgataatggggggcacaggtgtctgtcccaagctggatggttaagaaaaatgtggaattctatgcagcagtaaaaagtaacctactatctgacctatagcaatataaataaattgcaaaagcaataaccagtaagagaagctggaaaaagaatgagacttagagcacaatatggttgagataaatcaaaagcacatgcacacatcaaataatgccatatgctaaaaataagaatacttgcatatgtaggaacaattaccaaatccacaaagttggtgctatgggtaatggaaatggaagcagggatccaggagaagaaaaaaataaacaaacaaaagatgacaggagcttgcatgccccagtgatgatagtggtctgttaaaagacggatatgggccgggcgtggtggctcatgcctgtaatcccagcactttgggaggccgaggcgggcgggtcacgaggtcaggagatcaagaccacggtgaaaccctgtctctaaaaaatacaagaaattagccgggcatggtggtgggcgcctgtagtcccagctactcgggaggctgaggcaggagaatggtgtgaacccgggaggtggagcctgcagggagccgagattgcaccactgcactctagcctggatgacagaacaagacccttgtctcaaaaaaaaaaaagggatatgattatcttagctctctgtacctggggtgtgaaataaaagtactaaaaatgaaggaaggaaaacagagagagagaagaataaagcaattttgactaaggaaattgaatttttttttttttgcttttcccaaaattcaatcaaatatatttttcttggatttaaacaactctttgataaaacagtactagcaccacacattttctgcagaactacaagataaagaaattcccactaccttcaagtactaagagaaataaagattacaatgctttctcttcctccatcaataagtgagtaaaacgggctgggcaccgtggctcatgcctataatcccagcactttgaaaggccacgacagatggatcacttgaggtcaggagtttgagaccagcctggccaacatggtgaaactcgtctctattaaaaatacaaaaattagctgggtgtggtgttgtatgcctgtagtaccaactacttggggggctgaggcatgagaatcacttgaacccgggaggtggaggttgcagtgagccaagattgcaccactgcactccagcctgggcaacagagagagagagactctgtctcaaaaaactcaactaaaataaaataaatgagtaaaatgaagaccgaaattggaatgtcaaacagccagatgatgtcactcccttttgcacacatgataattaccacaaaaacccaaacagctaagagtcatggtgcgaggccacgcagactaacaaaactgttaccttgatgatgccaaccaaagtcgttttcatcattaagatgccttcagtaaaaatggaaatagcatgagtaagcttggcaacctataacaaagaaaaagaggtatgaaaaatcactgtctaatagtcctggaatgaacaaagataacaggaaaagaacttgtagctttaggacacctgtgtccacatattctggacagaaatgaggctctgtggtacaactgaaagcccactgttagacatattgggtaacagagtcagaagacaacagtttattctttcatgtttgacaaagcatttctcctttaggcttcattttctcatgtctaaaatttggggcagaattcaatgatctagatgggcccttttggctagaaaagactatgagactgagaaggtaacctccccttccctggcctccccattatttgcaagcaatagcagcagacattgataaggtaggcaggtgctagctatactgttgaatcagaataaacatggaaatatcaagcttgataatctaagtccctgacatatttcttggacttgtatcagaatgggaaattgacactgtacatcatattttcaatcttcacttgattttacttttgatgtctttaaattctaagctcagggagaaaaaaaccagaggtgcttggggagaagaacctctgaggctgctgaactattattgagtgagcttaaaatctgcccaaaagaaatggttaatggaatatagattattttgagctgctcaaaaaggaacatgaatatgaaaagtcaggtcatctagctcaaagagaacaagggctgctttagcaagactgttataggaaaaagtgaccagctaagcctcatttcccctgagaatactgaggcgaacaaggccttaagtgacaccaggaaaatgtcaagaataaaaggtgtgattgtactaaaatcataaaacgcgtttaccattgcaaatgtgagacaacaagtcagaattggtctggtggtccccagaatatggcaggtgacacaggcctgtgatatttcatgactgttagtttttaatatgaaaaggcagaagtcagagggacacagcacctcgtatcgtgggcctagctgagcatagtccctcagcttgtctttgtccaggcgggtaggcacttcaataatgtcgtgggtctgaagctttatgatctttagaagagatgtaaacatgctttctgggatgatctgcaaaaccttcagtgaaaaggaaagcaggaaacgcaatgaacatctgttttacttttcttggctgacaaatattaggatgcctaatttgtctatatagggggatgctgaaaaatgtaaaagagctgttttaataactgctggcaggcacagggctccattcctttaaacattaattgcttacagaatataaagctaatccttctaaaaatgctgcaaaagactgtatcattcccattttacagattttaaaaagatcaaggttcaaaaatgttaagtaacatcactatagaggactggctagaatgcgacaccagtaaattttgaattcaggctggtctggctccatgctccatcagaatttattaaaacgagaatcaaaattcccatgaaaacctgaactgggctctgaccgggagatgctggatctagatcaggctcttttaccagatatggctctgtgattttgaagaaactattataatctctgtttctacatctataaaatagatgtgaataccaccaacacttaaaacacagaaataaaagttcctggcaagtaaaaacatctgtacatccacagtagcaataagggtaagtttatttttaggtgttgcaaatttctggaatcaaatttttaaaagggaaagagacacggatatacttttggggggcctaagcatactttttgtatttaaaacagcagttatctggcaagagtaaatatcaccctgatgcatttcttacttttctcacataggataccaactctccagaatagtactgtgacacgctgagcaggtcggggctatttgcctgattaatacgaagaaggggcagatcgagggcagaggcaagctggaagaaaaataaggtatatctgtttcttgtttcaaaaagagtcctagaaatctttctttccagaaaatgtaacatacaacaaaacatttgggttttacccaacagagggcattaatagtttctgacaatacagtttttgaaaaacccaagttaactgtgatggcagtggttcttaaactgtgctccctggaccagtagcttccgcatgacctgggaacttattagacatgcaaattactgggctccactccacactgacttagtcagacaccctgggggtgcggcccagcaatctgtgttacaaccagccccgcaggtgattctgatgcatgctcaagtttgagagccactgtgccacagaaaagagctactcctgtgtggaaatcaagacgttctgattgacgttctgatagaatctgattgacagattctaccgaatctgtccaatctaatatgccgtcaagtgtaagaagtgccattattttatgtgccattcagaaaaaaattaaatgctgacaactaaactatgatatgccatcaatgataaaacccatccccagttacagaaatgttaaaatatgaaaagaattgtagtagctaggcgcagtggtgcatgcctataattaaagctacttgggaggctaaggcaggaggatcgcttgagcctgggagtttgagacacagcctgggcaacacagtaaaaccccatccccctcactcccacgtcccaaaaaaaggtgcatctcagaattgatgtacatggtacatggtagctctgtcaggagacattgagtaggctgggcgtgggggctcacacctgtaatcccagcactttgggaggccaaggcaggaggaacatttgaggttaggaattcaagaccagcctggtcaacatggtgaaaccccatctctactaaaaatagtaaaaattagctgggcatggtggtgaacacctgtaatttcaactacttgggaggctgaggcaagagaatcgcttgaacccgggaggaggagctgcactccagcctgggaaacaaagcgagattccatctcaaaaaaaaaaagaagaagaagaagacactgagtagactctttgttcatttaccacgaactgaaattaccatgagagcaaggactgtgcctgttgttcaccaatattccctgttactgtagatattagtactagtttgtagcagaggctcagtaattttttgaatgaataagtaaaaggacttaattcatgcctagggaataaaggacacaaaggactcacatttttagtacacagataaaacttaaaaaaaaatctattcttcacctaaaaatagtattcctgaagacattccaacttacattaattaaaactttaaatatttctggaatctttgaaattatgctctcgtggaaaaactgctaacaatttcagtctataaaaatattgaaattatttaccttcctaaaaggataaaatcctgggctgaattaatgaatgaggtatgaatgaaggccaactctttcctagcaacagagaatctcactgttttttgcttacctttaggaaggtagctctgagtttagtaaccatggatggatttacccttatgctttcttgcatgatggatgtgaaactgtaaaaagaaaagaaacggtaagaagatgttcctagggcctttcatctacagcaaatgtcaggctgcctacattacctgtcaatcaactgccaagcgaaagaaaggtccccaacgatctgcattgtgatcagaacctcctctttaatgttaatggttctgatcatttgatgaagaaactttcgagtatcggcaagaaactgacatacttgcagattggattccaactggtggaattcttgaacctgtgttacagaaatatacttaatttaaaaatcctgaatggactctatggtgctcatttgttcttgaaaacacttcaaataaagcacactacttctgacaatttcttgataaagtttttatttcaaattataaatttcagaaacgtgagccaagctattaaaaaatgcacaagtttctaggattagaaaatgttccgctgcttattgtgtatatcacaaccatgtgttggaatttgtgtattattaagttcttttgatgcacttttaaaaacaaaacaatgattctacaatgtcttgaaattttaatgtatataactgaagatgcctgggttatatgacaaaataaataaggcaaatgataaaaagcatttgagatttacaaagttgtttacgatcatattatagactaaaaaaatccaaacaagcaaagtagaaataatacaagtgtgcaattgttctggaataagaaactttggtagaattattttactgtgttgctgtttatagcgaccatcctaaaaaccttgcagaaataagaaaaagcctgtaagaaaatattccaagtgaaaacagtattaattatatctctaaaaatatataatcataccaattggatagggttatagattatgagtaaaaatgatgttttaaataatagagttggccgggcacggtggctcatgcctgtaatcccagcactctgagagcccgaggcaggtggatcacctgaggtcaggagtttgagaccaacctggctaacatggtgaaaccccgtctctactaaaaatacaaaattagctgggcatggtggcaggcgcctgtagtcccagctacccaggaggctgaggcaggacaatcgctggaacccaggaggcggaggttgcagtgagccaagattgtgcccctgcactccagcctgggtgacagaactggattccgtctcaaaaaaaaaaaaaagagtttatgattatttttctgctgcttttagttatcattttaaatctagttaaatacacaattaaaatttaagagtggtgaggtataatttttttggtacaatcatttttgagttgaaagaaaaacaataaactatttttttcagaaaagaaaatatatcacttataagcatatgaccattatataattattttcatttttgtgtattcctttctggttttttcccccaaggcacacacttttttacaaccctaaaaatggtatacacatgcaattttgtttttgcttttacctccttatcacaatttgcccaatgtttctatattatttttataattatgtttctaagattacatgtttcctcaagttacaatatcgtaatttttgctaccattctcttcatactagttatttatttccccaaatttaggacagtatacgttacaggaaacatattaattcacatcgcttttacttctgatgaaatagtctctcagctatatttacaggaacagactgctgggtgggtcataaggtgtgattcatgatccaagaacctgcatttaaaaagcgtttccttacctcttccaaagcttgtatcagttgtacagtttttctgcccgcagcagtagaatcatcataatttaaagacaatatttgttttgagatctctctgaaccaagcttgaaggttttctagtaatacagaaataagaaaatactgaaatcctcgaattcctgtagctgtggctttgaatttaactaaataatcttttataaattcagttcttcagagctttaaccgtgggcctaacactaggaattttccaaacgacaaaaatgcctggagcatgcgacatagtagaataaactttctacataaatagcttagtctacagcacttggcagacaaatactaaaggctcaagtgcatgctataaagtgtagaggtggtggtggcagtggagaagagttggaaaggaactgaaggatgaccctagttaccagggagaattttctggagaagcgaggaaaagtaaagatcagatcatcggagagatgaagaagggaattgtatccagatgaaaggcagacacaggcagaggcttcagggcaagaatgacaagagcatatcttggagggcaaagaagagaccaatatgacagaagtgtaaggtgtgactggtgagtcacagggatgtctgaacaatgcagggggtgccatttgcacttaggaaccggcagacatttcatacagtagagaaagagaagggtgtccacatgctctgattaccctcagtgtgtcaggcaaagttctaagtatttgatcttcatagcaatacagggaggtggaaattgttagccatttcccagataaagaggctgatgctcagagagactgagaatgctatacagggtgacacggtgactaaatggcagagccaggatttacaattatctgtccaggttcaaaaactctgtgctctttacctcaccaagttgatcccctaaagttttttttttgtttgtttatcaatggggtggtcccacgttattaaaaggccttaaagacttacgatctaagttatttcaagaattggcatgacaaacactcatttttgaagatttttgtagggctgaggggcagcgatggagtagtagaaagagcatgaaatttggggtctgagatgagtgagacccaggctctccacctttgtaccttcagcaaatgattacatttttaagcctcagtttccttatatataaaataaggattaagatgtgtatcttacagggttgtaaggatgagaaaaaactgtgaaagtatgtcctaagctgtaattaaactatacagctggaaaaaaatgtaaaattgttatttcatctctgaaacaaagttggtatttgtaagggcctaaaagacactatcacagagattaatgcactaattctaggcagctaaccgggtcagattgttacacgtgattgttttgcaggtcacaatatgataaccataatattcattctagacttcaggtttcatatcacaatatggtgacctgcaaaacatgtttctagtttatatcacatcgttatacgttggctggcttttccctataggaacaataatacaatttggaaatatatttttgaccaaccactcagcatcaaagaaataaacaaaagctaaaatacagtaatcacaagctcatactgattaaaaataatagtttttaaacaagaagctacactactaagcaattctacagtataattaacttcatcagaaatagatctgatagttaaaacaaaattaagcgttaaaaaaatagtttgtcaccataaaattcagaatggttttttgggagcagttagaaatttcttatttataaaaaatttgaaatgatgccagaactttcctataaataaaatttcctagaagaagtaggatcaaaatcattaaagtaaaattttagtttgtgttttttcaaaactagtctgcagtaccctcttctgctactagatagcaggtgcattcgtgaacaagaatcaagcaaaatcagaagaattttagatatcatctatgctggtagattatgacattcttgggtgacgtattcttcttgagaagatcatgagaattatagatcctttcccccctttccccaaatcactaaactgacacattagttttgcataccatggagatggaggccaactgtgactctctaaactcttgtctatgaactggagttaccaaaacccctggtttagcataacctcacatttcaaagataagatataaaacctgaactctaaaatgaatatgaacattgcccaagagagcagagagctagacgcagccaaaactaaccttcagatctttattagcaacactaaagatggaatatcataggatacaataatgagaacataaagtctttttaacctgccagtttccaaggtttcaaataacctgtgcacacattccaaacacaccagtatttcctcttcagtaattaccatttttctccactctggttaggggtttcactcctgaaaagacatcagcaagctcagtcatccgctccgaaccctctttcttgtaatgctcccatttggtttgcttttctgaaagcatttgcttgaacatctgttgaagcaacagaaaatatttatttacttaagagaaaaatccagactaggcagcttatgaagagagcttgaggaaacccaatttaaattttaaataagaagctacactataaattaacattgaccctgatgtcatctcctcaggcactgatactttgcagaaattcagggacaaagccagaccacctccaaaacagtagttctcacaccaacaccaacagcacataagcaccaccaggaggctttaaagttttcagattctcaaggcccacccccaaagattctcgttcaggcggtcttgaatagggccagaaatccgcatttttaatgtgagattaaatttgtgaccactgctctatggttccttctaggcaacaatgtctgcaattctaacgtaaacagtcagggacagtttgtgtattaccttctccaatgactggggaatgaactagattacctgcaaaagttctttgttttattatacaagtttaattgtttatttttatttatttatttattattatacaagtaattgtgtttattgttatttatttatttagtttttgagagacagggtctcactctgttgcccaggctagagtgcagtggggtgatcatggctcactacaaccttgaactcctgggttcaagtgatcctcctgcctcagcctctcaagtagctagggctatgggcatgcgccactacacctggttaattttcttatttatttattttttttttttttgcagagatgggggccttgctatgttgcccaggctggtgtctcaaactcttggtgtcaagtgatcctccctccttggtctcccacactgttgggattataggcatgagccactgtaccgccttaattctgtttattaattcactccttcataacatttaaattctacaaagtcttgggcagagaagaaacgggtgtaactcagggttgggttttttttttttctgaaacaaacttaaaaaacatacttatttctcactaaaggacacgccatctcagacaagggtagatggtcttttacaccgggctcttaggaggtaaacaggcatgaactctgatttctcgcttaagaaattcctcacttgccagcatcataataaatcttgaaaagctgagcaatgggatagggagactccatctgcaggtggagaatcagggctctgtggaattttgcggggcctgtagaggaagaatcttagtgatctggcagaatgactaaccaataaaatgatgacggagaggatgaggaataatgaaattatttatagagtctaccctaactttctgagtccctcggatcaatcaatgccatttgataatggcaaagcaacaacataagagcaccctgaagccttcgtaagagactacatggcgtcaagcccttcaaacactcattcacatgaactcacaggtttcacatctcacaggatggaatttgggataggggatggtccctgaattaggaaatgtgctgtcatataaagattagaaaaaacacaggtccaattactgtgtctataggatagtcagaaagtgactctatgaactgtgcaggatgggaagtaggacagaggaagcacaggttaaagaacccagctgaaatgtcagaaattcaaatgtatcatttctttgagcaatttgtattgggtattttttttttctttttaccagagctttcctgaagacctctaatgaggtggtactcctttatgctgtcttgtttcctgtctacctggatagacagaaggaagctgtccattctgtttcaatagattccagagaacagacttatcattagaaatacaggcttggtcagtcagatagcctaggtctgtcctgatttccactcaacaatgctgaactacatattatctatagaactcttgggtccctggggctctagttcataattctaactggtctgagggcatttctttcattcctttttttttttttttttaggcagagtcttgctctgttgcccaggctggagtgcagtggcatgatctcggctcattgcaacctctgcctgtgttttcaagtgattctcctgcctcagcctcctgaagagcttggaatacaggcacgcgccactgcacccagctaatttttgtatttttagtacagatggggttttgctatgttggccagactggtctcgaactcctgacctcaggtgatccacccgccttagcctcccaaagtgctgggattacaggtgtgagccactgcactcgactgggcatttcttccttgcgggcattttttcatttgcctttgaaaggccacttttgctttgacctggttcctgttcttggatctttcctgttttctcatcttggcttaatctgtctttcttccctcactatactgacagggcagctcctagacggtagggacacattttgttcatatttaaatttccagcacctggcaaagaacagagtaggtattcaataactatttgctattcagagggaaaccattaaaattattaatagatcaaaaaggagcagcatttatctgatttgataaaattatgcccagacaaatcactgaaaacactaagcacaggcattatcattatgttagcagtcagtatctattttttctgagctacttagtaggggaatatagtatcctcagaaacctagaagataaagaaacatctaatatactagtaaccatactgaagcaagatgaggatctgttccgaatgggtataaatgtctgggctagttcctgggcccacctgatccaagcccccagggatactggttataaaacctgagcattcccaggtacccatcatttttattatgcccatacaggcttcttcagaggtaagactaacctcagcatttccttcagtgaactcagatgcctgaagtcctcaagatgaccttgtacaaatgcaaatcacccaccccagttaataccctttccagtggttctcatggctcttaggataaagaccaaagtcctgcaaggcctagtatgggctgactcctgcctacctttcagcctcatttcacactacctttctctcactctctctcctccagccaactggtctttcaggtctttgaattgtttatgttcctcctcaccaaagacgacttgatattcttcctgtccctggaatgttctccatcacgctccctacctttgtctacctaacactaacagatcccttccccaggccccttcagaagctcttgcgtctcttctcatggaagtctaccaggatgcaacaggatactttattctaggtacctggagaactacattcctttccttcagagcaaatatctgagttcatatttacatttttattagtgtgattctgtttttttgagacagggtgtcactctgttgcctaggctggagtgcagtggtgcgatcttggcccactgcaacctccgcctcccaggttcaagtgattctcatgcctcagcctccccagttgctgagactacagccgtgtgccaccatgcccagctaatttttgtatttttagtagagatgaggtttcaccagcctgctggccaggctgatctcgaactcctgacctcaggtgatctgcccacgtgggccttccaaggtgctgggattacaggcatgagccactgcacttggcctagtgtgattctttgattaatgtctatattccccattaggctataacctctaccatcttgagtacctttccccatcactgtatccccagtgaaaggaggcactacaggcttgttaaatgtttattcctgtcctttaactataagaactatctcaacagctcaaatctgtaccttgaatcagagacagagcaagcaatcctagtcttttttttaaaaaatatttttaagcataaaaaagctaagactgtggtgatattcattcaaatatttttacctctttgagtataaactcaaattgtgcagtatctaacagcagctggaagaggatcctgggattgtaccgagagtctgttagaatctggtccttgatttgacgaaggcgtttgttgtttgggtcacaggctagaaacaggaaaagtgttacctgcttactaaatgtgtagaaaatatctatgaaataagataaattattaaatattttccttcattttaaccatttaaaaagtaataagcaaaatgtatatcaataaaagatggtgaaatatagtacatctatgccatggagtacaattaaactgttaaatgacagttgaatctgacatggagtgccatccttgaaagattgttgaatgacaaaaagcaagctgcagaacagtgtttccaaattttgtgagcattctgcggtttgtttatagcaactgtctaaaacgaatgggcagagcctccttgtactacttcatagctgggtggcttcctcacgtcctgtctgttcggagttgcttttgctttagacattgatccctgccattcagtaacggactgctatccctagagaggcctgtttgcaaggttggctcttggctggcatctgggaacttgaatttcacgaagagctgccatcattttgagaactcacaagatcagctcactaagccttaaatgattgtacaaacaacgttttccttctggaagtctggaattttggtacatgctgggcagaggctacctatgtaagcagcccccaatagaaaccgaaggaagctgagtctaatgagccttcctggttgacaacacttcatatgcattgtcatgactcactgctgggggaattaagtgtgccctgtgggactccactgggagaggatgctcggaagcttgtgcctcattcctccaaattcactccgtgtgcccttttcctttgcagattttgctttctatccttccgctataataaatcatagctgtgagtactactagatgctgagtcctctgtgtccctgtagtgaatcactgaagccagagtggtcgtggggaatgcccgacacaacaaggaagggttcctcacacaaagatgagggacccccaaacaagaagcagcagacctctggccatcctgcttcttgtagaggccagagggcatggcaggcagtcagagttttctgaactatccactacccaggcactaggccaaggtcacaaaattaggcagtgattgacccaaggtaaaaatactggatgtcctaattcttagatgatcctatctgccaagctaaaccatttcaaatgaaataaacgccaagttaaaagaatagaataaaaaatattgatatttgcttagattggtttataaggccaattacttatctaagaaagagtaagtagaataaggcaaaatacttacaaggcaaagctactgctgcggtttcaatgcgtcttccaaaagttcacatgttagacacttggttgccattgtgtcagcgttaagaggtagagcccttggcaggcaattgtgttatgaggggtccaccctcatgaatggattaatgccattatcttgggagtgggttagttattccaacagtggctttgctataaaagtgagctctctcttgcacccactatcttgcccttctgcctatctggcatatattgacccttgctagatgctggcaccatgctcttggacttcccagcctccagaaccatgagccaaataaacttctttatacatttcctactctgtggtattctgttatagcagcagaaaatgaactaagacaaataaagtcaaaataaaaactctaagacttaaacagactttgtcaaaaagttcacagctgataggtataaggtatatggtagttacactagtattacatgtgccccctcctgccttcctagtcctgcccccatcaatatctcaggatgtctggcaggtacagaacaacaatgttgtatagatatatgtatatgtcatgggtggttttgttgctttagttatgatgaagcctgtggaaggtcatcttatatgctgatttctaagttactccatcaggaggagactcgtgacaacctggaaaagaggctcagttttcatgggaaactgcaaagttctgatttttcatgaatttgccagaactatgtgggaagaaatatattggaactggtgacactgattacacaaagtgaaaattttcagctccatatttacctaactaaacaaaaatcaaacaaactcagaaggagctccagttgtctttatactaattttaattaaactagaaatctcctgattttaatctgctttcatgtttgcatagggaatgtttaagtacccagttgttggacaaacactctgtattcctcaatgtgctttaacatttagcttcttggtataaaccaggtttgcttctggggttcccagggcctgaccatctctctcagatctgacccttaaggattcatacccagagaactgcagagccatcagaactttggggtcaaacttcagtagccagccagcctttctcatcccttatttcctcagagaatatttctttacaaggttctgtacaagcatcctaagactgggaaatgcctccagcaactcaacaggaggcaatgagactaggcctgcttttctgaacaccatgactgaaattccacaaaagttaactaagcagttgcttttcccatgtgtgactcacaatcagataggtcaatcatttgtttctgataaattacgaccctgtgcaatcaggtcagacaattgccaggcacaaacgcaaaagacaaatgtggctgaagataaaaccacagacctctggcaagccaaggttgtccctggcatgggtgcgaattcaggagactgccggctttccgaacatagacagggccgtcaggcagagtcacacagaagatgaagatgaggctgagtcactagaaaaccccagttggttttatgacaggataaagtgagggcttgagttgtttatacgcttgtgaatgcaagacttttggtaaagaagattaaaagctgagtcaatgtagtaaaatcctcaaattagaactggagtttatgtaaaaaataaactcaactaattaaaaacagattcagggattaaaaacttcagccatcgtgttcatactgtgggtaaattgtaaatggatataggccaacaaacaagatgatgaaacaaactggaaagcagctctcaggataaaggtttaagaagctggagagaaggctgaggggaaactccacacattttcaaagatacgaaggatgaggaagtccaactgctgttttcactgtggaccacccataggaagtggaagcagacggtagctagaaggactgtgaagtcatcttggctggaagagctgtgagacaggggctaccatgttacaaaggaaggctacagagaagtcttgtgtgcacagttttttaaagagacacagtcttatctggaagaacaaagaagtgctgcacacagtgcctgtctcagagttggtcctcaaggaaagtttgttgagtgaaaaacaaaaagcagagggcttcacaggcctgctgaatgacacacctcttaggggtaggggtatacagtcctggatgagggaatgcattggttaattagtgttgatccagcatttacgaagaataagaaactgtgccagccctgaacaagctcagagatgttaattcaacttacttatttttctaccattaaaccagaggttgaagcatttctcacaatctgaacttgatggtcaaactgtgtgaacagaaggtctcggaggagaccatgactcataaaaagctaagatccaatctaccttaaataagcactctggtccagccaggtcatcaactcagtgggcccatatgtttttctgtactttcaaaatcgtatcacttattccatcatttctgtagtctagaatttcttctgctttttgcttcaaaacctcatcacacgcctggttggctcctgattcctgtatggggtttcctgacctcctctgctcccctatcccaagcaatgtttccctctctactctgaactcaaatcacaccaactgtctgtttgacacacctggtgtctgtttactgccttggaccttgaattagtttcccgctgctgctttaacaattaccacaaactcagtggcttaaaacaacacaaatttattctctcaccatcccagaagtgacaaatctgagatggggctcactgggctaaaatcaaggtgatggctgcgctgggctccttctggacattctaggggaaaagtctgttttcttgttttcagcagctaaaggctgcctgtattccttggcttgtggccccctccatctttaaagccagcaatggccagtcaggtttttgtcacaatgctatctctctggttctgacacttctacctccctcttcctgatttaaggacccctatatttacaggctgggcatggtggctcagacctataatcctagcactttgggaggccgaggtgggcagactgcttgggctcaggagtttgagaccaccctggccaacacagtgaaacactgtctctacaaaaaaatacaaaaaacttagccaggcatgatggcacacacctgtagtcccagctgcttgcggggattgcggaagttgtatcgcttgagcccaggaggtctgagtgagctgagattgtgccactgcactcaaacctggggaacttgagatcctgtcttaaaaaaaaaaaaaaagtggggggggggggcgggctcttattttattattcttttttgagacgtggtcttgctctgtcacttaggctgcagtgcagtagcatgatcttggctcactgcagctgcaacctcccaggctcaagtgatcttcccacctcagcctccccagtagctgggactacaggtgtgtgccaccatgcccagctaatttttttactttttgtagagatgggatctcactgtgttacccaggctggttctgaactcctgggctcaagctctcctcctgccttggcctcccaaagtgatgggattacaagtatgagccaccacacacagcaaggacccttatgattacactgagtccactgggataatccagaaacatctccttaaaggtcagctaataggcaacctcaatccccctttttcatgtaatatatctaccggttcagggactagggcatgaacatctctgggtgtgggctggaaggcactattctgcctaccacagatctgcagttctattttttcatatgtctacatttgatctccccattctgatcagtgacaagctccttgaacatgagagataaacatcctcttattccctagcacctaacagtacctgacaggggagagcttttcaggtatgctagtggcctatccaagttgacaaaaaatgactaactttaaaaagcaacttgattctcatccaaggcctctctccctgctaaaccactctgcatcgtgaagtaggtcctgattctgagagtctttatgtggagtaatataaacggccaccccttttgtgcattacctgagtctgctgtatgaagcatcagccatcggatggcaacattgcagtctctcaggcagttcagaagctttgggatattgtccagaaccatctcctcccttaaataaccttcttttagaaattgctgcacttgagcatgcactctttcactgacagtagcatatctgcttgccttgacaaataagaaacttgaattacatttaaaaagtcatttatcttgaaaataaatcacattcaaatgaattcactgacaaatagtaacatttctatataggatgaatgacatatggattacagttatagggctcgaagataacatttctataagatgaatgacatatggactacagttatagggctcaaactttaacatttttatataatttctgtacaagatgaatgacatatggactacagttatagggctcaaacattaacatttttatgtaatttctatataagatgaatgacatatggactatagttctagggctcaaagataacatttctatataagatgaataacatatggactatacttattgggctcaaagacaactggcttattgaacatatttgaaaaaagcactggacttagaattctgagactacatcctagttctggctgtgattaaactttggtgtgacttggggcttaacccctgtgtattggtttcttcaaatttcaaacggagacttggaccaggtggttcctcagaactcttctattattaacttagatgaaaaagaaaataaagacagaagttcaattgcttgttcttgctaatactgttgacaaagaaggcagaacagagcagaaacacttaaaatataagacttcttctacaggcttatgaaagcttagcaaaaaatacaccttagtatatcaaaaatgaatttccaaaccagctttttggaaaatttggtcattctgctttacttaaaggaagtcaaatgttaaacatcattaacctcatcaagttagttgaaatctgtggtatcaagaaacctcttaaaaatgtcacaaatgagaaaatgcaattttagaaagggattttagcaatgaaaaattaatgatctgatgttgctaagtataaaagtgccactttctctaatatatttctaggagatgtgccaacattgaaattattttgtgcattatttatggaattcaatttacttgaataaaacatgatgaagttttttgagtcaatattgttttatccacacaggaaactcagtaactgagccaggatgaggaacataaccatttagaaatatcaagtatgctccccaagattttatctttattcctctacttacttggatgttcccttctgccttgtgtaagaacaaaagagatagaatataaccgtttaacctttaagatgaatgtcttgagtcttgttgcttatttagcacaacacaaatgataaatttaaattacagtgacaggacatattatccatattcagttatcatcttcatcattcatcctacttataaaaacatattaattccagctattggtacaaccaactctggccatgagaatatagtctttaagcaaaagtaaactaagtcatttggggcatatgccatgcttctttgtcttagggtactgactcttccttgggatcctaatcttcaatttacatatactatataacaaaacctacaattacctatcttattctaacctataaaattcaccttttattaatcattgcattaaattatctaagtgattatcttccaaattccttgggaaatctacttagcttatttgctacttcataaactaggcctgcagttatcagagaatgtccccagattagaacctacctgttctctgacatttgaaaggtccagggtattatttaaagcagtttttgcagctttgtaaggttcccaagcatctactagattaactgtgatccccatgtaaatactaattacctgaaagaggagacattcagaatttgttaaattcctactcacttcaaggcaaagggttgaatactaaagttatagaaggcaatacccactccatgtttaaattccattccaatgaaaaaccaagattttccaaatatataggtaagtgttcctgattgttaagtaagtgttcctgattgttaattcacgttaataggtataaagatctctttacacctattaacgttgctttttgaaattctctattgtgtaatattaatgttttctcaccagttgttttattggttggcaattgcctgggatatctttttttaaaatcccttcattttcactgtgctagggtattttttcaggtgtgtatcttacaggtttcatgtaattggattttggtctttcttaataataaatatgtctttaattatagtatcatggtcaaaacttctttattaaacttaggaacctgaagccacactatcagtgttttcctcttggctgctcaactctgagctcactaatatgattcacagttggccaggaaccaccacttcctaatgtaggctgttctcatactaccaataaattgaaggcccctcataacgatagtttatgtgattcaacagccgatatagaagcagaacaaaatctgctacatgcgaatataatccaactccctgcattttgttaaagcctctttgttttcatatatttcatttcatatatattatgaagcaagctttattcctataagaatatttttaaatgaaacaatgcttacaaaggtacaagcatatccttgcaataatataaactttagtaaccccattacagttagcttataggtaaaactttattattaaagtgaaattcctattcacaaagtgacaaattagatgaatttggctatcttagattcagaaaatggaaaagaataaataaattcttacacaacttagttgtaatctcagtagctaaagcaagagacattttaataaatgatttaatcttgagagtatccattttagaaaaagactagtgggttcttcaggaagttttactgactcatttattccttcatgttataattataaaattctcaatacagttagagcaagtttacctaagtgatgttatgtcccattatttacaacattacaacctgtgggttaaaggccaaaagaatgggaagttagttctctaacacatttactgtagaggaaaaaaattagcaatacttgcccaattatctggaaagtatttatccactatctctctcatttttgcttgatgggtgtgaaggatggaaggctcaaagtagagaatcacgtacagcatggcagcttggtttgccagggctgtgctgcgatgctccggcaaaggatacgctgagacctgcaatgtcaagacgacaccccgagaaagctgttggcaacatttgcacgtagacatgctcaaattaaactctctggttgtaagacacatcagtttttccaaagcccatcacctttcaggatcctggacactggaagcccttctcagactgtaccattgcttgccaaggtcttccttcttattcctaacaccataatattctcttcttccagcccttgaccgctgcaattctaagtcttttcttaaaaaaaaaaaaaaaaagtcccattcctgtgtctcccaccacttctccatttttgtatctttcctgttggagacaacccttagaactgacaggctccactcactgttgctattttctcactttctgtttattattcaactcactgaaattcgacctccatcatcatcccagtggaattccctacggtcgctcatgacctcacaaccatccaattcaacggcttctttttaagactctcacttaaattctctgaggaatgaaatctctccttctctggtttcctagataccactctctcttctcaatctcctttgctgagtcctcatcttctgccttttaaatgttggtgttccccaggggttcatcccctcacgtactagaaatctttggatgcacaaagcacatatcaccttgagctaccacaagcaaaaaggagagaaattgttataagggcagacatagccatgtcacatgaaacctgcaggcaggtatgtggccaggccacaggaagcggctggggctgggaaccggaatgccttcgctctttctccccttgatgtgttggcccaccttttctctccctccaggctactcgccatatacatggcagaatgaggctgcccacaaactcccaattttgcatgttgtggataaactccaatccagaaactgtttctcaggcccaattccaaattacctggagacagaatctgttccatcacccatgaccagggatgggggaggtgcaggacagagagtggggtggacacacagcacaatcacagcttaacccttgtgctaataaagatcatggggcaaggaggaaatggaagcacattgccttcagaaggacgtggaatgagaggcaatcaggaatgagatgctctgaattgacacagaccaaattcaagttatggttctgctacttagtaacaggaatttaaggaaattatttaagctctccaagtcttattcttctcaacagcaacatgggggataatgccatctactttacagggctattgtgaggaacagagaaaatggtatgggaacaaaacctcctttgtggctggtttggactgaattctcaatgaatggcaacaattattatggagacctggcatctgtgggtagcttctgattttgaattgtcttaaaacaacaacaacaacaccaccaacaaaaaccctcttatttatacttaacatattcacacaaaaaactaacaagctacctaaagaactgcacagatcaggttcattctgtgataaatgatatccacagttatcacaggcctctttactccctaattataatttttacaaatatttaaatatataacatctaaaattatgttttcttcagaagaatgaagtcaaatggtaattttatttggcgttttttaaaaggaagtgactactacacatactggcaaggggagtggggcgattttcaaatgctgcatgatcttcacagccttgctcaggctgcctcctttcctggcactcctcttaccttccttttgtcacctgttgtgaccttgctgccactgctgcatgctccagtggcaccctgtgcttaccctaagataacacccatcttgctttactataatcctgtcatctgcctttcctaagctacaagctcagtaggggcagggacatggcctgtcttcttcggtgatgggtccccagcattgcgcatgtgaatgggcacgtatcacatactcaacaaccatttcttgaatgaatgactaaaagaatgcatcttcttcccaatagctcaaattccatcttctccctgaaatatatgattctggcaaaattaataaccctctttcctttatcatcctggggtgtagctcaaaaggttttaaaaggttctacctgcttttactcttttgggaaagaaggaaggaaaggagtaattaaagagggaagtgaaatcagtctgttaaactgtcttaataggtcttaatagatttaattcccacctggttgtaaatatcatcagatctcagtcgaccaatgaccatactgatgaaggattcgttgataggcactctctggaaatagctctcgggatagttggatggtcttttggcacctggttggctagaataacctgtacttcgaagcagcttacaaatatcgtccatatttgaatcagcagaagatcgagcagcactgagtcatattcacaatgggaaacaaagacccaaaacacacatattagaaactgaaaagtccaataaagtagaattccattctactttgactcaatatagtttcagatatgatcacaggtccatctatatcctcaatatatcctcaagattcaaaattatgtgtatatatatgtgtgtgtgtgtgtatatatatatatatatatatatacatttttttttgagatggagtctcgctatgtatgtatatataaccttttttttttttttttttttttttgagatggtgtcttgctctgtcacccaggctggagtgcagtggcgtgatctcagctcactgcaacctctgcctccaggttcaagcaattctcctgcctcagcctcctgagtaactgggactacaggcatttgccaccgtgcctggctaatttttgtattttagtagagatggggtttcaccatgctggcccaggctggtcttaaatgtctgacctcaactgatccacccaccttgtcctcccaaagtgctgggattacaggtgtgagccactgtgcccggcctcaaaattatatttttgaaagcctgtttagaagatgggtattcatactatgtaaaggtccataatcccttttccaaaatccttaggagtggatttgtttcggaatatagcatttttcaaatagtaagagtcatatggcatatagatcatacacaatacaacactccagcagggtctgaattggcatctcatgatcaacataagtgaataattctggaggaaaatttataaatatttacaaaagtgagataagtgaagactatatatagcctcacacctattccaggcaagttttgactccaaatgatttcagcttacatcaggttttgctgccaaatgaattactatgtatatgtacatgtgtgttgtgtgtatactcgtgtatatatattttttcagagctctttggatttgaaaattgtgggtaaagaatgtgaacctgacattttacaaattaaaaaataatttaaaaatattatgtcaatttaaagtaaaatatatctaacttttttcttggcaagctgttccttctacagagatctaataaacaggtctgtgatttttccgggtggaatagtaagctctgaaagaaatgaactagattcaaagaatcttagacttggatatgacctgctatttgctgtaaggatctcttttgccacgactgtgacttggaagtgttcagtgtcacttcaataataaatgctcacattctaatgaattagctgttgtaccaaaggggacaaagccatattttcaaaactgggcttcataagccaatatttttttcttcttctttacactgtgtatagtttttgtttttccaggtactctcagaaatataggaaaggccattcaaatctcatttttaaaaacatggatgttaaaacagcttggtcaaactgacatgaatgaacactgctagaacactcccttcagctgaaaggaaaaggctagttgaggagcctaagactaatttgctgctgaggacacagtagtacctggtattgccgaaaagtataatgtccccaaagaacccccttctccttgtctactttgtcctaatttttaagtttgaaaatgttaattctactctttacatctttagctcaagctcctgactcctccttcttgacagtttcttctctgaatcttgactatctccgacattgacctggtattccatttttagctcattcaaccaattgaaaatctgtgcgttagacactaaaattaaaaagttggttaaggtggctcctgttttcaagaccttacttcctgaagaatcacagttctgtatagataaacacaacaaatgatttgtggatatgtgctgttgcttgatttgtttttgtttctatgtaaacatgggagagaattcactttcaacctgactctgaatgacaacttttcaaagtcatcaaactgaaatgacaacagaaagcacacttatttccttatatctgccaaggagtaatatttgaaaacttaaacaacaaaagcaaaaataatcttcattagatttctaagattctttgaaatttagcctcaaggtaaagaaagttcacaattcagactcctttttaaaattggagttatcattagggacagcataatccatacttctaataatctataatatatagaatacttgatatgtaatacatagattatataatttataatcattatgaaatatgtaattgttatatacctacaatatgctcacaagacataagaatcttactttttttttttttttttttgagacatagtctcgctctgtcacccaggatggagtgtagtggcatgatcttcgctcactgcaaccttcgcctcccgagttcaggcgattctcctgcctcagcctcctgagtacctggaattacaggcgcccaccaccgtgcctggctaatttttgtagttttagtagagacagggtttcaccatgttggccaggctggtatcaaactcctgacctcagatgatctgcctgccttggcctcccaaaagtgttgggattacaggcgttagccactgtgcccggctgaatcgtatactttcttatctattcttggattactgctgttcacagtataaggaatatggggacatacactgcattttaccgacagcagcgtttcggaagtgtagtcctagcccaggaatacctgtatcggtagtaagaaaccagcatcctctctctgacttctccttcaatcttttggtcaatgaccagtagcataactccatataagtacagtgcttcacactaagaagagaagaggacaaaagccaaaatcactagattatacattcttagggagtaaagtcggtaatcatgaaaaatattgctttgctcacacttcttcaaaaagttttagatttcaaggaaaaggtaggtttcctccaaggagctcttaccttcttgccgaatgggccttgaaaagtttatgtaaaacagattttaattcatagtgataatttttcagttgacctattttggctatgttgcttgggacaccaaaatagcaacccaatattgtgtatacctcttcatcataaaatcattcacttattcaatcagcatttcttaaatggttagtatgtactaggtatcaggacagatggctgggatgcaaaaagtaaagaagacagaattcttacaccgaggaggctcataacttccacataacttttaactgttttaaattctgttcaaagtctatgttctaaactcagatatggacctgccagttagaagataattaaaagctcatttcgcttctctttaaagaatggtatttcgtatatatttgtgacttaaaagaaaaaaaagtgatactatgtttgatattcttgaatttcattttaaataatcattattacttactagaagttgttttccatcttcattgagaagcacagtttctaaggtttgctgaatataaaccccttcattgagatcatctagatatctagaaataaaaccacagtgcaagttattaatttataatagaaactttaacatctttaaagaaggaaagatttttaaaagataaggcaggatgccaggcattctggccttccactagttcatggtccttcatgctcttaagaatacagtcttataaactgatttagggccacagtttgatatttatcgctgttccaagtaaaagaaatattccctagtcctgatttgtgaattacaagtatctaggagtaaaggcagaagaacatggaatatctagtctaaaagttaatgagtaatgaattcttaagaagtgtattaagagacagaaagttaatgataaagataagttctttttcccacttttcacatataatacactaggatatgataataaataacaggattggaaactatatgacttagttaaactaagtttattacaacacctcataagagcaggacattatagtaaaacttcaaaattcttaagatgaccagtgccacaggtaggaaaagacaactatatacagtataaactaaattaggaaattttgtagtaactcagagagatttacacgttgctatgtgtccttttccctctccactatttactaccagaataagctattcctaaatagatcaatacctgtttaagtctacaatatatttatgtacactttgaaatgctaaataaaatctggtcacaatttctatgttgttttcacgaaattcttcatctaaatcctgtagctctggcttagcatccagtttgctttcccataattctggaccctgagaaaaaaaaacacatgtgaaatgtcaataaaagcatacttgttggtgacaatttctaaatagtcttttaaaaatttgttcttatgttattagacatcccaaacttaaagcagagcaacagaaagtagtgaagataatagaagcctagatataaaatccctttgagagaaatgaatttgaattggacccaagattagcatgcttttaagtatggggcccttcaatgtgaaatatcaaagttatcttttaaaaatacaattatattgtgttagggctttgacataatactttcaacttattttcaagttagtagctaatattaagtttagtcgaaaagctcttctctttagctttttccataattccttaaccttacagagtttcatggttcccagagaaaacacgcttttgtagaaaagacaacaataaaaatgctatagaggaagattaccttaaaatagctgaaatcaaatatgatatctccatatttctgttgatcagctctgtcttttaacctgaacacagcaggaataaactcagagagtctcaaaagttcagcaatgatggcattaccacaggaaacaatccttaggattgcttggccacagaggttgttctcggctagaaagtccaacattgtgaggcggaccgactactctgtgcctggacactggggatgattaactggcctcagagctggtgtctgtatattattagatgaaaccaggtgtgcagagagattggctcctccattaaagaacctgtatccccaaaaaaagtgtgaaaatctcaatttgtttaaggaagcacatgtgtacacataagaaacacatttttctcccaaactcactaaaaaaattttaagaaataatgagttcctttataggggaaagggtgtttatctgtcactcttcatattttccatgtggagggactttgctagattaacactcttggcctcttcttcaacatgttagtcacttctcttgagaaaaagatatgatacagctcatctctgtgctagggagaaggaaccactgggcatgtgtggttccaatgtaccctgattatacaagctatctcctactatttgatatattagcaaataatttcaaacgctataaagagagctcagagacaaatccctgtacatcattttgaggcatttgtccaattatttcccagaaatggaactgcaagcttaaggtaagaacatgtccaagattccttttaaaattacagatgctaggttctgcaaaattctgtgaagatgatttataaatactaaatcaaactggtccaaaagtctcataaaattcagcacttaggtatctagcactgttagcagaatccattacttgcttctcttgtattccaatgcactctctgaggatggttagatcacttagcatactgaatattatcgttgcttacagctcattctgaaagttcttgaaggcaaggattgatctttacccaaccactccttgctgaatacctctttgccaggctggatatgaagatgtttaaacatctcaccttctagtccagtggttctcaagcctggctgcttaagggaatcacctagcatcttagagtttctggtaagtaggttagaggtagtcctaagcatctctgtttttaagaatctccccggatgattctgatgtgaagccaggatcattaaaagagtagagaatgactggtcttatagaaaactgcagcaggcaaacaggaaattaacaatatttatctttgtgccctttgtgctgaactcattccttggcactgacaagtataaggagtgcataaataatactagggttacaagaggtgatgtctgtcctctctagctgcctgctatactgctggagatgagccctgaagaaaaaaaatcagagagatgaagtgcttcagtgtgtctttacaataaagaaataagaagtgtaacatacatttaattgtcagtatggagcatttattaggtgttctgttgggaaaggtattcttatactgggtgatctttagtaaagtgacatctaggaattcggggctagagaaagaaacctagcatctaaaaagaatgacctattttagtatgtaacacttaaaaacttttccatggtaaatgacttagaagatggatttgaaatccaaagggcagacacagggttgatttctaaaacatgcaaagggatctcacaagctgtcaaagagagaacagagagagaagcggaggcagaagccaagtaacaaggaaaagggaaaaaaagatgtcactaggaatgaaaaccaaccaaccaacaaaacatacatgtgatgttttcctgtacacataagtctttgagcatgtcactacccaggttgtgccttctaagcatcttctgtaacacagagactctcgataaaactgcttcctgacccatccctttccttcccactagcttcctcctacagccagtgcagatagcaggggtgagcagatggtagaaggcgaagggcaactggagaaggaagcgagaaagacttacacaaatgaaataactcctcggacttgatgaggtttcagaaagttcttgaagtaggtaatttgtctcattacgctactccttcttacattcccctctgcccacagacttgagtaccccttcttgttcaggcctgtgtgccttcccctgcaacaatcatttttcttagttctaggggcttggaaagcaatctgattataataatgtggtaactggttgccaaagatggctcccaacaattccttgccatgaagtcagcccatacagcaccttaagtgaagggctgaaccttattttccctctcaatgagtctggattgcattttattagtttgctgggctgccgtaacaaagcaccacagagagggtgacttaaacaaccacatttattttgtcacaattctggaggcgagaacttcaagatcaaggtgttggtaggactgttttcttctcaggcttctctcactggcttgtagccagctattttcctcctgtgtcttcgcatggccaccccattgctcatttctttgtatagagatgggagtctcactatgtagcccaggggagtctcaaactcctgggctcaagcaatcctcccatctcagcctcccaaagtgctgagattacaggcatgagctaccaagcctggccctcctttgtaaatttctgtgtccaaatttcctcttcatacaaagataccagtcatattggattagggcctatcctagtggcttcattttaacttaaccaccgccttaaaaatcctgtctccaaatatagtcacattctgagctactgagtgttaggaattcaacatataaattttggggggacccaactcagctcataacagcttgtgccttccttccttcaacccaaagaatactgtagaattaactctctaccaattccaggcctaagccttgagaaggcctggcagtatctccttttgctctctttgggtgtccgaagctgccatgtaagatgtctgggtatcttgctagagagatcacaggagttacaaagaggaaagaccatgctgagagggaaaagtcctgacacagaagagaatgaagaaagccagcagacagcagaaactgaagtgccgacgtgtgacttgggttgacctggtccactcagcccccagctctttaagtcttcctagctgaagtgctagacatataagggatgaggctattcggcttctgcagccagcaaagccctctgtgccttttcccaattcctaatgcacaggatcatgataaatttttaacatattgtattgttttgggcaaataagtcttggggtagtttgccatagtgctgagattcagttttgaggactaacagtacaagttgtcaatttaaacagcatgctgatgctgttattgtgatatttcattttctataatgctgtgcaatatagtcattgcttttgtataataatgtccatgtagctatttctgtattgtactactgcattttcctccaatccccatcttttcagttctctgcttccgctgattattgcaatttccttacaggaattgtgccatttgtcttatctttggaaaaagagagctatgtcctaaaaaccactagaagtcggtgagggaacaacaagtaggtgagggaacaatctttagaaatgtttttaggcctggcaacggtggctcacacctgtaatcctagtactttagaaggccaaggtaggaggaatgcttgagctcaagagttcaagaccagtctgggcaacaatagcgagaccttgtctctactaaaaatcaaaagaatatcagtcaggtatggtggtgcgagcctgtagtcccagtgacaagggaggctgaggtgggaggattgcttgagccctggaggttgaggctgcagtgagccatgatcgtgccactgcactcttgcctgggtgacaatgagaccctctctcaaaaaaaaaaaaaaaaaaaaattttctcacatgtcaagtataggagattcttgctattaagaatagttcatatctgaaaaatgctagagtgattacaaaatacagaaaaatgtttcataaaaaggagaagaaaaagttttgattacaaatgtatcttgaaatttgtgaaaatgagctttatatattaggctgtgataagtgccgtgaagaaaaaacataataaaggatggggcatatgctagtttccatagagcacctcgggcagaagtcagaaggaaatgagagagcaagcagtatggatatctgggtatggtcagcagctttctaaagtggtccctaatgatctctgcctcctggtattcatgttctatgtaggttccttcccttgagtataagctgacttactgactccctcctaaagaggagaatagggccaggtgtggtgactcactcctgtaattccagcactttgagaggctgaggcacatggatcacctgaggttaggagagccgggatcaccccggctctactaaaaatacaaaaattagccaggcatggtggcaaaaacctgtaatcccagctactcgggaggctgaggcaggagaattgcttaaacccaggaggcggaggttgcagtgaaccgagattgcaccactgcactccagcctgggtgacagagtgagacttcatctcaaaaaaaaaaaagggggagggggggaaggaaataggatagaaacaaaagatacagtgcacttctgagattagatttcgaaaagactaacttctggcttgggcaccctctgtagcttgctagtccaggggaagcaacatatcatggtgtgagagagccctggggagaagcccatatgacaaggaactgaggcttgccaaaaaccacctgagtgaacttgaaagtagatcccttataatcccagtccagccttcagataagaccatagctccttgttcccagcctgactgcaatgttctaaaagccccagagccaaaggcagccagctatgccctaccctccggaccatagatgctataaagcttattgtcttaagccactgggttctggcatagtttattatgcagcaatagataatgatcctaataatggcatcccaagcagaggttacaagtaagtgcaaaggccccagggcaggaatgtgctagatggctagcaaggtggctaaagtggctggagcagagtcagctaggggcggaaacagaagaagtagactggattggatctgagagccaagaagccactacagctgtctagaactcccatgaaggtaccctgtaatacacattaaggcatacattattaacaagttcttttagtttcctctgtgatacttgcttgttaaaccacactgatctctaacaggctgaatttcagataatttcatttcattttctgcatggatatggtctggcttgggaaagcagagagggaaaggggaaataatggacagtgggcaaaacagtcacatactaaagccctctgaagaccaccaaactaacccagaaggtctaagtaggatgaaactttacaccaggagtgtccaatcttttggcttccctgggcaatattggaagaagaattgtcttgagccacacataaaatacactaacaccaaaaatagctgatgaccttaaaaaaaatcgcaaaaaaatctcataatgttttaagcaagtttacaaatttgtattggggcacattcaaagccattctgggccgcatgtggcctgcaggcctcaggctacacaagcttgctctagactcatgaagaggaggacaagctatgattaacaggtccaatggctacccgatttgggataccatgacagggcaacaatgtggccctgggaaaaacaacttaaagcaaagtaacattacttgccctttactctactctctcccaacatacagaaggacagacagactcagcacctgcatgcacacattcggggaagcttcagtctgggataacgacagagatcaagactttcgtgtgtcaatctcttgttttaatccttagtcccttactcaagaattacgctgtagacaactttaaaagaacatgaggaggataataataaccaaatatgttcggcaatagtaaaacaaatattatgggtctttattacctaggtaaatcacctttctaaaattctatatataaactttatattaaatttttaatgcaaaagcatatgagttatatttaatatacttttactgaaatgaactcactgcttgtaatctgttttgccccatgaagggcacttgtgttttctatttctaataatgcaagcatctcctgctaagtttttgaagatggaagaagttaaaacaagattagctgaaagaaggaaatcacttagttacattttatgtactagacctcctaacccggactagttatattttccatgtaacaaatggaatttccataatttgtacaaatataatttggctagagtatttggtaaatagccccctcgttggctgaaggactagtcctgaagaacagaatctaagaaccatcattaaaaatgcctaatcaagttgcagctaagaggtaggtggatggctttacaaagtgttaagactcagctaagtcttaaaaaaccactttagaattaggtccaaataaacactgtagaagaagctatgttaaattatcctttcagaggttctcttggtgctagggatcaagaacacttgaagatcagttttctcaatacaggctatattattattggcatgaaatccagagatcccactatattttcttattttcttttacaagtgccggtaacttcatttttaataatttggcgtggaactgtgattttcagtttgggaagtaatcctaatcaaaagacatgctttcaagaataaggcatgacatccttacaccaattaccctgagtacagaataatatttcttaaggaaatcgaattgtcgtggacaaacagtttaccctcttcagaggacaaaagaaggcaggtctatttttagcctttcgcaaaacctcagttccataaaggaagcactggtctccacaaatccattatcacaaacaaaatataacggttgctgatcaagataaatgcaagctgcatatattttccagaaaagttctgaaatgaggctgaacctgaaatcctgggaaaggcaggtgaaggacaattagagaaggtgtcccttgtagtgcacaaagacagtaaaacttcgccctcactacgcctcacctatgtttgagggagctccatgcgcttgcaatcaggagacccagttttatggctctgtgactttttttctttctcctgtccgatcataatcctgattccgatcccaggaatcagggccctgggaactttttttttttcccccaaatgcaaaggattttgacatcagtatgtcacaggtgaaggcattaaggcgcggcgagcagcaatgacttgcccaaactcacagcccatggcataactagaatgcaaatccacgtctgtcagcctgtaaaagtcctcactactagcctttcagttttctcaaaagcaaagagaaataacgacgacatccatacagcagtgttcccggaaacttggaaggatgagattcggaccaagcagctgaacggtgcttcctaaagcgaggaaggggtgtgcaaaatgatttccccctaagcggagacgaagagctggattacagcccccgccccagaaagcccctaagccctccatcccgagtcccccatccaggctgcacgcgactctgcagacctccccgtggccagcgcggcccagcggggaggggaagggggccatgcaaaaatggggcgcgctcactccatccccactcacctgtcagccgggccgcgccacggcgcacgcgcagggccggaggtcgcgcgcggagccggcacccagtttccacccctccctcaaggcggcggtcctcttctatccgcagtcccggacctggagcgggtcagaccccgacttccgcccctgactccccaggcggtcacatgaccgaagcggctgggagcagggaggggcatcatgt

SEQ ID NO: 2883 - DNA, 42611 bp, Homo sapiens
  source 1..42611: mol_type = genomic DNA
tgaagagaaaagatatttaattatttctcaggctaatctcttaaagcgctcaaagtgttttcacaagtgcaaggggagggattgttctcagccaacatttaccagtgattccgacacacgcaaaaacactcccaatcacggtgctttatacttacttttaatttctgcactgaaaaagaaaaggaaggtaaaaacaatgacagattagtttacagtgacttcatctttgtccttaaattaacctttgctcttgagagcagaagagggaaagacaggggaacatcaaagcatgatggtgaaacggtgaccaggacacctcggtctggctaacaagggttctaaaaacttggacacggtgccgtcaacgcactagtttgtaaacactgacaggcaacagttaagatacattaaaaaaaaaggaaagatacccacaattccattcttaaaatcaagcacaaaatctgacaatgaaacatatccaggggttgtgtgtccccatctgatctggaggtggcgctctgaaggcagccacaaggtgtgagtcacacactagggagacagacatctgttcaacacagaattccggctttgctgaactgcaatgcatattccctcttctcactagtacagaaatgttctgcaggcaggaacatgagccccccggctcattcacctgtacaacctcccctgacagatagtgagagccgcggcggggccaggggctctgtgtgctttggaggctactgcctctggaatgtttcgcattctcaaggtttggttgggctgtgggttttagttatgctccacacattgtttaggtgctcgctttatttttcatgtgcaaactgttactgtctaaagctttcagaagaacgtgtacagacaccctgcagagacgagggtcatgactgggccctcctgcctcttgtggtggggtgggggcatgggggcgcgtcacagaaatagagaaatgacatgttccgctgcagttaaactctagtccctgattcggtccatccagaggcgggggtggggctcctcagtaggtgattgtccactccttgacagaggcatcatgggaggtcgtgaccagcgtgtgctcgtccagccaggccaggctgctgacatggtgcagccggtgtgcatctgggaagaaagggtgcaatttaacgaaaagccaaacttctctgcaactatgtacatcttggactaggaagatggaacaacctgtgcctaaatcatctccagggccaagaaaatggccacgaatcgttgtaactcaggagcctggcacggtggcagtgtggctgaattctccacgtgacactcctgaaccccggggccgggtacctcttttttgtgtgctgcagggtaattagcagcatccctggctccacctacagatgccagtggctccctctctccaagtcttgacaaccaagttccacaggagtgaaataacaatgtcttcttatgtataaaagcgatgacatgcagacaccacacaaacagctacactgtatccatgccctattaaaatggggcaggcatgacaaccagtaagaggctggaacacacaggactgggggggccactgactttcccctctgtgacagtcacaccgtgggtgaacagattcgattccccataatcttgcctccacccaaccgagatgccaatagtgagacggtgcctgtgcgcttatggctcctctgtggctagctctgcccatgaagcccagggaggctcccagctgcaggcaagggggttcccaccagctctctgctccccaggtccgggtggcccccagcctctagatctgcagccccacctagacagggtgagattcagcccccacccctgcctggcacggcatacatcctgatgaaggaagccttggcctgcgggtggcacaggtgcccaggagcgccttcaaccaccaagcatgacttggctgtgaggccaggctttagcactctgtccacatcaccaggctggctcttttccagatgcagaactcaactatctgcacgagaacccgatgctgaggtcacttcatgtttggtggcctgtgacctcacagtgaagacacagaccccgacctcctaatctctatctgactagctcttgctgtatttttttctggatccatttcattcatgaacttgtttgattctcactaccagactggcgattgccttataaaccaggacggacgttgaaacctgctttgtctctcctcccttccagaccgggctgccttccctctttgcctgtcctgcacctgaagcctgcagctggggaatgggctctgggggtgggctcagacatttttaaataggaaagggccccattaatgtttaacacaaaaggatgtcttcaaggagaatggatgaggggacttgactacacactaggaggagagtggtaggggggcactcggggaggggagggtttggacaacacagagctgccttacaatacgtgcatggccacgcggggacatcacaaccccctcagggagaaatgatgacatgcggggctaaataaaacctactgttacaaatcatttcacctgtttcttttttaaatgtggctaccaggaaatttcaacgccacatgaggctcacattatacactggacgtggctgtcttagggagggggagaccctggtcccaggtgggatttaaggggtgagtgggggaagtgaagatgtcaaaagtgaggccttcactcagctcagcaggtgtcctgtgcatggggcccccgtggtccctcagtacggccagcagcgcagctggtgtttgctggatggaaggagacccacaactcttccgggccacctgtctagaagcacagaggctacttagccctggggactgaagccaggggacagcctgtgaggtggcccatggagccccgaaccatgggtggtccctgccaaggcctgggggcggaagtcaccttggatcttgactctggtttccgggtcactcagggtccaaacatacaccatcatgtccatgccaccggaggcaaagtgttcattgtctggggaccaggccaggcagacgatttttgcatggtgtccataaaaaacattgttctcctagttgcaggttgaaaacaagagaggtggcaggtcaggttcaggccgcagttgcccatatcacctcgcttatccctcatggcgacaataaggaccgaggtttctcacgcgctaactctatgccagcgacccctgcaaacccactgactcctcagaagcatggcacgaggcacctgctacttgtagaggcaagaaaactacagctcagacaggctcagctcaaggtcaccaagtcacagataacctcccactgccacctgcaccgcccagcacggggacagaggaggagcccgccgccactcaccgagtagccgtcagcaacgctgaacactgtgaccaccttgctggcgtcgcacaccgcgaggaaggcgccgtcgtgggagtaggccacgtcggtcacggggcccttggcctctaggagcttgccctcatccttcagcgtggtgcccaggatggaatacaggcggacgttgccgtcctacggcagggacagagaggaagtgagccacccctgaacacacacaccacacccatcctttgtgaagggggggtcgagggcttaagaaactgtgccgttcccactgactgctgctctgctgggcccatgccaggagctgggcatggctcttcccgtggatgggcctgaaacctacgcagctctatgaaaacagctgttggtacctcggggcaccgctggtctcatgaggccctcaagctggctggtggaggaagccactccatgccctggtcacatccggcacctgaaggacctggcagcacatagacccacccagcccctagcatggagggcactgccacgcctgctgcaggactgggttatcagagggctgccctcctgggctggagaggggaaatgagctcttctacagagcactcaggacttggccaggcacactgtgaccagaccacacacacaaattcaagggcatgagaattatgccgaggcagaactcaagggaaactgtaaaatgtctggttagtaccgcaccttgaagatgctgggaaacttctgtcactcttccttcaacctgtgagccgagcccagccccaggggatgccattccttgatttcctgacctgctaccctcttgcgctcccctcctgccgccactcatggggctggctctgaggcacagctgtgccctcctcggcactccctctacctcactgtccacagtcttgtgggcacccgggcagtgaggtgggggaagtgccgaggaggggaggggaaggctccagccctgggtggcaggagatggcgtggctgggccccagagcaggtcccacgccccgactgcccccatccttcccctgacccctcgccttccctgagacagccccggtactcacacagctcacactgtccccaaatcacccagataccaaggacagagagcacgggggagaggaaagcgacttaccacacccccaattgccaccgtgtccccgccggggtgcactgccacaacttcgggctcgtagccggggttgtcgatgctgaagcacttcctctgatccttcagcaggacaatctgtggcacacacaggcagctggtcaggcggtccagcccttcgggacaaaaccctcagtggtaggaggggcgcgtccctgtcggggctcactggagctgggtttggctccatacccaacctctttgcagggccacctggggctctgagccacaccacctggactcatgtcccgtttgacagttgctctagccagtcaggtggggcaggaaacacaactaactgtgaccattactgtcatcactacattacttccaaggcagtcaccacagcaccacctcttggaaagtcacttggcctcgatgggaatcaacgttcagggtaagaaaggtactaacaacagtaaacaaaaacagcgacagcccctaggcacgtgccagcgctctgctgtgagtgttccagccccacaaggcagggatcgggttccccgtttcagagaagaaaatggggtacggtgcttatgctgcacgcccaaggctccagttcccacaggctgagccgggactcgcccagaatccaagcctcggcacccgcactgggcctttgcctctggtacatgcagcagaggctctgcagcgggggccttccttccatctcccttccttgtcaattcttccggttctaacttactcaactgctcccagacagtggccttcatctctgagttttgcctttatcccagtgtgcccctacccaagccaccagctgtcatgagggaaggcagcctctgcccctaccgtctgggcttctgtttctgcgtggattgtgggtggatcgcgatgaatggtagcagcaccctgactaaaacctactactgaagaggcacctctgtcatctgcccggctctggaggtggccttacctactcacaggtgaagaatgagggcctaagcatttgcctgaagcttcgtccgacatgagacttgaacctggttgtttcctgatctaaaatcccaggcccctcctagcaccctcctaactctttgactggtgacagggagctctgcagaaaattctgacccagagcaggggttccagatgccctgggaggatcaggtaacagcagatcacagagaaatgccacatgaggaggtgcagagacctggagcctgtcccctgcacaccacaaccctaccggggtcctttctaacctcctgggcagcaggcgccagctgggccagtctgaacatcctctcagcctcaggggaaagggtggcctatgatgaccacaactttacagatgaggaaacctgggtctggagacacagggcacgctgccctaggcctcatcccctcacccacaaagccccatgtgcagaccccttggctgggaagagccctgctgtgcagagataggccacctgccagccttctagaactccgctttgtagcgtttcccccaggccccgaggcgctccatgtgtggattccctttgcacctccccacccccactggctgtccaggctgtttgcaataattacttggcagggatttcttattatctaggacacagagaaatccactgtccctaacgcaattaagttcacaaggcaaaggagggccagagggtgctgaaagcagctttctttagcagggctcgccactcgtgccaacaggtgccccttgacttccccggtctacatgccagcaagcctaggcccgccaacagataatatcttctgcagggcagaattctgtataaagtgggtcaggcttgggtctcaggtggctttggtccagatattccaaaggtgtgcaggtggccccactgtctggggttagaagccaggccgggaagtcaggtgccacccttctgcatgtgggaaagtaccaagctgctctaggcctcagcctcctcatctgtaagaggaaccaagatggtgtaaggagacttacatgtacttcctcataatcacctggatctgtgagtgctggggatgggaaactaaggctcagagagggtgaggtaaatgccggaggtcacacagctacaatgcagcagggctgggatgtgaacaggagcaaaggcaggcccaccccacagggtatctcatagactttacaggctgacaggcaggcagcgtggtctgaggcttagagacaaatcccagctctgccctccgaccagctgcggccttggacaaccaatttatccattccgtgcctccatttcttcatctgtacaactgatgtgatggtggtgaggattaaatatgtgagatcccttagtgcagtgcaaatgagcactcaaccaaaacactggctagagcaactgtcaaacgggacatgagtcaaattcagcaagcaggcaccacacagctgcaggctcccacccaaacactaagccaggtccctacctgtccaatgcacacgaccacggcgtatcccccggggccgacggctacgcactttggctgaacgtccagtttcacaactccttgtccgctgttagagagaaaggaagcacattacttcgacaatgcagcagctcagggtaggtatgcatacatatttactgttaaaccacagttttgctccttagaaggcaattctattgccacctatactggagagacttgctaaaatatgggatggtagcgaaaaaacgatccatgactctggtgcaaagagattataagtcataatgggggcccggggaggggtgggggggggggaaggaggggcgggaggcggtgaaaggcgttgattatgctcctatttatctgtggtaagccctcattacacccagatgtggcttttgtccccctgtctgttggctaaagactggagtttactgagcacagacagaattgagctctgctccccaaaatggatgggtaacttttaagaatccgttacctttaatgggtgaaaatcatgttatttttagccttggccaatgctatcaaaacttgttctagaaagactcatacacacaaacttcttgaaaactgagataatcaaggaaatttctgtgtcactcggccaagtgtggcatccccaaaggctctgcagcaaggtcaccaggccaaggctggctctgtaagggccttgccttgggttatctggcccagggaagacccttttatgggacgtgttaagagtggggtcaccacagggcagtagaaagaggaccagggcccagatgcctgggctctggggccgcttctgccactcatcgggaggcccaatttacctacagatgcccagtctgccaggcaggcagggcctgtgttacctacaaggacggcacacctgctaggagttgcgtgctgcaccctgtgccaggctcccatcaacaggccccaggagtccccatctcccaggcaacacgacttaggcaggactaccgggtgacaaaggggtctacacaagaaatgtagggccagaggaggggtcagacctgggcatggggacactggatgtgcagtggcctcgtcaggtcctggaacatttctctttcaagtccctccaactgcatttaggacttcagatcacttgcaaactgctactctcctagctccactgactgccaatcaaaggcccaagaccaaaaacaaacaagacattgtcttttaaccagatcactgtgtgcccatctcacccttgagcagaaggggaatgctgtcttgtactcagcacctgccctgtgccaggctcacctaatccacaacagcctgaggcaggctccactgtacccgcctttactgatgaggaaagggacacagggagagaccgcagcaggttcctggagaacagggctgtgatctgctgcccctgcttccagggcagagtccacacctggtcgttgtctgtgggcaagagcattacccagaccacctggatctgtaacacagtgctgggctcagggcccaacaacaggagaacaatgctggggacggggtgggagagatgaaaggagcaagtgaggcgtcctccagaacagtaactgctggagggcacaagccctccgaggggagctgaggctcatccggaacccccgcagacccgagtgctctcacctgtagtcccgcagcatgaggctggtgtaccgcacggtgtcgtccatgctgcagctgatgagctgccccgactcatccacggtcatcctggacacctggttcgtgtggcctttcccagcgaaggagtcgttctcccccgtctctgaatcccagtaatgtagggtggggttaaggaaaagcccggctcccaggactgctgggtgttctcaggtgtggcttcagtcctaagattctccatttacatcaagaatgagaatctcgccgcaaacggacataaccattccccctgggaagcctgcagtgtccactgttgacacgttcttaggaaggggtatctgaagtgtgggtgcaccacacagggattgggatgaggcagaaagggagccgtgctgaaggcctactggggaccagcaagctggggaggctccggcgtctcctctgctactagttatcgggtaggcgcaaccctctaaccccacatttctttatgttttgggggcagagggtggcatgtctgccctcctctcccagcctggggggacctccttgggtcccggacagtccctttgggaggtacagcacatgcggaccagagctgtccacacaaaaggcagtctccaacacagcacggtgctcagggagggcagcagaacaacgcacagcaggtgccatcatcagcaacgtgtgtgggcatccctgcccaggcactctgcagatggtggctccaaggttcaagacacacccgtgagcagggtgtcaccagccccaggccatgcaggaaaaacacaacagaagcccccatcatcagggagaaaccaggactcatttaaagaaacccagacaaggacttataagggggacacaaacacctccagggaacatcaccgaagggccacaaggcacctcgcaggagctccagccctggctctgtggaccacaggctgcatgactctggggcgggcacatcagctctctgggctctggttttcctatttttaaaacaaggggacccaacgtaagggtgtccaggtgcttgtgaattctaggaatcaagaaacccaccatgtggagtagggccaaggctggcgccaggtgccattggcagaggtagtggcagcccaagctcagggccgttaagccacactctcagggttgcacgacaagaagggactgatcaggtcggagccgcccatggcttttcctcagcataagccctggagttgccaaggacaactccaggggacagttgcctgtccccatgtacagacaggccacccctagaagccacacgggtcagaagagcgtgtggctgtggctgcagctggagccacctggctggcctggcctctggcatcatgggaacaggaaattcccccctagagccagcggctccggagccagctctttgagtcaaaggatattaatgtgtccgtcgtggctcccagagtaaatgtaggacttgccgccgtttttatgcaccgtcagacactggatcgatttactgtgaccctgtgaaggagacacactgggcgggtaagctgatgacacactgccctgccctctgccacccgctttccaccaacgaagcttctgggtaatggagggggcagacgcccctcaatccatggcagtgcaggtgctctgaggccccagtagccccagctgcccgaatgcacggcccacgagccctaagaaacctttccaaagctacccagtcacctacagaccctgcccttcattcccctccctccaaggtacctaacccagacctgggcccagacctgcgtctaaccaaggcccagcacgtcagcacctgagcacctaacgtgtgcagacacgtggcctgcaccccgccgaccagcacccgtcgcggggagccacaagggggtcggtccaggaggacttcgctggccacattcgcttcaggccctggtttgtgaggtttcttctctctccctgcccaggagtgctggccctgctgagggcaggggtctctctgatcactgtaaaagcccaaggctgtccgtgaacgctgacgctcctaccctaacctccctgactgctgcagtggagggcacacaaggctggtccacaaccagacagctgcttccagagggcggcgtttagccccctccatatctgagcctgagacaaaaataacagctagggtgcaggctcctcatgcctttctcctgcaaagggaggccagctcctggctggcccctctcctctgagctcagggcttttccgcaggaattcttgatctctgtggtatgccacatgttgccacaatatggcatagatctttggatgcaggtctccttggagacaggtacacagttaccagtgggactggagaatgggcaacgaatgcagctactttcatcttttccacagagacgtggggaaaaatcatcacatgccccagtaagagacactgagctgggcggcctccttccaatgtggcatcccaccagtcccttacagcgcggacctcagaccagcacagcccccaccagcagggctcaggcccaccttcctgccaaatcagaacgtgcactcggcaagaggccaagagacttgtgtgcaggctcaatgccttgaacttaccagaaacactcctagccatgcccagatgcccacgggtgttccttctggaggcctgcaagctcctgctgccctgagacttccctgtaaacttagtgcctctgggggcgtcagcagccagcgctttttagagctcccaggtggttctaacacgcagcctgggctgatacctgctgctccatcccactgcagcccagatcagcaccgaacatcagcatctgcgtgactcacacaggtgtggcatttgagagttgggacatgggggttttgacaactggcccttggggttttggtggaagggtgggatgctggttgcttttttgggacataagtttagccacggtggcaggccgggtgcactggccccagacagttggcagcagtggtattaggaagagcactctcagggcagccctgccaacagaaacgggacggcagacctgagggctgacacctggagaacactgtcggggatggctcatgggaaactgtttttctgggcagtagcgaagccttactcacccgtgtacaatttctcaccatcccacttggaggcccactggagcatggtctcgacaagagccctcagctcccccaggcaacaacctcctcggccccatgctgtgcgtgccttcctttttatactcatcaccctgggctgtgagcccagcaaggaggcgctcccgattcccctctatcctcgaggccacgtctagtgaacctttatggttcagccttccccctctcagcagtgctgctgcccccactgccccggcacaaaggaaccgtgactctatgcatgagcgttgaggtgacctggtccgtaggagtcacacacacaacgttaacgaggccccttcctcgtgggcaaactcccatgtagaatggatttggtgattctagcagcccctcctagaagccgtggtgtgaaggagccactgacagcacagcacgggccgagtgcacaggcccgggggctgctccaggctggcccacactagccctgcagggttcagaccctctgcagaggctggtcccccagagctccacggcagcaggatgcaatgggtgagggaagtgctagggtttgtctccccgagtggcttaaagcaggagcccgagaagggctgctgggatgaagtgcattgtccacctgccttgatattacagcttagaatagcaggaggggtcacccaccctgggccaccagcgctgggggaacctgacttggagttcccagcagatgcagtgtgggaagcaggcgagggcgctgctgtgagaggaggacctgaggatacagaagggacccctgctctggctcctgtccagctgcgagattcccagaggcgtcaacttggctggtgtgggtggagggagaaggcaggacccccccagccaatggaacacagggagcctttggctcaagtgaacccttccgggttagggttcagaagcaggcaccttgctcctccccaggttggcatttggggccttcacacctgggacccatggatgattctaactccgtttcctcctgctcccatcgctcccttatggaactccagtatctccttcacaccctgcccaccacattcaaactccaggcagcgccaaggcccaggcccaaggccacctgctcttgctcctccctcctgcccctggacctcagcgatgccccgtcacctgccctggtgctcagtgagcttctgctcttgcctgcagtcgggtaaagcacaggctgtgcactcccaattcagggaaggcagagccctgcaggaagtaaccgctctcaacagctgggggtgatggccactgccccgaatcactaggccctgactctccagttctcacagtagctcaaggggaacttggcacctggcctgccaccatggctaaactcatgtcccaagaaagcaaccagcatcccagccttccaccaaaaccccaagggccaaggaggcctgaggacacctctctagcttccacctggcttcccctcggttccccttccttgctggccactctggtctcttccctgtccacccagcgggcagagccttccccagggcaggccttaccttgatgacgtgcaggggcttgctggggttgtttctgtccagatagttgatgtacccggacagggagacactgagcaggtggtccttctgccataggcagcccagctgctggtccagaaccgtggagcccatgggaaatgtgctgaccacggagttcacgctgacgtcccaaatcttggaagttttgtccccagaagcagaaagcaaatgggtgctgtcgggactccaactaatctattcagaaaaaagcagtgtgtcatgtgccagaggactacagactggagagagaccccaaaaagcagcttgtccactgcgactgtttgagtaggacagaaggagcccagagagagggtgggacatgagtgaggccaaggacaacacccgcctccaggtctcccgttccagccactaccttctcccatcaccttattgcgaccttaaagcttttctgggcagatataaaaccgccccgacttatagcccctcatttcaagtttttgtctaactccggagtgagtgtggatggactgacacgtggactcggccaaattcccaccactaggccgggaaacacgctcatactcactgcgtaaatcccaccgtcgtgggccttgcttccgcccagcgcgcacaccttctccccagtcttcccgtcatagatgtatatcttccaagaaataaaaacatgtgggtcatgtgtgtgtgaacaccctctggagtaagcagtttctccatggactgtggctgtagaaaaccggggctcacagactaagctcccagtgtggtttaaaagcagacatgcatttactgggctctgacgacgagtctgcagatgtggggagggcgatgtctaagttctgcatgtcaggactagcattaggcagcctgcggctctgagcagtcacgggagcaggcagacaagccattccccaccccaaaacccatcccagttcttacctggccgtcagcactggctgtggcaaatctgttcccatcaggagagaatcgcacacagttgacaaagcggctgtggtcctgcaggaaaacaattacctgcctgatgaggggccgcaggcctgactctaggttcaagaatgctctctatgaaacacagcttgcagctccagctgttcatcagtgtgaactgttagtccactggaaaatttcagagcttaaaaaaacatcctgggcagtcccttagtggaggggcaggagtctgctccagcctgcctgccatgctgaccgctctacctgctgggaaagctgattagcccgagcgaaggcagaccacctccagttatgccccccccagtgaggtgcccccagcagctgccctcttccctctgggctctgaaagagctcaagccccaatccttaagcttcacgatggctgagaccaggaggcctcttcctggaggcaccagccctgtctggctctgttgcccaggctggagtgcagtggcacaatctctgctcactacaagctccgcctcccgggttcacgccattctcctgcctcagcctcccgagtagctgggacgacaggtgcccgccaccacgcctggctaatttctgtatttttagtagagatggggtttccctttgttagccaggatggtctcagtatcctgacctcatgtttccccgctttggcctcccaaagtgctgggattacaggagtaagtcactgcgcctggccaataattaacttttaaacaaagttaatgattatgaccttcatcaagaacaagagcctgagcgactaaaaggaaatgacatgacttccaggggcgactctgttactcgaataaggaaatgaatgcattctttccgcagtcaacaagagtttgtatcagagactgatccttaaataagcagttgtaaagctgccaacacctgccctgccctcttgctgcccacctgcaggcggcgctaacccggcaaatgcacatccagtgctaacaactctcttggcacaggaagggctcgctgctcagcaggtacgaacactaaccttcaggaaaagcaattcaaccccaaggcggataagctgccccgcgctctaagtaaatcacggacttaattttaaagcatgagctacctgtgtgggggacctgcctgtgtttgattgtgtaatgttttcagttgaattgtgcctctccaaaagacatgctgaagtcccaaccctgggacccaatgagaccttattcagaaacagggtctttgcagatgcagtccagttaaaatgaggtcattagggcaggctgtaaatccagcaggacttggtgtccttttaagagggaaatctggacacagatacagagttggggtgaagctggaggcagagatgggagttctgctcacaaaaagtaacccccagggctgtcagtatctgggaaagacaaggaaggactcggagtgcgtccctgcccacaccttgactacagacttctgacttccagagaataaatttccattgtttaaggcacccaatctgtggcttaacaaactttgttatggcagctgcggcacactaacacatgtcatcaatgctgcctctgacactcatgtaataacccaccaaggtgagctgtgcccatttcaccaatgaggaaacataggcccagaaagaggaatcaggtgcctgggggtcccaagggccacactcaaggaaatcgatgtccccacaaagtccgtcagagtcagcagaagatacagacaccgttcagtctggcaatgtccccagggcaggcagttctcgtagagaggccactccccgccccagaaatctctctaggcccaagagtgatgcgaccccagacctgtggcacaaaagcaaccctgggcttcctgcacttcaaagattaaaccatttcctccagccaacaacccaaacttgcttgcctcaggtaagccctcctcagggtgctgccaagacctgctcacggctggggtcaggctggacacaggcccagcaggccctggccctgcacctgaaccaggatctcccacctcattgacccgtgttttaacttagatgaaagccggagaaatcacacattctgacaaggggagtcccagtgctcctcgggagctactgagggcgacgacagtcacgtttccatcccagtggatgagcagattgtcctccctgcctcatttcagggagtgctgtcatggtgcttgcattccgttctatgactgaagagctcgtcctctgtaggttgtggtcaccgcccaagaggacagggatggaagcaccaggctggctcagtctgaacttgggctcaggtctgtgatcagctcatgagcgatggggctggcgagccctttgcctgccccccgcacctgggtgctgcaaggcttggccaggcaaggcagtgccaaactacaaggcgtgcagtacccaggcgggcccagggctcactaggagatggaacggggaacacaggactggacggtcgtctctggctatggtgctagaggtcacccttccttgtgtttaagcgcagttctgcatcttgcttctttagttccttttgtacctttttcactagttctaaggctggtcttctttgcttaaatggtctgtgttctaagttttctagcacttctaggtatgtgaagttggggaaagcagtttccccagaaggcccgatccactcagctgctgagagtgaaaaccaactttccagatggggctccagggccctccagagacgctttaccccccgaggggccatggagagcctgcgggcaaattcttcacaggagaacaccaggcctggagcagcgggtaactcaaagccacatcacctgcacgaatctggtctccagtttcctgtccagagctctcgtctcagctgcgctggctcctgggccttgggcagctgctcagcaagcctgggggtgctccagcccagagtcatcccagaggtcagatccctaactccgcaggcccatttgcatccccccttctgctgttacccaccatgagggagccgtcatgcactgagggcctgttcccgtcggggttagccgatggggtccacctcctatctgtgtcaacatggcccacggtcccttgtccatgtcagtccatagggtccacattccctgtgtcaaagggcctcacagggcagttcccgagagagctgcaggaaggagccggctgcagtgaaggcagtggtgggagggcctgaggcaaagcacttctagaccccctgttgggcggggggtggacaggggtgtatgcaccactactccttccagatgaggccacacaaccttgaccatgacataaccacagctcgaatcctagacctctgaccagcacatcgagttctctcgctgccgaactccgcttccttggccagcacagcctcgccttgccgctgacttcgcactggctcctccaagccagcctgagcttccttgaagtgcagtgggccagggagatggctgggcctggctgacccctgggtccttctgacgaatgagttaagaactaagagaaaagagctcaccccaaatgcccgaatcacccaagcccagatgagtgggtgggacagtggacgctgatggctcttgctacaaaatggaggaaactaatcagccactgttcaattccaacctgtcacaagtgcccatttcagtggctccctgaggtcaaaacatggacattcctactccagttccaggtcccagaagcgaggacattcctgctcgcgcaaaccccaggaccccaaatccaagtctgtggttcacctctgccgacgcctcccacaggctctggcagggtggtgtcatgtgtccctccctggccccagaacccagcaggggcaagggaggggcccggcacagtccagggacacagatgcccctcgagtagctcatccccatcaccttttcctgcacctcgagccaaggagtccaaatgcagacactgatgtctgctcctgaaatagccccttcaaagagagaagccgcgaaaagcccattaaccaaaaaaagcgagggctaaaaatagccctttccacacggaggcccggccagtgaacaaagagggagagggattggggaacctcccggggagttcaggggcagcagcttcctgaggctgccctcaccggccccctgcctctgccccaccccagccaaccagcggggctgcagcagtctcagtccagcctcatccctggtggacaactgacggtgtccggtccacactcctgcctgtcctcccttgcagccaacacatagccaagactgacctgtatcaacgagcccccctccccacagtcctcactccctcccaccaatatgctccctctcaccaccgaggaaaccgaggcttgaagcactgaggtcataattaagtaccacacccatgtcaacatcacagagcgacagagcgctgcaggccccagctggcctgtctccagcacacacatgctcactacctacctagtcagctcaggaaccctctgggagcccaccccattccccccagcctcagctgaccctgtacacaagaggaccacaagcccacccttaggctgttcacatgcctatgagctggtagaaggggacaggctctcggtcccctgtgcccagtcccaccccacacaagcccagcacgggcctccacgacccttggtcaatgggtgttcccaaaacacctttacaccgtgacctgcgaggctggctctggaccatccttcagcccacccatcccccgcagcaaacttccctgcaaagtgccctggggcagccctgcagcccggtccacttagttgggctgaggggcacgaaggagctacccacccaactgcctctcccgtcacccgggacgggtcagctcagtcaccatgttccctggagaacaaggaccatatgaagggacaagaggctcatcctaactaaccgtccttggggcacctactggccatgtgacctgggccaggtcaccctccctgctgtcagcccccagttttcaggagtcagccatcagcccagtgaagagcaaggccagtcgacaggaggggtggcgcgtgctgaagacaagggaggcggtcctgcatgcccatcacaggggcatggcccaggcagccaccatacatgccagaagggctgaaacatctgctctctgccctgtcttgagtgaggaaatatgaaaaagaaaaaccaccagaaaccttgcctgttttgagctcaaattttccttatctatcaggaaggcagcacttccggtaacagccacagctgaggtttccagccctgcttggctccagcctcaagtgggagaactatgtgaggtatgaggtccccgcagggcagaggcaatggaacagagggagcagtggcaccccagtgagggaagccagaagtcttccgtgctgaacatttttccacctacaatcacagcttgttagatctggcagtgagttctcagttctgcatcataaggctgagcccccaggacgacatgctgctctaagtaaccatttcattagacacaaactatccagtgcaccaccaactcctgggacctaggacatgcacacagctgtgagccacactccagagggggcgtgtggtcatcctagaccaccaaaccaactgctcacccgaccggaggaagcggatggccagagaggcaaagaacctggcccaagtaatgcgcatggcgaaggcagacaacagagagaaactcagtggggcctttaaacccatccaggagtacctatcccaggagcctgcctggcatgaagacatccccatgggtgagatgggggaaggcagggagatggtctcgccaccctccctttttcaggccacggtcagaccctctgaggggaacctacccctgggttcgcaaaatgccagtgctggagacccgagaccacggtgcccagggtctcctttcagaaccgttctcctgtaaccccggaagttacttccgcaggtcacctaccgcgtcttcaatgtcactgggtaggaatgagccggcacccaggcttattccaggccaaatgttcctccactcccatcttcctggagcctcattcaggcaaatgaagaccaaagctgggctacggtccctcaggacgaggggcacacagggaatgctgcttgcatttcagctcaggcacagcatcatggagttctgcttcagcttgtactgaaacgccttcagaacatgccttgttccttttcaaggcagcagctccaacacgacccagctggtccctccgcagtcatacgccagtccctctcccacctgggtaactagggaagcacctgccaccccagcgctgcacccccaagctcagggcagcttcctggtcccggccacagggggcctctgcagggagtgggtgcagaaggcgcagatgaagacaggcccgagttgccaccacagctgctcattctcaggaggcgaggggcggcaggcaaggccaccaaggcctgagcgctggtgcggaggcaaaggcagcccagactcagccgtcatgtgctgcagaatgaaagatctggggaaaaaagaccactgctatgtggatttcacagcaagtggaacttaattccctctaaaataaaaaatgcccacatatggttttaaaatcttttactataacaggctcaattaattcctgagaacttccacatcccaggctttccgaccacatcagaagagcccacatacgggaggaagcccagcgatgctcagcccaccatgtcctcaaagctgactgtggctgggcctcatgttagcactcacacctcctctcacttcccccagcctgcacgcgctccctttgtcttggggttggtcatggagagcacgaccgcagctttcctctggggtccggagggcttaagtgcagatacacaccaaagtgtatctgcaactcagaaggtatttgggggcaggtgtggggtccctgagcacccttcctgtccttcctatgcgtgggcagttgagtccgcacatgtctcctgagcatgtggatggtcactgctgcctctcacaccctccctgtggctgagggtgcagcacgcaagggtcactgtcaccctgtttccgggagggcccagaggcatgactcacccgaggggggcacagccacctagctctgtgccaggccacagccctttctatttctcccaggtcctcaggcagggcccatggttgtgggttccacaaaagacttcaagacacatggtggtacccaccctggagctgggctagctgggcagacatttgtacccaacactcctgggccagggcagtggggtgaagtcctttctgaagttagaaaggacaactaaagagaaagaatgttctggacaagtccccaagcaagcacacaggggcacagcagcctggtgaagaagacaggctccagcccacccctggaacaaactggtgcccctgaccctgctgagcaccctgtgctgggtttaatgcacagctgcagagtggaaatgatccctcccagggcaggccaaggagcccccacccacagccggcttctagctaccacagaagtctctgagctgcttcctcctgccctgggctgagatggggtgtgcagctgactcagcattactcaccctgctctgcagtgcctccaccctagcgaagaaacatggcctgaagccacagccttcaatacagctcccaaaatagccaggtctccactacctacccattaggtggtagccacaagagcagagtctgagagctgccgcgtgttcagctgcatacagggagcctccctatgctttcacctgcccagccaggcccagctcagcctgcggttccgtgacaaaatgaagcctgtttcactacgaacggggcatccttggaaagccccctcctgtaccctaagccaagaacagtctctggaaattctgctcactttgtgggtcccgtcctcgccctttccagctgcactgcgcaggctatttatgattcatggcatgatgtcactaaaatggacagtgctcctcactgagccactttaaggacatgatctcattaatcctccatgaggcagacagtgaaaccactgacggttccaagaggagtcccgagaacttggtccaatctgcaaacacaacctcctccaaggacatcaacagtccctaaaatgtgcatttccgggtccattgttcttgtccatcctcagcgcaagcacaagcgggatggggaaagccagggcagagccgtggggttgtgctgagactggctgctgggctcctcccctcactcctacaaagctggggcaggaaaatgggcatcacagatgctccagacctgccaggtggctctcctacttcaaattcatagtcaaaaccctcagatgctgctggccccggcacacccccgtcttgcagaagggagaagtgaggaggcttggcaaggcctgggtgcctaaggcggggcgcatgcacggcatgggcctctgagatgctgccagctacacccaaagcctgccgcatttctggcacatttcttccacaaagtatctttcagtcttctaaccgtttgtcactttgcaggcgcatcactgccctcactgtctctaggagagaccaatctggatgtcccgcaagctcccttcctctgccactttggtggctcagctaacagcaggccctgcaggctcccctctctaatgagcacctccagccccagatgcttgcctggttacacggtcagggacattcctgccccaatccccgacaggcacacatcatcctagggcagggcccttccttgtgggaaccatccatgcccagctgagggcctggggaggacgagtgctgggtgggggagccctccctctctctgcacacccctgggagcccacttctgtgtatcatggcatacgtggcatgtgctgtggtctctgccatcagcatctaaacaggctcagcctctgctagcctcatgtacaaaccacaaatttcacccaaaaagtaagttcacttacgccaattgtgaacttgaacttgaatgggggtccctcaaagaatgccgcgcagttatcatcgcttcccgtggccagccggtatggccggctctgcttgatgtccacgctgttgatgactttgttgtgtcctgtaatctcgcccacagaagagccactatcccagaggaagactgctccaaaccttgacccaatgacacaggtggaagacaaaaaaaaaaaaaaaaaatcaatcccagaaggctggtaagcaatctgatagctgagctgccagtgcacagaggatggagtgactgtcagcaggcagctcagaacgccacagggacaaatgagggaagcactggggttctggctccacaaggcatttgtccaaaggacccaagaacaagatggggcaagccggcgccttcgggaaggggatgcatgtgtgtgtctgtggggccccacgccacagggcccagggctatctttacagcttcaccattctccttacagttctattgggagggaacagttaccatcccctacaggaatgagatgccctgctcttggctgacattcaacaaaaacactgttttagttactatttgctactgaaaaaagaaggaattaagaccaacaggaatgacttgagaagccatggaaaaacacctactagaacatgtacgagaaagtgccattcagtgaagaacagacatgccactgtcaagttcaaggggttatggccagccatggtgctgcaggggggactctgactctcttgaattaaaaaaacctgggtttcggcaccaacctcaccagtcactaggcccctgaggtcagtagccacccagtgccacccagccagcatccactgcccctccctcctccatcagagacccttgggggaggtgcccagctggaagaaacagttcagcctccctggcagcttcatggggcagctgctgtgagggaccccgaatagaagtgctgttgctctttcactctgtccccttcttgctgcctgcaggtgggcatgagagctggggttctagcaggcaaggcactcaggacgtcagaggagatacatgagtgctgggccctggtgacaaacccagtgtgatgtggagttctaccttacctggggctgcagccagccctcacggggcccggcacctactgggagctcaaccctcacgagtgcaagttagtacagacatcagcgcatccccctcccagggtcatagcacatggacgcatgagccacagcaacagggcagggaggggctgagaggagtgactcacttctcccttccttccccgaccacggcgatcctcttactgtcttcagtccaagcaatgtctttgatcttcccagcgaaaggctggtactcatacttcaacaggtgctccttctgcgtggtatcccagatcctcagcttcccagacacatctgtggggcacagcgggcgggggagggggggaggcggtggtggggtaaagggcagggggagagccacaggtcactgccgggccagggccacgtggccataggcccactcagaaccatgtctggttgcttaggctttctagaggaaaaggcctagtgaagagaacgtgtcttagggcaacaatattcagccacccttaagtcagagcccgtggcatccagaggcctgccatttgggcctctgcattttgccagaaatcttgccagaaatcatctggataacaaaccctgcttaggcatcagaaaaagcccagggacacatcatggtaaactccaatatgccaggaagtggtttagttttctcactgtgtttcttttcttgtaggggcatcagaatgacgtgtgggcctcaggccacctttgtggaatgggacggcactggctacacctgcctctcctttgcagttgctgcagtgacttctggaaacgaggtgcacagctgtgagggtgcagcgtgctgcccactgcgatgcctcagcgtggcctggcggcctccacctgggcctgcagaccgggcttcctgtgcagcttcccaacagcgtgctgctgcctggcaaatcagcagcctcactcacacaccgagcagttccacgacgcacaggaatccaagcgtaagattcttctgtgagagtagcaggtgggtgttgcgggggaaggagaattacacacagaactcgatgctgattctcttctcaccggagcgtgggcagccaattgtaacagaagcaacaccgggggccacgtacccccaatcccccaccacgatcctgtcaccaagtaccaagtcccaatcccgacacaccctctccaaatgagcactgtgttggcgtgaagaaatgggagcattctagactaactctcaaggcttcacgctttaaaacctcagccccatctgctaagcaggtaaaggcgcctttttaagaggattgtcaggacacgttaacaaccaccacagctctacagctgcttccagtgaaaagagcttttgttttcttgctgcaactgagcagctcaaaggagggcagcagctaagagccaggccttgggagcaggggccctgggttcaaatccagcctctgccacacacaggctttgtggggctcagcaagcaacatggcttgtgtccttatccagaagagtggaaataacagagccactcacagggctgctgtaggttccacgagttaacacgtgcgaagtctccaactagtcttcagtgcacagcaagagctcgttacgagtcaggtggaacgagtccacgaattaacggaggctctacacaggccacgaagatgccttgcttgtgggcagacacagcccgagcctagactgagccatcctctgagatgagggagatgcacgtaaggactgtcctgctctcagtccagctgcggggacaggcaagaggtgatgccaaatccagtgaacagcactaactaaggggagtcccagaagggcccagttctctgcacaaggtccaggaagaccacctgctgtgctacctgagctgagttccaaaggtgacctggagatctgcttagttaagtcctttcactgataaaacaggccgggggggaagaaggggtcagaagaggaagtcaccacaggctggcagcatcggaggggagcactgtgtgtgcaggaaggacatgcagatacactcaggagcatacatatccacacatgcacacatgtccacacatgcacatgtgaccacgtggtctgctatgctcaggcccatccagggcccatgctgccccatggagaagacattgctctcaggacaaggcagagggcgtcccaccctgaaagaggcgccttcctccaggaagcctgccctgggcctacgtaaggccaaaccacacgcctgtcacatggccctcgccaactcccaagggcagcctggaaccacggccccagcgccaaggcagacagaacagtatcatgaaaataacctcaggaaaaggaggcctgggcctgcccccgaaatgacctgtgcactgaggactgccccgtgggaatgtgggctcccagagtgccggaggctcccaggtgcgcagcccttcccaaggttcaacacttcagcagtcatgaaccagtcagactgacagggtctaaagatcctgcagagggctggggccagctgccaggcaacccacttagtgggccagcacggctctttctcagcccccttctccaaaccacccccctaccacactatttttagccccacttcatctctgcagcaaacgttccaatgtaagccttaacaattgcttcgctctattcaaagaaatgtattagaaacataaaatatgatctcgcccaagaacacttggacctgaggatggccccaaactcccttggctcctctacaaaatcagggcacttttcagggaggacagcgtcccacgatggccacttatttatgtggtctgtcctttgcaacagtctccgcaacagccttccattgaattctgtctcattggacacctttctggggactggggacagggcaggcctgggcccgcaggttctcagcttgcagctgacagggcacggacaatgtgccaggcaggagcggaggcccttgccaactgcattcctctcctgagaagacacttctaagagcattcggctccatgttaaacatgtaaaagacattcgggccaaatcttggggctttaaatgaagagacttttgctggcaagcagggcttggggaaaaaataaatcacagagctaaataaatcatgggatgtaaatgagagcatgttttacagatggagctggagaagatctaaacacaaaaaccattaaatgcctactatgagccagactccgggcccaacccttcaccgtgacctcagctgaccgccaacagcagtcagccagctcacccagccgcctggctcgatcagaacagagccccagttttgtgacaggtaacgggtcacccaggggtaagtacccattagtgcaacagccatgctgggcatatccatgccttactggctccttcacaccctaagaggcaggcactagcagccccagtttggaagagaaaatttgggcccaggaaggtgagttactcaactaaggctacgccaccagtaagaggctgccatggtctgagtgtgacctcgaaaaccatgtgctggaaacttaatccccaatgcatcagaggcggcctatggagaggtgattaggccaggagggctctgccctcaggaatgggtattatgacatgagcagcttcccaataaaaggacaagcccagcccctcttcttctctcaccttctctttgttcttctgccatggactgacacagcaaaaggcccttgacagataccggcccctgctgtgcaacggcccctgctgtccaactgcccagccccaagaactatgagccaatacatttgtgttagtcgtaaattacccagcctgtgagcacaaagcagagtaagacagagccgaacccaggtcttccccaaccccaaggcctaccatctcccatacacccttcaggacaggctgctgtgcacacgcaggatggtacaagcatagggccacggcgtgcatgagtcccgccctcccctactggtgcttagctctctcagcaatttggtcatagctgtcactctccagagaggctgatgaggcccacatcagcttactcacttggcctccctgggctgcagatggctaggcaaggcaggcagtaagtatctgttgagcttatgaatgaatgagtgagtgaatgaatgagtgggccaccattctagaaggggtaccactctcactcctgtacctcttgttcccatctgtgtacaggaaaagctctgcgtcaaagaactaagtaaataaaaaaacatccttcaagaggaaagatctctccacccctgcctctgcctagcctcccactgagccacacaaaagcccaggctgcagagagcaaaggcccagtgtacaaataaaacgtgagcgctggcctggaggccagcattgtggtagcactgggaaaggagcagcgggtaaagatgacacaaaacaaaacatccattcacacatacacacacacacacacacacagacacacacacacacacacacacacacacacacacggcccacaagggctccaacataccatgccatggcttcccgcaaaaggtccctggccaacctcatggtggcatttctgctgacctccaagctggaactaactgcaacactacaaactagaaagtgtcctttctgttctagaactaaggccagttttgaaaaggggcattttggtagcttacaccaggggtgttcaatcttttggcttccctgggccacagataaaatacactaatactatcgatagctgatgagcttgaaaagaaaaaagaaaagaaaaaaaacctcacgttttaaaaagtgtaccaatttgtgttgggctgcattcgaagccatccggggccacatgcagcccatgggccaccggttggacaaggctggcttacacattccttgtcagcctcagctgaaactaattatactggctcccctcaactcaccacccccagcctgctcccccaccccccacctccctcctcccactctcccaaggccagaagcccagcttcgccctgggccctgagcgccacccaggcccccacaggtgtccacgagccttgcccccatacagtacctccggaggcaatgtagaatccgctgggcgcatacttggccaccaccacctgatgggcgtgctctgtgtagatgtcagcaagggctgggttctgcaggaggagaccccggaatgaacagaaggaatggagaagcagtcaagcttccagctctccacatcaacagatatggggtgaaaggggtgtacaaagaaacactgaagctaaaaccgtgaagaaaaccgcagaagcataccacttgcctacgtatctactgcctgcctacctatctctgggtgatagaatttcatgttactttaattcgttctccttagtctatgactgtacaacaaggtgatttttttccttttctgcttttctgtactttccataatacagaacaaatatatcagtgaaacagatacacaaaaggtggattagagcaagaagccctggttctaatccctcccatttgtgggaagctgcattcattccagcgctctgttctcttccgtgtttaggaccagctctcctggctgccaatcaatgttggaccccaaactcagcgcctggctgtgctgtgcaggagcagagcaggacacgctgtgggagccctctctatcaaaaacttgggtttggaaaggaaagtcgattccccactcccttgcatagcacagatcaaaggctgggtggactttgtggcaaaaatggggccaacatttgagactagaagcatcttcagcaatgaggtttcaacatgtaatgtgctaaaagtagatccctgcgcctccctcccggcatacacacacacgcagggcctcagtgaaacagaaacacacacacacactgggctgctctcaatctgtctccacagtgaagctttctttcaggagggaataaagacatggccatctaatctctgctacctactgtcagctttttacaaaccaagtgctctttgaaagaggcagcttcccgccagcttgaggcttaggacacaccagactcctgtgagggtgcccgggcacccctagcatgaccccacctgctgccaccccacccctcatctcccttagacccctcctcaagacctgaggggcccccatctcacgagactgagaccacagaagtacagaccctgattcctgcccaccttctgccatcctgtttaagctccacgtctgtgtgtagtctgtgcccttggccagcacctctccctgcctacggacacccactcacccatcaggcctaacggaagcgttccctcctccatgaagcctccaagtatggcccaagctatccgtatcaactcttctgtgcttccagatcatttaacatgtccaccgggatggcacaacacacatcatagtccctagcattcctgtccatctcctccaactctgctgtgccctgcttaacatgacctttatctcactagccatctcaataagtggtttgggggagaaaaaaagaagtacacacagaccttctctttcatccctaagacttaacacagcattatgtgatataatagacaccagtcataaattaatccattttgggataatcgttcgccagtgaaattagaatgtatcaaggtgtctatccaaagaagatactacgaatgacaagtaagcacatgaaaaagcgctcagtgtcattagtcttgggaaatgcaagtcaaaactacaacagaataccactccatactcactagaatcaataaaaagaaaagactgacatcaccaagtgctggcaagggtagaggggtggggacactggaatgttcacactgctggtggaaatgcaaaatggtacagttggaaaagagttgggcaggttatttataaacctaaacagacactactcacaccaaacaccagcaaccccactcctaggtatctgccctggagaaatggaagcatgtgtccaccaaaagacacaggagcaatgttcacagaagctttctttgcaatggccaaaaactggaaatacccaaatatccatcaacaggtgaacagagaaacaggcaacacaccgcactgcttagtgatagaaaggaacaaagtgcaaatgcactcaacaccagctatcaatcgccaacatgttatgcaaagtgaaaaagccagacagaaaagactacacattgcctctcacttcatatgaaagaagattttagaaaaggcaaccccaatgacagaaagcagataagcagctgctgggggtgagggtggaaggggtggcgggggcggggggcaccctccggagtgacaggaatgttctgtcatgacaggggtggtgcttatgggactatataggtcatctgtcaagatccaagccacacactgaatacagacaaattctactgtatctaaagtacacctcaataaaactaagatgctggctatttattaaatgtctgcccaatccaaccctctcccactccaattagtccttcatattctgacactgacacatccctacccaaagcacctggcaagaaaatgatccacttaacaggcagcccctccaagaccctgttcggtgtacactcacagctgactggggatgggggaggtctcacgctcacatacaggggcacctgcccatcccgccagacagatggcctcgtgggctctcccagcctggacgacctcctccccaggccgtgctgccgtagaaagggtggggctcccatgggccttccgctggggagggcatccagagatggaagatgcctgggcaggggcatgagaggaagttctgcccctaaaaattccttcccctaaatggtcagggctgtgtgtaaaaaccccaaagggcaacagaatcctgccagctgatgaatcactcactctcgtttgtattctaaatacaactgggtcagcggtgggggctgagatactccaaactgcagataatgacttacatctgagtcagagcagcctcctccccagctcctcagctcgcagagggaggctgcttactacacccagaaagatacctcacacccccacgtgtcactcggcctgtgaggctctgtccccatcagctgggtcgagatggcaccttgacaccctcagtgtgcccctctccccccagcctcctccccctccttccatcttggggaagaagaatgagattgggggttgagaagcttatttggggaaaaactctggaatggggaaaacgagacagggagggcaggaagccaattccaggagccccagtgctactgtaggcaaaagttctgtctccccatctccctgggggcctgggggagaccaccatgagcagccttggagttgcccactcagggacacccctcctcccaggctttcttctcatgctgctgcaggctgggccagctctggcagtgggaggctgccgttcagtcctcaccacaggcctgcccagttttccttgccaactcccaacccatcttctcttttacctccaccattttcaatgcagtcctcctgttcttcctgggaagagcgataactgctttggaatgcatctccaccctccaccaagccggtagtcttcaaatcccgaccctgattacctcacggtccggcttgcaacccacccttcctgagctccctccaggcttcagcccactcgtcgctaccctgctgccgccctgacgttgccagccactccttgggctgactaccccaacccatggcccctcaccccaacccttgaggatagaacaggtgcagcccctctaccttgctggccccagaccccttccccagtggcctccacacctgggggctagggcctgtgagggccagagctggggctgggataagacctcgagacaagccccagaattctgccaccacccctggaggagtccgggggcctctgaggacatgaaggacaccagccagcaatcaaggagtcacacacgcgagcagacccaggacccacggacttcggcaagtgacagcatgtaacagcacccagccctgccaacacagggcctggttcaaggcccagtggtgcccatttgaagcagaagctttggacttgacccgggaggccattctactctgtcacactatgctcaggtcccaccagcccccacctcccacctgtgcactgaggcatcctgcccaggaatagctggtctttttctgagaatcctgttgaatggcaaacctaaacatactcccccccggcacctgtacaatgtctgtgccgcctttgagactcgctataatacacaggtcatgcaaacaagcacacagaagcgacatttccgtaactctgttatgccccaggcagcaacatttacaattagtgagccctgagcccctcaaagctctcttactttcctatgtcctcccagtctcaggtgggtgacggaggggccagaggtcactactccaatttacaggtaggctgtgatgaccctgggtcctggggcttgggtctcaaggcttgccactggtatctcagctcctggcccacagtgaacctgatggaacatgctagaaggttggagatacctgcccaagcaaaaaacatttcagcagatgacgacacaacactgatgaaggggcctgctgtgccctcctttagctgccaactgtccccgggaaccccagagaaagtctcaggcgtcctccatggtccacccaggccaagtgagcgtgagcttccagtcagggcactggctttgtaaatactccaagttcctgcaagcaacagaggctgaaagctgttactgctgtaactgacctgtgcaaatataactggccagggcccttatgttcactggtgactacaactaaggccaaggctgaatgacagcaaaaaacctcagctccaaagcaggaatgtaaacttctgcgacaacacaacgccttctcctaattatcttttaaggcccaggcaaagggcttctcctccaagcagccttccctgatgctccaagctagaaatcatctctcccaccctgaacccccaccttccctgactcccaccccactgccctcactactttccaccttggactacacatcatttgtgccccacctgccttctgtactacgtggacaccagagtggggaaggttcacacttgattcaccatagcagctgccaaataccgacaaagaccagaacttggctggagcctggtagctgtttatcaagaaacaaatccccaccggccacttactattcactctcagacaggccctgggtgggcccctcagtggattctctttgaaacctcacaacacctgctgtaaggaaggtaacctcataatcccacatgacaaagaaaccaaggcagacactgggcgatacgccccaggccacccagctgttaagtggcagcgccagacctgaactcagggccagttgctgactcacctgggttatgagcatataactaacagcacggtgagtcaagggaggtaacaaatgctcaacaccttcacacaatcccaggtcacgtcactgcaaatcagggaccatatgtggcggcctttactcctccctgtggttttgttgtcttccttacggttggtctcaatgttagtgtgattctttaatacagagaataaagtctgcactggccaaccagctgtgtgcttccaaacagtgtacaggcagctccttgagctggctgaggacggggtggtcactcacaggccgccatgccctgaacgactttcccctcctgcctcccagctcagcctcagatgccttgaaacaggcctgggggtactcaccgtgtggccctgcacagcagcacccctcattggactacgtgtgagcgggacaccaccacctccgttttcagtcttcccctctcctactccccacccagggcccaccagggccttaactgatgagttgcaaaggtagacctgggggtggctcccagggttcaaattccagcaccttccagaggttcagcatcctcacctctcaaaagagagatgagggtatccacccaacagggcagtcatgaagacaagagcagaggtccctgccagggcccagacaaccttctgaagatgctttacgaattagctccgttaaatcttacactgatcccatgataacattcctcccactctcgcaggcatggaaacagaagaggcaagcacaccaagtttcagccacagaccagcacaaaatacactcaacaaagaacagagaggtgctcaggggtatacactggattggacagtggggcgggggtaggggtgggatgctggcctttccctggagagcaggcaggacccatacgtagaagtgacaagcaaggtgaccaaagctaaggacccacaggtctaaggagcaggcacatcgccagggcagggagtgcctgcccatcactgagacggcgaagagacgcacacagggccctttcctgtgtccacagctgtccctaacaagggccttgcagaaggtggaggtcactctccaaagaagcatctccaactactcttgggcaaggccatctctccagtagtcttacgcatgaggctaaacctcttctcttacctcaaagatggcttcagtatccctcccgttacctccaacagggcaagaaatgtaccaaaagcaacacacaggaggccacagtggggctgagaggacccaggtacacatgctgtttcctgcctggtttctccccacctctgccgtgtgtctcaacgctcctcctggagaactcttattcatccttcaagacccaactcaaatgtggcacttctccagcagctgtccccgctctgtggcacagctggctcctccctcacattcccagagcacccagggcattgttcttttgaagcacttaacctggtgccttcgaaggttctttaccagagttttcaaccttggtacccctggcatttggggctggacagttctttgtggaaggacggccatgtaccttgtcggatgtttggccacaaccctgacttcagataccagtggcacaaaaatgtctgcaaacgttgccagatatccctcaggggaatgaggtgggggaaattacccctccctgaaaatcactgattttaatcctggtcctctgtggcttagggtatggcttgccaagacaggggcttagtgaacatgtgtgggaaacgtgagagccagagatggctgcaccacgcaacggaacctgcgctgacgccgccttcatctttgagcagcttcctaattggcttccctgcctcagatctcagatacagaacttctccttaccgtaggctggatctgattacttgtctgtgagacctctgaatggctccagtggccttcagagcagggctgcgctatggtagggctgtgtgagccacctgccaccactgcacaccagcacttctcagcctgggtcctgtccactcccctcacgctcagtgccacagtaacagcccataagcacccggcccttcggtcctcccagatgtggtcccatctgcagaagcccagcgtcctgactggcacctgcagccactcagattctcctgagatgaaggccccccaccaccctctgcttcccctgccatcaggtggtcagactgaaggcctagaggttcctggctctgcacctggcaggcgctgctgccagctcgtttgcacccaggtgataatccaacgcaccacttccttctgccacctagagtttatttcactcccacccaggacagtgagctccatgtgggcagggcctccatcctgcacccccacaggccaatggccatctggatacacgcaggtagtcagcaggcgtccaattccggagaagcagctaggtcagtcctcaagccctctgtcatgccaccattacccccaacccgcaggaaacacaggtgagtcctctgcatgtgaatggtggcagctcacaccaagggaaaccaagagtgagcccaataccctccccaaccccccacttggtctgccccctgttcaaggagaaaagtccactgatactgcgcctgggttcccagcagtgtcaaattgctataaaccttgcactcccggaaactcaattttatagacatcatttttccaaatgtgtattttagttctggaatctaggaactggatactttaaaaaccaggccccaaacttgcctgcatagcaaatctgctggctgcctggcagcacacaagagggcctctgttgtgaggcaaaagttgctttttttttttctttttctaaacagggactactggcactactggcattttaggctgggtaatttttattgtaggatggtcccgtgccctgtttagaatcacaaacaggttcgttcacagccattgggggtgacccttcccagtctttgcacagaggtcataagaggcagaggtgatgcaggcagggtaaggaaacttagaaggaaccaccccagacctaaggaggtaccagcacctgcaggaagccttccttagacccccgaagcacagactatccatcccttctccgtggggaactaatgtctctcaaacacagtgtacatatggttcactggaatccccttcttggagctctctccttctggaatattagtttctacatggccaccattatagtctttcactctacagaggagagttgcctctccaggtgaggcaacgagatgtgttgaaataaacaggtaagaaacaccctttttctacaagtttaagaagtgccattatgctgggttcacaaaacagcttttaagtcaacaaaataaatgacagagggggctccaagtgcaaagctggcaacggtgctcgcctcttaggtatgaaaggcgattccacaaaatttaggtccggcaatctacactgagctgagctttccttgttctcatgcagtaagacctcagtggctgcctattatcttcacgacacagcctggttttccaggctttttaatcaatgagtaactcactgagcacctactgtgtgccagacactctcttaggcgaggacacggcagtgactgaaagagaggggaaagccctgctggcctggagctgatgcccagttagggggacaggcagatacctatgtacacttgtaggcagccgtagcctgctgcttgttagcttgcttcctacttattgtcagcaatgagaaagacagaaggccggggatggaaaattctattccggggacacccctctactaaggtgactacatctaagtataaaccaaagggaaaggcctagtgtggtggctcacgcctgtatcccaggactttgggaggccaaggcgagcgagcagatcacttgaggttgggagttcaagatcagcctggccaacacggcgaaaccccgttacctactaaaaaatacaaaaattagccaggtgaattggcacgtacctgtagtccccactactcgggaggctgaggcaggagatttgcctgaacccggcaggtggaggttgcagtgacccaagatcacgccaccgcactccagcttgggcgacagtaagcctccacctcaaattaaaaaagaaaaaccaaagagaagacagggagcaagacttgcagctatctgagaaaatgtccaggcaaaggcaataactagcaggtaccaagacagatgtgtggcatgttcaagaagcagcaaggaggcaagaacgctggagccgaggccacggtaaggactctggctttcaccgaggtgggaagccactagaggcctgtcttgtgtttcagccactccagcgagtgttgtgaacagacccccagggcaacaagggtgaaagcaaggagacctgtttggttttcgggagtctgggggcaataagtcaggtgggggaagatagcttagtcgtgggtggaggcagaggaagccagggaaatctgttagattctgaagatactttgaatgtggagtcagaaggatttactaaaattaaaatgtggcgcagtagcgaagcagagagtgaaacaggagtccaaggtttggggcctgaacagctggaggaacggtgttcccttttaggggaagagcacgtgggaaacacaaatttggcttggagtatgtatgttgagtctgagatgtcaatgagacatgttagatcttccatgatctggtcctccatttcttccctcttccctccctgagcctgcattccaaacagaccatcatccttcctgaacggtcatgccaattcatgtcacttttttttccaagagtactttgccctaaaaaaaatcgtacccacctttacttgagtacccagtccacccatccaactaacaagagactcagtgcctgatctacatccagcccagggagggctatattagtagcatctcgtgctgacctggcattgcagaaacttaaaaataattgagaagggaaacagggtaacccctgagaagaaaatggcaaaccacggggaaggggtaagaatacagagctcagaaacaggcagaatgggtttcacaagctgggaaatgctttctgcaaaggggtgcctgtccctgaatgaccactccattagaagcagctccagttactggcctgcctcaccttgctaagtctgactcctctttagagtaacggacccatgtggggtggaaagagatgctacagtttaagaagctatcacagggccagatgcacagcaggtactttatgtgaggccccctccctggaagtcaatgtggactgcaacgacagggaaggcctggttaggggcaaaacgaaatatcctactgctctgtatccgaggacgtgttagtggattttatttgccaaactactaaatatctctttagggttgtctcaatttttattttctcaaaagcctcaggacctgccttcggagacttccagatcattaccattagatccctggtgattttctccagttctaagcaaggcccttcggctttctaggaatctgtgtgactagcaagttgttagcaccttcaaagcacattcacacccgcccaccccctcatttgaggggcccagcaatccagggcaggtagagctctgtcttccagcagaggaacagcagcgactgcctgggttaacgagacagatgcgggcagagccagcagctcttcggaccaagaggcttctcctttcacagagaaggaaactgagacccagagaccccttcattccctcagccagttgctggcctcctggagggcaagtgtgtccgatcaacagtcccaacctaccaagggaaatcaggctgactttaagttgacaacccttgtatgcctatggcatcaatcaaaacatacatctttgtgccagccgcccccactaagcacagcacaggagaaatcacccaatggccgggccggcacctccaactcccaccccaccaattccatcactcaggctgaggaagggaaaagcaaaatttaagcgtgtaacccaggaagggagggagactgacagactgggtcaccccaacaattacagaggaataacatgaatttgcaaggatttcccaaggagctggctctagaagccttttcagcctgggtaccggaggcttgcagagaatgattcatgggaaaacactgcttcctgtttttgctttggggcttagatccatggtggcagatctggctggcccagaggcccgggtgtttttccgggctctgccatactggaagaccagggtattaacagcgagttagctgagtgccattccattcagcaagggctcaaagtgcaccaggcaccgctgggcttgagggacgccagcagctcattcattccatctgcccagccagcaggcgaagcgagagtggtcatcatctcatcatctgttttacagacgagaaaactggggctcagagatgcccaaatcgccaatcttctcaaggtcacgcagcggccgaccgggtcagtctgatccctcaaatccggagcccttgcttttaaggaatgaactaatctaatctcccatccacgtactaaccaggcctgaccgtgcttagcttccaagatcagaggcgatccggcgctttcagggtgctatgaccgtagacagaaacgaactaagactcagtttcctcatcaagaaggagcagacaaggacctgggtgaatctgaggccggcttccggggctccgaggtgtggctcccggtagagggggcgtggcgccctcaccctccccgggccaatgggcaggaggtgagaagtggagaggaaggcgaattatcccatcccaaggtggctccggagcagaaccgcgcccggggtagggggtactcacgtcgatgttccttaggatgacgcactttccattggtgtacagaaaattgttgcccttagggtcgccgccgatgatcttggagacgcccctctccacctgcgggaggctggcgaacaccttctctgcggagacacaaatgcggcggggcatgtcagggcagggcggggacggcggggacagaagggagaaggagccccggaccggtctcggccggtcacctgttgactgcgccgggagggcggcctccactttccacgagcgccaggaaccgcgcgacttcctggtccgcgccccgggccaggcccttgggggcagcggggctcctccggctcggcccacggcgccaacttgggggcgcaccccccgtcgggggtcccgccctgcaccaccgagggcggccccgccacgcctccggccggcgcccgcacccctcccccgcgccgaggactcccccgccacccgcacggcgcctaggggccggggaccggggccggggcagcgcggcggccgctcgggggccccgcgccgcggcacttactgatctcgtacggcatcctcgcccacttgttaccgcgccgcgctcgccgagagcctccggggccggcccgcgctgcgaattacacctcgccgaggccgagcccggggactggagccggaaggcggcaccgggcgtgccgggagtggagtgggcggtccgaggccggggctcagaggccagctcgcgcctgccctgcgcgctgtggttgcggacgccccgaacccggaagcgcggtcccgcgcgcggctcgcccccagctttgaccatatatagtcaagcgctcggctcggcggctgcgg

SEQ ID NO: 2884 - DNA, 42611 bp, Homo sapiens; identical to SEQ ID NO: 2883
  source 1..42611: mol_type = genomic DNA

SEQ ID NO: 2885 - DNA, 17432 bp, Homo sapiens
  source 1..17432: mol_type = genomic DNA
tgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacaggtagattgtttttccgacaaattatcaaacgacccatcattgcactctttcaaaatttgattctcagacgtacccattctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacacgtaagtggtgatggcagtggagtgtggagtctggggagatgaagtgtgaggtcgatctgtcctctggtcctgagacccacttctccaggcctctgccccctttgcttggcgacccaggtttattgtcccccatcttcctttcagcgcttggaactacagcttctcccagctgcctcgatttctcagtggttcctggtcagagttcagcacccaacctgagaacttcttgaaaggctgtaagtggtaaggataacaacggggcagggagctgaccacccccgagattttcactgtaaaacagtccagttttctaggagagggatgccccagagctgggagaagcggcacgtagcccttttagactgagcttacattttatctagcagtttgtgtcttctacttccctcaaggattcaggggggcttacctaccccagaggcaggctcagccctagccctacacttgaaaagcataggtctggccagctttctaactctcccctgtttctagggctcctgacggttcctgcatcttgaccaatagtgctgataacatcttgcgaatttataacctgcccccagagctgtaccatgagggggagcaggtggaatatgcagaaatggtaaggactggggctaactgcctcttcatcaatgctgcacatttaagtccttcgtggagatggaaaaagtgtagtccaagtgtttcctgttcacaaacgggactgtttttcaagacgagtttccacatgtagcgttttctgccccgaattctgaagttatttagagagaggtttcccctttctttaattaggaatctgtgttttttgctaaaaagtagtgaatttcttgtggcagcatatatatatttctatttcttatttttttgagacaaggtcttgctctgtcacccaggctggagtgctgtggtgtgatctcggctcactgcaacctctgcctcccgggttcaagcgattctcctgcctcagcctcacaagtagctggtattacaggcgcacgccatcacactcgactaatttttatagttttagtagagacggggtttcgccatgttgggcaggctgatatcaaattcctgacctcagaggatccgcccaccttggcctcccaaagtgcggggatcacaggtgtgagtcaccgtgcctggcttatagctatttattgattgactactgatatatgttagtcactgtgctgggataaagtggtggacaagacagatgaagggctggtttgctttctgtgtgggagacagacaacaaacatgtaaaccagcaagcatcaggaccaagatgatgataaatgctctgaaggaaatacacagaatgaagagagactaactagaggaaagcacattgcataaaatggtcaggaaggagctctctgaaaaggaggcatttgagctaagacctgaaggaggataagggatcagtcatgtgaaggcttctggaaagagctttccaggaactggcaatgatactataaacacccagaactgggaaatagctttgtgcgttaaaagaccagaaaggccctgcatggtggctcacgcctgtaatcccagctactcaggaggccgaggtgtgcagatcacttgaggccaggagttcgagaccagcctggccaatatggcaaaaccccatcgctactaaaaataccaaaattagacgcatgtggtggcacgcgcctgtaatcccagctacttgtgtggctgaggcaggagaatctcttaaactcaggaggtggaggctgcagtcagacaaaattgtaccactgcactccagcctgggcgacagagtgagactccatctcaaaaaacaacaaaacagactgggctcagtggctcacacctgtaatcccagcactttgggaggctgaggtgggcagatcacctgaggtcaagagtttgagaccagcctggccaacatggcaaaacctcatctctacaaaaatacaaaaattagctgggtgtgatggtgggtgcctgtaatcccagctacttgagaggctgaagcagaagaatcatttgaacccaggagatggaggttgcagtgagccaagatcatgtcactgcactccagcctgggtgacagagtgagactccatcccaaaacaaacaaacaaacaaacaaacaaacaaacaaacacaaaacaaaaaacccagaatgctggtatagccagactgaggcaagtgagggggacagaggggtgaggacagagaagagcagccacgtcgtgttggttcttatgggtaaggcatttggagtttatttgggaagtcatgagagaggtgttttttttttttttttgagacgagtcttgctctgtcgcccaggctggagtgcaatggcgtgatctcggctcactgcaacctctgcctcctggattcaagcgattctcctgcctcagcctcccgagtagctgggattacaggcacccgccaccatgcccagctaatttttgtatttttttaaatagagacggggttttaccatattggccaggatggtctcgtactcctgacatttgatccgccggtctcggcctcccaaagtgctgggattataggcatgagccaccgcgcctggcttaatttttgtatttttagtagagacaggttttgccacgttggcctggctggtctcaaactcctgacctcaggtgatccacctgcctcagccttccaaagtgctaggattacaggcgtgagccaccatgccaggccatgagagaggttttttttgtttgtttgtttgagacagagtcttgctctgttgtccaggctggagtgcagtggcaccatctcagctcaccgcaacctccgcctcccaggtttaagtgattctcctgcctcaaccttccgagtagctgggattacaggcatgtgccaccacacccggctaatttttttgtatttttttagtagagatggggggttcatcatattggccaggctggtctcgaactcctgaccttgtgatctgcccaccttggcctcccaaagtgctgggattacaggcatgagccactgcgcccggccaagagagttttaaaacagaagagtgaatggtttatgggtgggcaagagtgaaatccagggccaggcacggtggctcacgcctgtaatcccaacactttgggaggctgagatgggtggatcacctgaggtgaagagttttagaccagcctggccaacatggtaaaaccctgtctctactcaaatacaaaaattagttggggctgggtgcggtggctgactcctgtaatcccagcactttgggaggctgaggcaggtggatcacctgaggtcaggagttcgagaccagcctggccaacatgatgaaaccccatctctattaaaaatacaaaaaattagctgggcgtggtggcgggcgcctgtaatcccagctactctggagtctgaggcaggagaattacttgaaccaaggagatggaggttgcagtgagccaggattgcaccactgcactccagtccaggcaacagtgtaagactccgtctcaaaaaaaaaaaaaaaaaaaaaagattggctatagttttctcccacccatcctaatcaggttctgcctccatcgcttcctgaaagtgctcttgtcaaggtcactaatgtcctcttgggtcattctccttttttttttttttttttttttttgagacagagtctcgctctgtcacccagctggagtgcagtggcgccatctcagctcactgcaagctctgcctcccgggatcacgccattctcctgcctcagcctctcccgagtagctgggactacaggcgcccgccaccacgcctggctaattttttgtatttttagtagagacggggtttcaccatggtctcgatctcctgacctcgtgatcctcctgcctcggcctcccaaagtgctgggattacaagcatgagccaccgcgcccagcccctcttgggtcattctctaaattcgcctcactgcatctcttagcagcatgagtcactgtctccacctccctgcgctggagcactcaggcactcagggctctgctgggccttctcctcctccatcagcactctttcttttttttcttttttttgagacggagtttcaaaaaatcagacccaccaaggcatgtggcagttgtgttgctctttgctcggtacccgctagaggtctgttgccattaatttgaaatgagaccagttagtgtgactgtgcatctttcctggcaagttaaatgactatagtttctctgtttgtaaaatggggatgattataatagcacctgcctcacagagttgtgagaattaaaataatcagtaatgaattaaagcacttaaggccgggtgcggtggctcacgcctataatcccagcactttggggggccgaggcaggtggatcgcctgaggtcaggaattcaagaccgacctggccaacatagtgaaaccctgtctttactaaaaatacaaaaattagccgggcttagtggcgggcgcctgtaatcccagctacttgggaggtttgaggcaggagaattgcttgaatccaggaggcgaaggttgcagtgagctgatcgcaccactgcactccagcctgggcaagagagcaagacttagtctcaaaaaaaaataataaaattaaaaaaaagtacttaaaacagcacctagcatatagtaagtgttcggtaaacactagtagtcactggtatcagttgtgtgcaagccaagaataggaggatggtatggttgaggtttaccaggagagaaagacaagggtatcctgagagtgtcttcaagagtgtgcatgccatggtggactagaatctacagtgggtaaggaactggactgtaaataagtttttgatgaagctgaataaattgtcatggtagaaatagcagagcagggtcaggcctggtggctcacgcctgtaatcccgacactttgggaggccgaggcgggtggatcacctaaggtcaggagttcgagaccagcctggccaatatggtgaaaccccgtctctactaaaaaagatacaaagttagccaggcatggtcgtgattatgatattaatgattataatattaaaacattttaaaaaatatatcttgcaatacagatagtcaatttgttttctttttttctttctttttttttttttttttttgagacagagtctcgctctgtggcccaggctggagagcagtggtgtgatcttgcctcactgcaacctctgtttcccggttcaagcgattctcctgcctcagcttcctgagtagctgggattacaggcacgcaccaccgcacccggctaatttttgtatttttagtagagatggggtttcgccaagttggccaggctggtctcaaactcccgacctcaagtgatccacccatttccgcctcctaaagtgctgggattacaggcgtgagccactgctcctggccagtcagtttgttttcaaaagatttttgtggctggtgtggtggctcatgcctataatcccagcactttgggagaccaaggtgggaggaatgcttgagcccaggagtttgagaccagccttggtaacacagccagatcctgtctctatcaaaaaagttgggcctatggtcccagctacttgggaggctgaggtgggaggatcgcttgagcctgcgaggttgaggctgccatgacctttgattgcaccattgtactctagcctgggcgacagagtgagactctgtctcaaaacaaacaaccaaaacctttttgtgcttttttttttttttttcctgctagtgtaccagttctatcgcaacctctctcattaggtattttcatttttagtgtctacaagcttagcatttgaaatagataactttttttttttgagatggagtcttgctgtgtcccccaggctggagtgcagtggcgcgatctcagctcactgcaagctccgcctcccgggttcacgccattctcctgcctcagcctctcgagtagctgggactacacgcacccactgccaccacgccaggctaattttttgtatttttagtacagtcggggtttcaccatgttagccaggatggtctcgatctcctgacctcgtgatccgcccgccttggcctctcaaagtgctgggattacaggcgtgagccactgcacccggccttaaatagataaaatttgtataggtcagaaaattggggaagggtgtatttgggtatttccatatacttgtgtgtactgagtcttcttcccaatatagtttctcgggttttctcctttcttttccaccttttcacagaactttctgcaagtctcatttccagctccccagcgtctttcctgagtacttgccctgccccgtgggtcttgcaggaagcctttactcctcgtcttgccctctccaggagacactttgcatcctctgtaccctttatctctcagggtggggacggggaatgtcctcattcccaaatgctgtagccacacaattgctctttcgtctttgtgaaacttttcccttgaggcttatgctgattctctctcccgctgacgacgttggcactgtacagccttccggtgctctcctgttcgcccgccattttggtgacctcaggtatccaagccaaaagccagggtctctctcatcctttaatctttaatctccctgttcctaacccctcacatccaattacttcccaaatcccatcaagtctgcctaatcttcctaatccacccacatctgtccctcccactgcctctactttaattcaaggtcctattattttgggccttatgttgctgaaacagtctcctgcctccttttgctcattaaaaccgtatttgttgactctgcttattctgcaccacgtgttggggaagcagtggtgagagcgaggcagatgtgattccctccttctctgataggtatgacggaaggggagtgaggagcaccaggggctataggaaagaggaacaggggcgccttgcttagctggaggggttagggaagcgttcccagaggaagaagcatctaagagacctgaaggatgactaggattcagccaggaggagtcgttgggggagatgaaggaagaatattccagacttggagcctaggacatgtgaaagccagtgggttgaaagtgtggcgagttggcactttatgggacctgagagtcaaaatggcgggactcagagattttttttttttttttttttttttttgaaatggagtcttgctctgtcgcccaggctggagtgcagtggcgcgatctgggttcactgcaagctccgcctcccaggttcacgccattctcctgcctcagcctcccgagtagctgggactacaggcgcccgccaccacgcctggctaattttttgtgtttttagtagacacggggtttcaccacgttagccaggatggtctcgatctcctgaccttgtgatccgcccgccttggcctcccaaagtgctgggattactggcgtgagccactgcgcccggtcaggactcagagatttttatgggaattagcagatagagataagccttgagaggtgggtcgggggtagcacgtggtaatggaagactaggaggaggaactggcaagatttggtattgggttggaccaggagtggaaaggaagtgaagagtggtagcagtcaaggctggtgctcagatttcaggattgagcactggtgtggagtccaggaggaacagcaggtttgatggtggtggatgccgggcctattatggacaaattgagtttgaggaacctgtgggatgatcaagtggcactgtccaccaggcagttggatatatgggttcagagtatagaggtggacactgaagtcctggctggttgacatcagcctgaggcccagaagacaactgacgaaggacagtgtccagactatttatctctcacaaatcagtaagaaaaagacggctgggcatggtggctcatgcctgtaatcccagcactttgggaagccgaggcaggtggatcacccgaggtcaggagttcaagaccagcctgaccaacatggcaaaatcccgtctctactaaaaatacaaaaattagccgggtgtggtggcaggcgcctgtaatcccagctactcaggaggctgaggcaggagaattgcttgaacctgggaggtggaggtagtagtgagccgagatcgtgccactgcactccagcctggggacagagggagactctgcctccaaaaaaaaaaaaagaaaagaaaaagaaaaaagagaagaaaagaaaaagacaacaactggtcaggcatggtggctcacacctgtaatccccactttgggaggccgaggtaggcagatcacttgaggctgggagtttgagaccagcctggccaacatggtgaaaccccatctctactaaaaagtataaaaattagccgggcgtggtggcaaatgcctgtggtcccggctccttgggaggctgaggcatgagagtcgcttgaacccaggaggcagaggttgtagtgagccaagatcgtgccactgcaccccagcttggggaacagagaaagactctgtctcaaaaagaaaaaaaaagaaaaagaaaatgggcaaaatttatgaaaaggtgtacctaactaaatggccagtaaacatagaggaaatatctaatctctcttatagtaatgatggaaatacaaatttatgctgtaatgaaataccatttcaccaccttcaaattgagaaaaatgtaaaagtctggcaataccaagaagataaagaacaatagacacttttttttttttttggagacaggatcttgttctgttgcccaggctggagtgcagtggtgcgaacatggcacactgtagcctcaaactcctggggtcaagcagtcctcctgcctcactctcccaaacaggtgggactacaagtatgccaatatgcctgactaattttttaattttttgtaaaactggggtcttgctatattgcccaggctagaatagagactcttatacactgctggtgggagaggacattgggacaagtgctttgggaaagaaattgacattatagtatcttacaaagtttgcaaagtgcatagcgtagagaccagtaattttactcttcagcagaaactgtagagaaacccttctacatgtgtacagaatgttaaagcacactagccaaaaaacagaaaaacatcagtgattctaaatagaagaagggtagatcagtttgaatatattcatgagtagagtactatacaccagtgaaaatgcatgaattagagcaaaatgtgtttccatggttaaagcttgctatcacagagggatgtatatgatataataccattactgttaagtctaggccgggcatggtggctcatgcttgtaatcccagtgcattgaaaggctgaggtggctggattgcttgaggccaggagttttagaccagcgtgagcaacacagacccctgtttctacaaaaaaataattttaaagattagccgggcaggctgggcgtggtgtctcatgcctgtaatcccagcacttgggagactgaggtgggtggatcacgaggtcaggagttcaagaccagcctggccaagatggtgaaaccccgtctctactaaaaatacaaaaaaattagccgggcgtgatagcaggcgcctgtaatcgtagctactcaggaggctgaggcagagaattgcttgagtctgggaggcagaggttgcagtgagccaagattgtgccactgcattccagcctgggcgacagagcgagactccgtcaaaaataaataaataaataaataaataaataaataagccaggtatggtggcttatgcttatattcccagttactagggaggctgaggccaggggattgtttgcttgagcccaggagtttgaggtttcagtgagatgattgcgccactgtgctccagcctaggcaacagagtaagaccctgtctctaagaaaagaaaaaattaagtctaaagacctgcaagacaacgttagatactgttttttttcccatatgaatatactcctaggctgggcgcagtggctcacacctgtaatcccagcactttgggaggctgaggcagaaagatcacttgaggccaagagttcgagaccagcctggccaacgtggcgaaaccctgtctatactaaaaatacaaaaaattagctgagcatggaggtgaactcctgcaatcccagctactcgggaggctgagacacaagaattgcttgaacctgggaggtggaggttgcagtgaactgagatcgtgccactgcactcagcctgggtgacagagtgagactctgcctttaaaattaaaaaaaaaaaatttatatatatatatatatttatatatatatatatatttatatatatatatatatatatatatttatatatatatatatatatttatatatatatatatattcctaaggaaatgtatgacagtgataaattcaagatagtgtttacctctgagggagagtttctgttaggaaaggggtttaaacatatctttttgttcagctggatggaggggtcacagggctgtttttttaataagatactttgtatgtttgaactgtttaattttttttctttatttttgtaaggaggtttttttgtttccatttttgtatttttgagacagtgtttctgttgcccaggctggagtgcagtggcaatgatctcagctcactgtggtctctatctcctgggctcaagcaattctcatgcctcagcctccctagtagctgggactacaggcatgcactaccatgcccagctaatttttttttcttgtagagacagtgtttcaccatattgcccaggctggtcttgaactcctgggctcaagtgatctgcctgcctcagcctccctaagtgctgggattacaggtgtgagccactgtgctcagccgataatttttttcttttctttttcttttttttttggggggcactgtctctctgtcacctagggtggagtgcagtggtgcgatctcagctcactgcaacctttgtctcctgggttcaagggattctcctgcctcagcctcctgagtatctgggattacaggtgtccaccaccacgcctggcaaatttttgtactaatatttttttaaaggatcaaatggcacctagcatgtactcagtaagtatttgaataattggttggttctttgtctctgggttgaggtattattatttgtttcttcctctctaagtgtttataaagaaaaagtataaggcccggcacggtggctcacacctgtaatcccagcacttttggaggctgaggcgggtggatcacctgaggtcagaagtttgagaccagcctggccaacatcatggtgaaaccctgtctctattaaaaaaaaaaacaaaaacaaaattagccaggcatggtggtgcatgctctgtctcaaaataataaaaaaaaaaaagtatgaatctatatggcttttggtggctaaatttgacattaaagtctgagctcacccttgaacattgagacagagtctgtgctccatatatacaccccatctgccacaacactgctagaggcacgcgcctcagactccttttccctccgagtgactcagccattcccccgtctctgtataggtccctgtccttcgaatggtggaaggtgataccatctatgattactgctggtattctctgatgtcctcagcccagccagacacctcctagtaagtaatgtttgcctccctgctcgccgccccaccacccagtttcaagcagggcctcttgggagagtcaagggctgccaggggtctttggaggaggaaggcttggcatgcttatcagaggggctggtcagttggcttcctccccttcctttttttttttttagattgagtctccctctgtcacccaggctggagggcggtgatgcagtctcagctcactgcaacctccgcctcccaggttgaagtgattctcctgcctcagcctcctgagtagctgggattacaggtgtgcaccaccacacccagctaattgtgtatttttcatagagatggggtttcaccacgttggccaggctggtctcgaactgacctcaggtgatccacctgccttggcctcctgaagtgcttggattacaggcatgagccaccacacccagcctcatttttgtatttttagtagagacagggtttcaccatgttggccaggctggtctcgaactcctgacctcaagtgatccacctgccttggcctcccaaagtgctgggattacaggcatgagccactgtgcccggccattcctccccttcctttgacagcaccggggtttcagtgtccatgtctctctcagcgtggccagcagcagccgggagaacccgattcatatctgggacgcattcactggagagctccgggcttcctttcgcgcctacaaccacctggtagggaccgccatactcagccccagcactcgtactggcccggctctccttccttgagggcagctgaggctttgcaagacctgttttcagccctttccttcccccaggatgagctgacggcagcccattcgctctgcttctccccggatggctcccagctcttctgtggcttcaaccggactgtgcgtgttttttccacggcccggcctggccgagactgcgaggtccgagccacatttggtaagcatctgtgcctccaagggaggaggagagggaagggcactgccacctgcacaggggccttttgtgagccgggggccacctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggtaggggtcacaccctgagagcccaaagcagctgggcagcggggcaggagcagggatgtagtctgcagtgtaggggaatgggtggggatggggaaaaaatcccaagctgaaggagtgcctggagaccccgagggaggcagggacatccagggctttgggggtgactccaggtcctgttccttgtctccaggatgctgagctcctgtgctgggatctccggcagtctggttacccactgtggtccctgggtcgagaggtgaccaccaatcagcgcatctacttcgatctggacccgtgagtggctgtgactccttcctacacagggccctgataagcctaggaatgccagagcccagctgtagggtcccagtccctgggtgtgaggggttcctgccccaggggtgaggcctctgccagcaaatctctcctctctctcgcaggaccgggcagttcctagtgagtggcagcacgagcggggctgtctctgtgtgggacacggacgggcctggcaatgatgggaagccggagcccgtgttgagttttctgccccagaaggactgcaccaatggcgtgaggtcctcagttcaattccagagatgttggggcttgggttggggagggaggtgaatcccagagggagcaagtgtcctcactgaaggcactgatagaccctccccatctctccctcagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 2886 - DNA, 16063 bp, Homo sapiens
  source 1..16063: mol_type = genomic DNA
ccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacacgtaagtggtgatggcagtggagtgtggagtctggggagatgaagtgtgaggtcgatctgtcctctggtcctgagacccacttctccaggcctctgccccctttgcttggcgacccaggtttattgtcccccatcttcctttcagcgcttggaactacagcttctcccagctgcctcgatttctcagtggttcctggtcagagttcagcacccaacctgagaacttcttgaaaggctgtaagtggtaaggataacaacggggcagggagctgaccacccccgagattttcactgtaaaacagtccagttttctaggagagggatgccccagagctgggagaagcggcacgtagcccttttagactgagcttacattttatctagcagtttgtgtcttctacttccctcaaggattcaggggggcttacctaccccagaggcaggctcagccctagccctacacttgaaaagcataggtctggccagctttctaactctcccctgtttctagggctcctgacggttcctgcatcttgaccaatagtgctgataacatcttgcgaatttataacctgcccccagagctgtaccatgagggggagcaggtggaatatgcagaaatggtaaggactggggctaactgcctcttcatcaatgctgcacatttaagtccttcgtggagatggaaaaagtgtagtccaagtgtttcctgttcacaaacgggactgtttttcaagacgagtttccacatgtagcgttttctgccccgaattctgaagttatttagagagaggtttcccctttctttaattaggaatctgtgttttttgctaaaaagtagtgaatttcttgtggcagcatatatatatttctatttcttatttttttgagacaaggtcttgctctgtcacccaggctggagtgctgtggtgtgatctcggctcactgcaacctctgcctcccgggttcaagcgattctcctgcctcagcctcacaagtagctggtattacaggcgcacgccatcacactcgactaatttttatagttttagtagagacggggtttcgccatgttgggcaggctgatatcaaattcctgacctcagaggatccgcccaccttggcctcccaaagtgcggggatcacaggtgtgagtcaccgtgcctggcttatagctatttattgattgactactgatatatgttagtcactgtgctgggataaagtggtggacaagacagatgaagggctggtttgctttctgtgtgggagacagacaacaaacatgtaaaccagcaagcatcaggaccaagatgatgataaatgctctgaaggaaatacacagaatgaagagagactaactagaggaaagcacattgcataaaatggtcaggaaggagctctctgaaaaggaggcatttgagctaagacctgaaggaggataagggatcagtcatgtgaaggcttctggaaagagctttccaggaactggcaatgatactataaacacccagaactgggaaatagctttgtgcgttaaaagaccagaaaggccctgcatggtggctcacgcctgtaatcccagctactcaggaggccgaggtgtgcagatcacttgaggccaggagttcgagaccagcctggccaatatggcaaaaccccatcgctactaaaaataccaaaattagacgcatgtggtggcacgcgcctgtaatcccagctacttgtgtggctgaggcaggagaatctcttaaactcaggaggtggaggctgcagtcagacaaaattgtaccactgcactccagcctgggcgacagagtgagactccatctcaaaaaacaacaaaacagactgggctcagtggctcacacctgtaatcccagcactttgggaggctgaggtgggcagatcacctgaggtcaagagtttgagaccagcctggccaacatggcaaaacctcatctctacaaaaatacaaaaattagctgggtgtgatggtgggtgcctgtaatcccagctacttgagaggctgaagcagaagaatcatttgaacccaggagatggaggttgcagtgagccaagatcatgtcactgcactccagcctgggtgacagagtgagactccatcccaaaacaaacaaacaaacaaacaaacaaacaaacaaacacaaaacaaaaaacccagaatgctggtatagccagactgaggcaagtgagggggacagaggggtgaggacagagaagagcagccacgtcgtgttggttcttatgggtaaggcatttggagtttatttgggaagtcatgagagaggtgttttttttttttttttgagacgagtcttgctctgtcgcccaggctggagtgcaatggcgtgatctcggctcactgcaacctctgcctcctggattcaagcgattctcctgcctcagcctcccgagtagctgggattacaggcacccgccaccatgcccagctaatttttgtatttttttaaatagagacggggttttaccatattggccaggatggtctcgtactcctgacatttgatccgccggtctcggcctcccaaagtgctgggattataggcatgagccaccgcgcctggcttaatttttgtatttttagtagagacaggttttgccacgttggcctggctggtctcaaactcctgacctcaggtgatccacctgcctcagccttccaaagtgctaggattacaggcgtgagccaccatgccaggccatgagagaggttttttttgtttgtttgtttgagacagagtcttgctctgttgtccaggctggagtgcagtggcaccatctcagctcaccgcaacctccgcctcccaggtttaagtgattctcctgcctcaaccttccgagtagctgggattacaggcatgtgccaccacacccggctaatttttttgtatttttttagtagagatggggggttcatcatattggccaggctggtctcgaactcctgaccttgtgatctgcccaccttggcctcccaaagtgctgggattacaggcatgagccactgcgcccggccaagagagttttaaaacagaagagtgaatggtttatgggtgggcaagagtgaaatccagggccaggcacggtggctcacgcctgtaatcccaacactttgggaggctgagatgggtggatcacctgaggtgaagagttttagaccagcctggccaacatggtaaaaccctgtctctactcaaatacaaaaattagttggggctgggtgcggtggctgactcctgtaatcccagcactttgggaggctgaggcaggtggatcacctgaggtcaggagttcgagaccagcctggccaacatgatgaaaccccatctctattaaaaatacaaaaaattagctgggcgtggtggcgggcgcctgtaatcccagctactctggagtctgaggcaggagaattacttgaaccaaggagatggaggttgcagtgagccaggattgcaccactgcactccagtccaggcaacagtgtaagactccgtctcaaaaaaaaaaaaaaaaaaaaaagattggctatagttttctcccacccatcctaatcaggttctgcctccatcgcttcctgaaagtgctcttgtcaaggtcactaatgtcctcttgggtcattctccttttttttttttttttttttttttgagacagagtctcgctctgtcacccagctggagtgcagtggcgccatctcagctcactgcaagctctgcctcccgggatcacgccattctcctgcctcagcctctcccgagtagctgggactacaggcgcccgccaccacgcctggctaattttttgtatttttagtagagacggggtttcaccatggtctcgatctcctgacctcgtgatcctcctgcctcggcctcccaaagtgctgggattacaagcatgagccaccgcgcccagcccctcttgggtcattctctaaattcgcctcactgcatctcttagcagcatgagtcactgtctccacctccctgcgctggagcactcaggcactcagggctctgctgggccttctcctcctccatcagcactctttcttttttttcttttttttgagacggagtttcaaaaaatcagacccaccaaggcatgtggcagttgtgttgctctttgctcggtacccgctagaggtctgttgccattaatttgaaatgagaccagttagtgtgactgtgcatctttcctggcaagttaaatgactatagtttctctgtttgtaaaatggggatgattataatagcacctgcctcacagagttgtgagaattaaaataatcagtaatgaattaaagcacttaaggccgggtgcggtggctcacgcctataatcccagcactttggggggccgaggcaggtggatcgcctgaggtcaggaattcaagaccgacctggccaacatagtgaaaccctgtctttactaaaaatacaaaaattagccgggcttagtggcgggcgcctgtaatcccagctacttgggaggtttgaggcaggagaattgcttgaatccaggaggcgaaggttgcagtgagctgatcgcaccactgcactccagcctgggcaagagagcaagacttagtctcaaaaaaaaataataaaattaaaaaaaagtacttaaaacagcacctagcatatagtaagtgttcggtaaacactagtagtcactggtatcagttgtgtgcaagccaagaataggaggatggtatggttgaggtttaccaggagagaaagacaagggtatcctgagagtgtcttcaagagtgtgcatgccatggtggactagaatctacagtgggtaaggaactggactgtaaataagtttttgatgaagctgaataaattgtcatggtagaaatagcagagcagggtcaggcctggtggctcacgcctgtaatcccgacactttgggaggccgaggcgggtggatcacctaaggtcaggagttcgagaccagcctggccaatatggtgaaaccccgtctctactaaaaaagatacaaagttagccaggcatggtcgtgattatgatattaatgattataatattaaaacattttaaaaaatatatcttgcaatacagatagtcaatttgttttctttttttctttctttttttttttttttttttgagacagagtctcgctctgtggcccaggctggagagcagtggtgtgatcttgcctcactgcaacctctgtttcccggttcaagcgattctcctgcctcagcttcctgagtagctgggattacaggcacgcaccaccgcacccggctaatttttgtatttttagtagagatggggtttcgccaagttggccaggctggtctcaaactcccgacctcaagtgatccacccatttccgcctcctaaagtgctgggattacaggcgtgagccactgctcctggccagtcagtttgttttcaaaagatttttgtggctggtgtggtggctcatgcctataatcccagcactttgggagaccaaggtgggaggaatgcttgagcccaggagtttgagaccagccttggtaacacagccagatcctgtctctatcaaaaaagttgggcctatggtcccagctacttgggaggctgaggtgggaggatcgcttgagcctgcgaggttgaggctgccatgacctttgattgcaccattgtactctagcctgggcgacagagtgagactctgtctcaaaacaaacaaccaaaacctttttgtgcttttttttttttttttcctgctagtgtaccagttctatcgcaacctctctcattaggtattttcatttttagtgtctacaagcttagcatttgaaatagataactttttttttttgagatggagtcttgctgtgtcccccaggctggagtgcagtggcgcgatctcagctcactgcaagctccgcctcccgggttcacgccattctcctgcctcagcctctcgagtagctgggactacacgcacccactgccaccacgccaggctaattttttgtatttttagtacagtcggggtttcaccatgttagccaggatggtctcgatctcctgacctcgtgatccgcccgccttggcctctcaaagtgctgggattacaggcgtgagccactgcacccggccttaaatagataaaatttgtataggtcagaaaattggggaagggtgtatttgggtatttccatatacttgtgtgtactgagtcttcttcccaatatagtttctcgggttttctcctttcttttccaccttttcacagaactttctgcaagtctcatttccagctccccagcgtctttcctgagtacttgccctgccccgtgggtcttgcaggaagcctttactcctcgtcttgccctctccaggagacactttgcatcctctgtaccctttatctctcagggtggggacggggaatgtcctcattcccaaatgctgtagccacacaattgctctttcgtctttgtgaaacttttcccttgaggcttatgctgattctctctcccgctgacgacgttggcactgtacagccttccggtgctctcctgttcgcccgccattttggtgacctcaggtatccaagccaaaagccagggtctctctcatcctttaatctttaatctccctgttcctaacccctcacatccaattacttcccaaatcccatcaagtctgcctaatcttcctaatccacccacatctgtccctcccactgcctctactttaattcaaggtcctattattttgggccttatgttgctgaaacagtctcctgcctccttttgctcattaaaaccgtatttgttgactctgcttattctgcaccacgtgttggggaagcagtggtgagagcgaggcagatgtgattccctccttctctgataggtatgacggaaggggagtgaggagcaccaggggctataggaaagaggaacaggggcgccttgcttagctggaggggttagggaagcgttcccagaggaagaagcatctaagagacctgaaggatgactaggattcagccaggaggagtcgttgggggagatgaaggaagaatattccagacttggagcctaggacatgtgaaagccagtgggttgaaagtgtggcgagttggcactttatgggacctgagagtcaaaatggcgggactcagagattttttttttttttttttttttttttgaaatggagtcttgctctgtcgcccaggctggagtgcagtggcgcgatctgggttcactgcaagctccgcctcccaggttcacgccattctcctgcctcagcctcccgagtagctgggactacaggcgcccgccaccacgcctggctaattttttgtgtttttagtagacacggggtttcaccacgttagccaggatggtctcgatctcctgaccttgtgatccgcccgccttggcctcccaaagtgctgggattactggcgtgagccactgcgcccggtcaggactcagagatttttatgggaattagcagatagagataagccttgagaggtgggtcgggggtagcacgtggtaatggaagactaggaggaggaactggcaagatttggtattgggttggaccaggagtggaaaggaagtgaagagtggtagcagtcaaggctggtgctcagatttcaggattgagcactggtgtggagtccaggaggaacagcaggtttgatggtggtggatgccgggcctattatggacaaattgagtttgaggaacctgtgggatgatcaagtggcactgtccaccaggcagttggatatatgggttcagagtatagaggtggacactgaagtcctggctggttgacatcagcctgaggcccagaagacaactgacgaaggacagtgtccagactatttatctctcacaaatcagtaagaaaaagacggctgggcatggtggctcatgcctgtaatcccagcactttgggaagccgaggcaggtggatcacccgaggtcaggagttcaagaccagcctgaccaacatggcaaaatcccgtctctactaaaaatacaaaaattagccgggtgtggtggcaggcgcctgtaatcccagctactcaggaggctgaggcaggagaattgcttgaacctgggaggtggaggtagtagtgagccgagatcgtgccactgcactccagcctggggacagagggagactctgcctccaaaaaaaaaaaaagaaaagaaaaagaaaaaagagaagaaaagaaaaagacaacaactggtcaggcatggtggctcacacctgtaatccccactttgggaggccgaggtaggcagatcacttgaggctgggagtttgagaccagcctggccaacatggtgaaaccccatctctactaaaaagtataaaaattagccgggcgtggtggcaaatgcctgtggtcccggctccttgggaggctgaggcatgagagtcgcttgaacccaggaggcagaggttgtagtgagccaagatcgtgccactgcaccccagcttggggaacagagaaagactctgtctcaaaaagaaaaaaaaagaaaaagaaaatgggcaaaatttatgaaaaggtgtacctaactaaatggccagtaaacatagaggaaatatctaatctctcttatagtaatgatggaaatacaaatttatgctgtaatgaaataccatttcaccaccttcaaattgagaaaaatgtaaaagtctggcaataccaagaagataaagaacaatagacacttttttttttttttggagacaggatcttgttctgttgcccaggctggagtgcagtggtgcgaacatggcacactgtagcctcaaactcctggggtcaagcagtcctcctgcctcactctcccaaacaggtgggactacaagtatgccaatatgcctgactaattttttaattttttgtaaaactggggtcttgctatattgcccaggctagaatagagactcttatacactgctggtgggagaggacattgggacaagtgctttgggaaagaaattgacattatagtatcttacaaagtttgcaaagtgcatagcgtagagaccagtaattttactcttcagcagaaactgtagagaaacccttctacatgtgtacagaatgttaaagcacactagccaaaaaacagaaaaacatcagtgattctaaatagaagaagggtagatcagtttgaatatattcatgagtagagtactatacaccagtgaaaatgcatgaattagagcaaaatgtgtttccatggttaaagcttgctatcacagagggatgtatatgatataataccattactgttaagtctaggccgggcatggtggctcatgcttgtaatcccagtgcattgaaaggctgaggtggctggattgcttgaggccaggagttttagaccagcgtgagcaacacagacccctgtttctacaaaaaaataattttaaagattagccgggcaggctgggcgtggtgtctcatgcctgtaatcccagcacttgggagactgaggtgggtggatcacgaggtcaggagttcaagaccagcctggccaagatggtgaaaccccgtctctactaaaaatacaaaaaaattagccgggcgtgatagcaggcgcctgtaatcgtagctactcaggaggctgaggcagagaattgcttgagtctgggaggcagaggttgcagtgagccaagattgtgccactgcattccagcctgggcgacagagcgagactccgtcaaaaataaataaataaataaataaataaataaataagccaggtatggtggcttatgcttatattcccagttactagggaggctgaggccaggggattgtttgcttgagcccaggagtttgaggtttcagtgagatgattgcgccactgtgctccagcctaggcaacagagtaagaccctgtctctaagaaaagaaaaaattaagtctaaagacctgcaagacaacgttagatactgttttttttcccatatgaatatactcctaggctgggcgcagtggctcacacctgtaatcccagcactttgggaggctgaggcagaaagatcacttgaggccaagagttcgagaccagcctggccaacgtggcgaaaccctgtctatactaaaaatacaaaaaattagctgagcatggaggtgaactcctgcaatcccagctactcgggaggctgagacacaagaattgcttgaacctgggaggtggaggttgcagtgaactgagatcgtgccactgcactcagcctgggtgacagagtgagactctgcctttaaaattaaaaaaaaaaaatttatatatatatatatatttatatatatatatatatttatatatatatatatatatatatatttatatatatatatatatatttatatatatatatatattcctaaggaaatgtatgacagtgataaattcaagatagtgtttacctctgagggagagtttctgttaggaaaggggtttaaacatatctttttgttcagctggatggaggggtcacagggctgtttttttaataagatactttgtatgtttgaactgtttaattttttttctttatttttgtaaggaggtttttttgtttccatttttgtatttttgagacagtgtttctgttgcccaggctggagtgcagtggcaatgatctcagctcactgtggtctctatctcctgggctcaagcaattctcatgcctcagcctccctagtagctgggactacaggcatgcactaccatgcccagctaatttttttttcttgtagagacagtgtttcaccatattgcccaggctggtcttgaactcctgggctcaagtgatctgcctgcctcagcctccctaagtgctgggattacaggtgtgagccactgtgctcagccgataatttttttcttttctttttcttttttttttggggggcactgtctctctgtcacctagggtggagtgcagtggtgcgatctcagctcactgcaacctttgtctcctgggttcaagggattctcctgcctcagcctcctgagtatctgggattacaggtgtccaccaccacgcctggcaaatttttgtactaatatttttttaaaggatcaaatggcacctagcatgtactcagtaagtatttgaataattggttggttctttgtctctgggttgaggtattattatttgtttcttcctctctaagtgtttataaagaaaaagtataaggcccggcacggtggctcacacctgtaatcccagcacttttggaggctgaggcgggtggatcacctgaggtcagaagtttgagaccagcctggccaacatcatggtgaaaccctgtctctattaaaaaaaaaaacaaaaacaaaattagccaggcatggtggtgcatgctctgtctcaaaataataaaaaaaaaaaagtatgaatctatatggcttttggtggctaaatttgacattaaagtctgagctcacccttgaacattgagacagagtctgtgctccatatatacaccccatctgccacaacactgctagaggcacgcgcctcagactccttttccctccgagtgactcagccattcccccgtctctgtataggtccctgtccttcgaatggtggaaggtgataccatctatgattactgctggtattctctgatgtcctcagcccagccagacacctcctagtaagtaatgtttgcctccctgctcgccgccccaccacccagtttcaagcagggcctcttgggagagtcaagggctgccaggggtctttggaggaggaaggcttggcatgcttatcagaggggctggtcagttggcttcctccccttcctttttttttttttagattgagtctccctctgtcacccaggctggagggcggtgatgcagtctcagctcactgcaacctccgcctcccaggttgaagtgattctcctgcctcagcctcctgagtagctgggattacaggtgtgcaccaccacacccagctaattgtgtatttttcatagagatggggtttcaccacgttggccaggctggtctcgaactgacctcaggtgatccacctgccttggcctcctgaagtgcttggattacaggcatgagccaccacacccagcctcatttttgtatttttagtagagacagggtttcaccatgttggccaggctggtctcgaactcctgacctcaagtgatccacctgccttggcctcccaaagtgctgggattacaggcatgagccactgtgcccggccattcctccccttcctttgacagcaccggggtttcagtgtccatgtctctctcagcgtggccagcagcagccgggagaacccgattcatatctgggacgcattcactggagagctccgggcttcctttcgcgcctacaaccacctggtagggaccgccatactcagccccagcactcgtactggcccggctctccttccttgagggcagctgaggctttgcaagacctgttttcagccctttccttcccccaggatgagctgacggcagcccattcgctctgcttctccccggatggctcccagctcttctgtggcttcaaccggactgtgcgtgttttttccacggcccggcctggccgagactgcgaggtccgagccacatttggtaagcatctgtgcctccaagggaggaggagagggaagggcactgccacctgcacaggggccttttgtgagccgggggccacctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggtaggggtcacaccctgagagcccaaagcagctgggcagcggggcaggagcagggatgtagtctgcagtgtaggggaatgggtggggatggggaaaaaatcccaagctgaaggagtgcctggagaccccgagggaggcagggacatccagggctttgggggtgactccaggtcctgttccttgtctccaggatgctgagctcctgtgctgggatctccggcagtctggttacccactgtggtccctgggtcgagaggtgaccaccaatcagcgcatctacttcgatctggacccgtgagtggctgtgactccttcctacacagggccctgataagcctaggaatgccagagcccagctgtagggtcccagtccctgggtgtgaggggttcctgccccaggggtgaggcctctgccagcaaatctctcctctctctcgcaggaccgggcagttcctagtgagtggcagcacgagcggggctgtctctgtgtgggacacggacgggcctggcaatgatgggaagccggagcccgtgttgagttttctgccccagaaggactgcaccaatggcgtgaggtcctcagttcaattccagagatgttggggcttgggttggggagggaggtgaatcccagagggagcaagtgtcctcactgaaggcactgatagaccctccccatctctccctcagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 2887 - DNA, 15154 bp, Homo sapiens
  source 1..15154: mol_type = genomic DNA
gtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacacgtaagtggtgatggcagtggagtgtggagtctggggagatgaagtgtgaggtcgatctgtcctctggtcctgagacccacttctccaggcctctgccccctttgcttggcgacccaggtttattgtcccccatcttcctttcagcgcttggaactacagcttctcccagctgcctcgatttctcagtggttcctggtcagagttcagcacccaacctgagaacttcttgaaaggctgtaagtggtaaggataacaacggggcagggagctgaccacccccgagattttcactgtaaaacagtccagttttctaggagagggatgccccagagctgggagaagcggcacgtagcccttttagactgagcttacattttatctagcagtttgtgtcttctacttccctcaaggattcaggggggcttacctaccccagaggcaggctcagccctagccctacacttgaaaagcataggtctggccagctttctaactctcccctgtttctagggctcctgacggttcctgcatcttgaccaatagtgctgataacatcttgcgaatttataacctgcccccagagctgtaccatgagggggagcaggtggaatatgcagaaatggtaaggactggggctaactgcctcttcatcaatgctgcacatttaagtccttcgtggagatggaaaaagtgtagtccaagtgtttcctgttcacaaacgggactgtttttcaagacgagtttccacatgtagcgttttctgccccgaattctgaagttatttagagagaggtttcccctttctttaattaggaatctgtgttttttgctaaaaagtagtgaatttcttgtggcagcatatatatatttctatttcttatttttttgagacaaggtcttgctctgtcacccaggctggagtgctgtggtgtgatctcggctcactgcaacctctgcctcccgggttcaagcgattctcctgcctcagcctcacaagtagctggtattacaggcgcacgccatcacactcgactaatttttatagttttagtagagacggggtttcgccatgttgggcaggctgatatcaaattcctgacctcagaggatccgcccaccttggcctcccaaagtgcggggatcacaggtgtgagtcaccgtgcctggcttatagctatttattgattgactactgatatatgttagtcactgtgctgggataaagtggtggacaagacagatgaagggctggtttgctttctgtgtgggagacagacaacaaacatgtaaaccagcaagcatcaggaccaagatgatgataaatgctctgaaggaaatacacagaatgaagagagactaactagaggaaagcacattgcataaaatggtcaggaaggagctctctgaaaaggaggcatttgagctaagacctgaaggaggataagggatcagtcatgtgaaggcttctggaaagagctttccaggaactggcaatgatactataaacacccagaactgggaaatagctttgtgcgttaaaagaccagaaaggccctgcatggtggctcacgcctgtaatcccagctactcaggaggccgaggtgtgcagatcacttgaggccaggagttcgagaccagcctggccaatatggcaaaaccccatcgctactaaaaataccaaaattagacgcatgtggtggcacgcgcctgtaatcccagctacttgtgtggctgaggcaggagaatctcttaaactcaggaggtggaggctgcagtcagacaaaattgtaccactgcactccagcctgggcgacagagtgagactccatctcaaaaaacaacaaaacagactgggctcagtggctcacacctgtaatcccagcactttgggaggctgaggtgggcagatcacctgaggtcaagagtttgagaccagcctggccaacatggcaaaacctcatctctacaaaaatacaaaaattagctgggtgtgatggtgggtgcctgtaatcccagctacttgagaggctgaagcagaagaatcatttgaacccaggagatggaggttgcagtgagccaagatcatgtcactgcactccagcctgggtgacagagtgagactccatcccaaaacaaacaaacaaacaaacaaacaaacaaacaaacacaaaacaaaaaacccagaatgctggtatagccagactgaggcaagtgagggggacagaggggtgaggacagagaagagcagccacgtcgtgttggttcttatgggtaaggcatttggagtttatttgggaagtcatgagagaggtgttttttttttttttttgagacgagtcttgctctgtcgcccaggctggagtgcaatggcgtgatctcggctcactgcaacctctgcctcctggattcaagcgattctcctgcctcagcctcccgagtagctgggattacaggcacccgccaccatgcccagctaatttttgtatttttttaaatagagacggggttttaccatattggccaggatggtctcgtactcctgacatttgatccgccggtctcggcctcccaaagtgctgggattataggcatgagccaccgcgcctggcttaatttttgtatttttagtagagacaggttttgccacgttggcctggctggtctcaaactcctgacctcaggtgatccacctgcctcagccttccaaagtgctaggattacaggcgtgagccaccatgccaggccatgagagaggttttttttgtttgtttgtttgagacagagtcttgctctgttgtccaggctggagtgcagtggcaccatctcagctcaccgcaacctccgcctcccaggtttaagtgattctcctgcctcaaccttccgagtagctgggattacaggcatgtgccaccacacccggctaatttttttgtatttttttagtagagatggggggttcatcatattggccaggctggtctcgaactcctgaccttgtgatctgcccaccttggcctcccaaagtgctgggattacaggcatgagccactgcgcccggccaagagagttttaaaacagaagagtgaatggtttatgggtgggcaagagtgaaatccagggccaggcacggtggctcacgcctgtaatcccaacactttgggaggctgagatgggtggatcacctgaggtgaagagttttagaccagcctggccaacatggtaaaaccctgtctctactcaaatacaaaaattagttggggctgggtgcggtggctgactcctgtaatcccagcactttgggaggctgaggcaggtggatcacctgaggtcaggagttcgagaccagcctggccaacatgatgaaaccccatctctattaaaaatacaaaaaattagctgggcgtggtggcgggcgcctgtaatcccagctactctggagtctgaggcaggagaattacttgaaccaaggagatggaggttgcagtgagccaggattgcaccactgcactccagtccaggcaacagtgtaagactccgtctcaaaaaaaaaaaaaaaaaaaaaagattggctatagttttctcccacccatcctaatcaggttctgcctccatcgcttcctgaaagtgctcttgtcaaggtcactaatgtcctcttgggtcattctccttttttttttttttttttttttttgagacagagtctcgctctgtcacccagctggagtgcagtggcgccatctcagctcactgcaagctctgcctcccgggatcacgccattctcctgcctcagcctctcccgagtagctgggactacaggcgcccgccaccacgcctggctaattttttgtatttttagtagagacggggtttcaccatggtctcgatctcctgacctcgtgatcctcctgcctcggcctcccaaagtgctgggattacaagcatgagccaccgcgcccagcccctcttgggtcattctctaaattcgcctcactgcatctcttagcagcatgagtcactgtctccacctccctgcgctggagcactcaggcactcagggctctgctgggccttctcctcctccatcagcactctttcttttttttcttttttttgagacggagtttcaaaaaatcagacccaccaaggcatgtggcagttgtgttgctctttgctcggtacccgctagaggtctgttgccattaatttgaaatgagaccagttagtgtgactgtgcatctttcctggcaagttaaatgactatagtttctctgtttgtaaaatggggatgattataatagcacctgcctcacagagttgtgagaattaaaataatcagtaatgaattaaagcacttaaggccgggtgcggtggctcacgcctataatcccagcactttggggggccgaggcaggtggatcgcctgaggtcaggaattcaagaccgacctggccaacatagtgaaaccctgtctttactaaaaatacaaaaattagccgggcttagtggcgggcgcctgtaatcccagctacttgggaggtttgaggcaggagaattgcttgaatccaggaggcgaaggttgcagtgagctgatcgcaccactgcactccagcctgggcaagagagcaagacttagtctcaaaaaaaaataataaaattaaaaaaaagtacttaaaacagcacctagcatatagtaagtgttcggtaaacactagtagtcactggtatcagttgtgtgcaagccaagaataggaggatggtatggttgaggtttaccaggagagaaagacaagggtatcctgagagtgtcttcaagagtgtgcatgccatggtggactagaatctacagtgggtaaggaactggactgtaaataagtttttgatgaagctgaataaattgtcatggtagaaatagcagagcagggtcaggcctggtggctcacgcctgtaatcccgacactttgggaggccgaggcgggtggatcacctaaggtcaggagttcgagaccagcctggccaatatggtgaaaccccgtctctactaaaaaagatacaaagttagccaggcatggtcgtgattatgatattaatgattataatattaaaacattttaaaaaatatatcttgcaatacagatagtcaatttgttttctttttttctttctttttttttttttttttttgagacagagtctcgctctgtggcccaggctggagagcagtggtgtgatcttgcctcactgcaacctctgtttcccggttcaagcgattctcctgcctcagcttcctgagtagctgggattacaggcacgcaccaccgcacccggctaatttttgtatttttagtagagatggggtttcgccaagttggccaggctggtctcaaactcccgacctcaagtgatccacccatttccgcctcctaaagtgctgggattacaggcgtgagccactgctcctggccagtcagtttgttttcaaaagatttttgtggctggtgtggtggctcatgcctataatcccagcactttgggagaccaaggtgggaggaatgcttgagcccaggagtttgagaccagccttggtaacacagccagatcctgtctctatcaaaaaagttgggcctatggtcccagctacttgggaggctgaggtgggaggatcgcttgagcctgcgaggttgaggctgccatgacctttgattgcaccattgtactctagcctgggcgacagagtgagactctgtctcaaaacaaacaaccaaaacctttttgtgcttttttttttttttttcctgctagtgtaccagttctatcgcaacctctctcattaggtattttcatttttagtgtctacaagcttagcatttgaaatagataactttttttttttgagatggagtcttgctgtgtcccccaggctggagtgcagtggcgcgatctcagctcactgcaagctccgcctcccgggttcacgccattctcctgcctcagcctctcgagtagctgggactacacgcacccactgccaccacgccaggctaattttttgtatttttagtacagtcggggtttcaccatgttagccaggatggtctcgatctcctgacctcgtgatccgcccgccttggcctctcaaagtgctgggattacaggcgtgagccactgcacccggccttaaatagataaaatttgtataggtcagaaaattggggaagggtgtatttgggtatttccatatacttgtgtgtactgagtcttcttcccaatatagtttctcgggttttctcctttcttttccaccttttcacagaactttctgcaagtctcatttccagctccccagcgtctttcctgagtacttgccctgccccgtgggtcttgcaggaagcctttactcctcgtcttgccctctccaggagacactttgcatcctctgtaccctttatctctcagggtggggacggggaatgtcctcattcccaaatgctgtagccacacaattgctctttcgtctttgtgaaacttttcccttgaggcttatgctgattctctctcccgctgacgacgttggcactgtacagccttccggtgctctcctgttcgcccgccattttggtgacctcaggtatccaagccaaaagccagggtctctctcatcctttaatctttaatctccctgttcctaacccctcacatccaattacttcccaaatcccatcaagtctgcctaatcttcctaatccacccacatctgtccctcccactgcctctactttaattcaaggtcctattattttgggccttatgttgctgaaacagtctcctgcctccttttgctcattaaaaccgtatttgttgactctgcttattctgcaccacgtgttggggaagcagtggtgagagcgaggcagatgtgattccctccttctctgataggtatgacggaaggggagtgaggagcaccaggggctataggaaagaggaacaggggcgccttgcttagctggaggggttagggaagcgttcccagaggaagaagcatctaagagacctgaaggatgactaggattcagccaggaggagtcgttgggggagatgaaggaagaatattccagacttggagcctaggacatgtgaaagccagtgggttgaaagtgtggcgagttggcactttatgggacctgagagtcaaaatggcgggactcagagattttttttttttttttttttttttttgaaatggagtcttgctctgtcgcccaggctggagtgcagtggcgcgatctgggttcactgcaagctccgcctcccaggttcacgccattctcctgcctcagcctcccgagtagctgggactacaggcgcccgccaccacgcctggctaattttttgtgtttttagtagacacggggtttcaccacgttagccaggatggtctcgatctcctgaccttgtgatccgcccgccttggcctcccaaagtgctgggattactggcgtgagccactgcgcccggtcaggactcagagatttttatgggaattagcagatagagataagccttgagaggtgggtcgggggtagcacgtggtaatggaagactaggaggaggaactggcaagatttggtattgggttggaccaggagtggaaaggaagtgaagagtggtagcagtcaaggctggtgctcagatttcaggattgagcactggtgtggagtccaggaggaacagcaggtttgatggtggtggatgccgggcctattatggacaaattgagtttgaggaacctgtgggatgatcaagtggcactgtccaccaggcagttggatatatgggttcagagtatagaggtggacactgaagtcctggctggttgacatcagcctgaggcccagaagacaactgacgaaggacagtgtccagactatttatctctcacaaatcagtaagaaaaagacggctgggcatggtggctcatgcctgtaatcccagcactttgggaagccgaggcaggtggatcacccgaggtcaggagttcaagaccagcctgaccaacatggcaaaatcccgtctctactaaaaatacaaaaattagccgggtgtggtggcaggcgcctgtaatcccagctactcaggaggctgaggcaggagaattgcttgaacctgggaggtggaggtagtagtgagccgagatcgtgccactgcactccagcctggggacagagggagactctgcctccaaaaaaaaaaaaagaaaagaaaaagaaaaaagagaagaaaagaaaaagacaacaactggtcaggcatggtggctcacacctgtaatccccactttgggaggccgaggtaggcagatcacttgaggctgggagtttgagaccagcctggccaacatggtgaaaccccatctctactaaaaagtataaaaattagccgggcgtggtggcaaatgcctgtggtcccggctccttgggaggctgaggcatgagagtcgcttgaacccaggaggcagaggttgtagtgagccaagatcgtgccactgcaccccagcttggggaacagagaaagactctgtctcaaaaagaaaaaaaaagaaaaagaaaatgggcaaaatttatgaaaaggtgtacctaactaaatggccagtaaacatagaggaaatatctaatctctcttatagtaatgatggaaatacaaatttatgctgtaatgaaataccatttcaccaccttcaaattgagaaaaatgtaaaagtctggcaataccaagaagataaagaacaatagacacttttttttttttttggagacaggatcttgttctgttgcccaggctggagtgcagtggtgcgaacatggcacactgtagcctcaaactcctggggtcaagcagtcctcctgcctcactctcccaaacaggtgggactacaagtatgccaatatgcctgactaattttttaattttttgtaaaactggggtcttgctatattgcccaggctagaatagagactcttatacactgctggtgggagaggacattgggacaagtgctttgggaaagaaattgacattatagtatcttacaaagtttgcaaagtgcatagcgtagagaccagtaattttactcttcagcagaaactgtagagaaacccttctacatgtgtacagaatgttaaagcacactagccaaaaaacagaaaaacatcagtgattctaaatagaagaagggtagatcagtttgaatatattcatgagtagagtactatacaccagtgaaaatgcatgaattagagcaaaatgtgtttccatggttaaagcttgctatcacagagggatgtatatgatataataccattactgttaagtctaggccgggcatggtggctcatgcttgtaatcccagtgcattgaaaggctgaggtggctggattgcttgaggccaggagttttagaccagcgtgagcaacacagacccctgtttctacaaaaaaataattttaaagattagccgggcaggctgggcgtggtgtctcatgcctgtaatcccagcacttgggagactgaggtgggtggatcacgaggtcaggagttcaagaccagcctggccaagatggtgaaaccccgtctctactaaaaatacaaaaaaattagccgggcgtgatagcaggcgcctgtaatcgtagctactcaggaggctgaggcagagaattgcttgagtctgggaggcagaggttgcagtgagccaagattgtgccactgcattccagcctgggcgacagagcgagactccgtcaaaaataaataaataaataaataaataaataaataagccaggtatggtggcttatgcttatattcccagttactagggaggctgaggccaggggattgtttgcttgagcccaggagtttgaggtttcagtgagatgattgcgccactgtgctccagcctaggcaacagagtaagaccctgtctctaagaaaagaaaaaattaagtctaaagacctgcaagacaacgttagatactgttttttttcccatatgaatatactcctaggctgggcgcagtggctcacacctgtaatcccagcactttgggaggctgaggcagaaagatcacttgaggccaagagttcgagaccagcctggccaacgtggcgaaaccctgtctatactaaaaatacaaaaaattagctgagcatggaggtgaactcctgcaatcccagctactcgggaggctgagacacaagaattgcttgaacctgggaggtggaggttgcagtgaactgagatcgtgccactgcactcagcctgggtgacagagtgagactctgcctttaaaattaaaaaaaaaaaatttatatatatatatatatttatatatatatatatatttatatatatatatatatatatatatttatatatatatatatatatttatatatatatatatattcctaaggaaatgtatgacagtgataaattcaagatagtgtttacctctgagggagagtttctgttaggaaaggggtttaaacatatctttttgttcagctggatggaggggtcacagggctgtttttttaataagatactttgtatgtttgaactgtttaattttttttctttatttttgtaaggaggtttttttgtttccatttttgtatttttgagacagtgtttctgttgcccaggctggagtgcagtggcaatgatctcagctcactgtggtctctatctcctgggctcaagcaattctcatgcctcagcctccctagtagctgggactacaggcatgcactaccatgcccagctaatttttttttcttgtagagacagtgtttcaccatattgcccaggctggtcttgaactcctgggctcaagtgatctgcctgcctcagcctccctaagtgctgggattacaggtgtgagccactgtgctcagccgataatttttttcttttctttttcttttttttttggggggcactgtctctctgtcacctagggtggagtgcagtggtgcgatctcagctcactgcaacctttgtctcctgggttcaagggattctcctgcctcagcctcctgagtatctgggattacaggtgtccaccaccacgcctggcaaatttttgtactaatatttttttaaaggatcaaatggcacctagcatgtactcagtaagtatttgaataattggttggttctttgtctctgggttgaggtattattatttgtttcttcctctctaagtgtttataaagaaaaagtataaggcccggcacggtggctcacacctgtaatcccagcacttttggaggctgaggcgggtggatcacctgaggtcagaagtttgagaccagcctggccaacatcatggtgaaaccctgtctctattaaaaaaaaaaacaaaaacaaaattagccaggcatggtggtgcatgctctgtctcaaaataataaaaaaaaaaaagtatgaatctatatggcttttggtggctaaatttgacattaaagtctgagctcacccttgaacattgagacagagtctgtgctccatatatacaccccatctgccacaacactgctagaggcacgcgcctcagactccttttccctccgagtgactcagccattcccccgtctctgtataggtccctgtccttcgaatggtggaaggtgataccatctatgattactgctggtattctctgatgtcctcagcccagccagacacctcctagtaagtaatgtttgcctccctgctcgccgccccaccacccagtttcaagcagggcctcttgggagagtcaagggctgccaggggtctttggaggaggaaggcttggcatgcttatcagaggggctggtcagttggcttcctccccttcctttttttttttttagattgagtctccctctgtcacccaggctggagggcggtgatgcagtctcagctcactgcaacctccgcctcccaggttgaagtgattctcctgcctcagcctcctgagtagctgggattacaggtgtgcaccaccacacccagctaattgtgtatttttcatagagatggggtttcaccacgttggccaggctggtctcgaactgacctcaggtgatccacctgccttggcctcctgaagtgcttggattacaggcatgagccaccacacccagcctcatttttgtatttttagtagagacagggtttcaccatgttggccaggctggtctcgaactcctgacctcaagtgatccacctgccttggcctcccaaagtgctgggattacaggcatgagccactgtgcccggccattcctccccttcctttgacagcaccggggtttcagtgtccatgtctctctcagcgtggccagcagcagccgggagaacccgattcatatctgggacgcattcactggagagctccgggcttcctttcgcgcctacaaccacctggtagggaccgccatactcagccccagcactcgtactggcccggctctccttccttgagggcagctgaggctttgcaagacctgttttcagccctttccttcccccaggatgagctgacggcagcccattcgctctgcttctccccggatggctcccagctcttctgtggcttcaaccggactgtgcgtgttttttccacggcccggcctggccgagactgcgaggtccgagccacatttggtaagcatctgtgcctccaagggaggaggagagggaagggcactgccacctgcacaggggccttttgtgagccgggggccacctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggtaggggtcacaccctgagagcccaaagcagctgggcagcggggcaggagcagggatgtagtctgcagtgtaggggaatgggtggggatggggaaaaaatcccaagctgaaggagtgcctggagaccccgagggaggcagggacatccagggctttgggggtgactccaggtcctgttccttgtctccaggatgctgagctcctgtgctgggatctccggcagtctggttacccactgtggtccctgggtcgagaggtgaccaccaatcagcgcatctacttcgatctggacccgtgagtggctgtgactccttcctacacagggccctgataagcctaggaatgccagagcccagctgtagggtcccagtccctgggtgtgaggggttcctgccccaggggtgaggcctctgccagcaaatctctcctctctctcgcaggaccgggcagttcctagtgagtggcagcacgagcggggctgtctctgtgtgggacacggacgggcctggcaatgatgggaagccggagcccgtgttgagttttctgccccagaaggactgcaccaatggcgtgaggtcctcagttcaattccagagatgttggggcttgggttggggagggaggtgaatcccagagggagcaagtgtcctcactgaaggcactgatagaccctccccatctctccctcagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 2888 - DNA, 15154 bp, Homo sapiens; identical to SEQ ID NO: 2887
  source 1..15154: mol_type = genomic DNA

SEQ ID NO: 2889 - DNA, 19809 bp, Homo sapiens
  source 1..19809: mol_type = genomic DNA
ggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactggtaagaaagtgctttctccagcggcagacccgggctggcgagggagagacgtagacgacatagggctgtttctgaagggagcagaaagtggttcctgcataagaacacttaggaggacaagcagctggagaccgtgggccccaagggtaggagggtttaaacttggtaatctctgggtgggggtgggcagcattacctccacttcactgcagcccctttcccccaaatgttaggctttctgggacagttctgaagccaaatagcccggccagtggtcccaactgggctactcatacttgtgagaccttgggtcctaatttggggttctgatactatgaccttcacacccatctgtgaaagaaagtgtcccacggagattctccaggactactctcaccctccttggaaagggagccgtggggcggggcaggggggacagagcagggggctgggaccacacctctaacgggagggggggcgcggaatctgaccgatcaaaaagccccattctcaaagctccctacctgtgacagggacctgagtggaccctccccagagagctttgctccagccagacccttcaagtactctggtttctcaaccagcccaggaagagcagggggagaaggggccaggtcaggcagaggagagagagcagaggaagggaagatgatgctgcctgtgtgcccgctgcctgggcagaagaggagtgaggctttgacagtccctctcggagcacgtcccctgtgccaggaacatgggcatgtaactcttctcgtcccctgggcctttacggctacagccaccccatttcccttctcccaagctgccacaagcaagagctgatggaaatgaaaggagtcatttctttctttcttcttcttttttttttttttttaagatggagtttcgcttctttttgcccaggctggagtgcctggagtgcaatggcgcgatttcagctcactgcaaccttcatctctcgggttcaagtgattctcctgcctcagcctcccgagtagttgggattacaggcgtgcaccgccatgcccggctaattttgtattgttttagtagagatgaggtttcaccatgttggccaggctgatctctaactcctgacctcaggtgatccacccgcctcggcctcccaaagtgctgggattacaggcatgagccaccacacccagccaaaagggggcacttcttggcaaaaaggacggttagagaaaaatgccctgcccaggaagtgggaggctcagaacccttccttcactgtggtctccaggaagaacctcggagtctctgtgagttagcgcaggtgaacctgaaggcaggggagacttgggaagctctcgctttggagattttggaagttggcatggccctggcaggaagcgtgagcctagcagggctgcgttcctaacactgtggaccaaacaggggcaccagaaaacaagaaaaaagattcaagagaatttggcacttctctcaaattatttaaattgaaataatttaattatttacattatttaaaatgaaatgtttcattttaaaaacagccttatagaggtataattgacctacaataaacctcacattttaaagggtagcaattgataagttttggcctaagttatatacatccatgaaacaccatccccgtaattgagataatgaagcttcctgtcaccccaaaagctccccatgcccctttgtaattcctccctcctgctccttcccatgccctgccccagcaatgtaagagctctgtagatcatccttattcttattagatgctgcctcactgttctgacttttggacccacacagggagtgtggggcaggtggtgtcatcatcatcacatgttcagtgcttaaggcctctggagatctagccctgggtatgaaatacagctccatgttttataatatgaaaataagtctatttttctatccccacaccttgaccctgtagtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggtgaggaggcggcagggaggatggggtctgagagtcaaggtgagtgttcagtcctccctgcaggtgagatggggtctgagagttgggggacgagggtctagtcctccctgcaggtgagatggggtctgggagtcaaggcaagtgttcagtcctctctgcaggagagatggggtctgagagtcaaggcgagtgttcagtcctctctgcaggtgagatggggtctgagagtcaaggcaagtgttcagtcctctctgcaggtgagatggggtctgggagtcaaggcgagtgttcagtcctctctgcaggacagatggggtctgagagtcaaggcgagtgttcagtcctctctgcaggtgagatggggtctgggagtcaaggcgagtgttcagtcctccctgcaggtgagatggggtctgggaggggcaagtgttccatcttccctgcaggagagatggggtctgggagtcacagagtgggtccagtcctccctgcaggagagatggggtctgagagttgggggacgagggtctagtcctccctgcaggtgagatggggtctgggagtcaaggagagtgttcagtcctccctgcaggtgagatggggtctgggaggggcaagtgttccatcttccctgcaggagagatgggatctgggagtcacagagtgggtccagtcctccctgcaggagagatggggtctgagagttgggggacgagggtccagtcctccctgcaggtgagatggggtctgggaggggcaagtgttccatcctccctgcaagaaagaaggggtctgggagtcagggaatggctccagtcctccctgcaggagagatggggtccgggagttggggtgagggctggggacttaaggcaagggtccagtcccccaggcagagactcacttgagggccatgggaagtcatttagcccctccacacaaagcccatggaaaggaaatgttaatcctgcctttttcatgctaatctgagtctacctccagttttcctatttccaatcctttccctacaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggtaagagccccatgtgatttctcctttacagccaaatagaccaacctgagaaaaggagaggaaggggaaacgggaggccagtaatagagatttccacctgaccactcttttcaccccattaggcttggagagcagtggagaactagcccaccgcataacacaggttctcctgtcccccagatactgatcagaagggttttccatggtccatgagtccatcagagctcagatcccccgaaggcagtcccgcactctggcccttctcatctgctttctcgtattggccctaattccctagggagatgggcacaagtccttgatctgcctacagtcaaagaggccagtgatcggccaggcgcagtggcacacgcctgtaatcccagcactttgggaggccaaggcgggtggatcacgaggtcaggagttcgagaccagcctgaccaacatggtgaaaccccgtctctactaaaagtacaaaaattagctgggcgtggtggcacacgcctgtggtcccagccacttgggaggctgaggcaggagaattgcttgaacccgggaggcggaggttgcagtgagccaagatcaagccactgcactccagcctgggcaacacaatgagactctgtctcaaaaaaaaaaaaaaaaaaaaagggccagtgatcatgcccttcctgctgcctcccacaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggtaagcacacaaactggggtggaagagagacgttccaagggccagagcctttcctggatgggatgcaaggaagggaagctctcaacaggacggatgacaagtgtatttgctgtatagatctcaattcatctggctattctaattctaaaccatgcctcagagtggccttcctgtgtgtctgctgtggccttcaaatgactggtccagggagactaggaggccggggctagagcctagctaccacaaagttgagtaaagaggccatggagaaggctgggcggggtggctaatgcctgtaatcccagcactttgggaggctgaggcgggcagatcacctgaggttgggagttcgagaccaccttgaccaacatggagaaaccccgtctctactaaaaatacaaaattagccgggcgtggtggcggacgcctgtagtcccagctacttgggagactgaggcaggagaatcacttgaacccggtaggcggaggttgcagtgagtcgagatcgtgccattgcactccagcctgggcaacaagagcaaaactctgtctcaaaaaaaaaagggggggaccatggggagtcctaggaaacaggaggctttctttgagcacctctagcacagtcctagcctggcagagatccattgcatccttttacagatgagaaacctacacacagaataaagcagggacttgctagaggcaaaaataagactggactcccgcacttcctggcactgaatctagggctttttccattatcaacaatggccagaagggagttagcaatggctcctggcctgggggcctatgtattggctccctggtaccattttatgttcacttgaatcactcacctctttatgagggtgtatttactgtcacacaaccatcagtgtgacagatcctttggtgtctttgctagttgttttggtaacatggtaacatgggagagagcctaaaactccccagacagtaaccttctcctgataaacaatccacccaagggcaaaactggccaatggaaacctggaaattgtgagagtcatgtatatttccttcatcccagcatggctggacgtcaacagaatcaaacacagtcttcaacacaacttcagtgcaacacaacacaacacaacacaacacagcttcaacactgtcaacaaaaatgtgttcaaccaacacctggtctgatcacagagtctgaaaactggtgcaatgaaagagcacagtcagaatggagggggttggcatccgtggctacagctccattcatctccttagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggtccggggggcagttcgtgctcatgagcacaggccatgtatgcagttgtgggagagctgggctagccgttgacaaggacaatcatttgtggtgttgtttctctgcttattcaggggaaagaatttcagctcctgaaagggaaatctactgtcattattgcaaccaaatgattccagaaaataagtatttccaccatatggtgagtagcacttagtaattttctaatggtgccaatagttcatccacattctgaaaagtgtgataggaaaggcagattctgggcccaattttacatagcatggatattaaagggtcccatatttattttttgctttgttccaaaagatagtttagtgacttgcttaggctaatcaagcacacaaaaattggtcttcatttgtgcccagcccttcaaaggggcttcccttgccactcccaacacccccgatcacctctgaccatctccaaacttcatggcctggacattgcaatttggtcctcagtagggcctgtcttactgttttcggtcccatgtgggagtcttctctattagactgtgagcttcctgcaaaactgcatgactttttccattttcctgacatcagagcttggtgcaaaaagaggactctgtagaggcgcagttacgtgattgactgactgactgattttgcctgggaacactcacaggttcttccctccatagcccctaagcgccgtttagtgcattgctgtgccaagttgctcccttcttttgcacagaatggagcatttcccctttgggaaacttaccaaggcttctctccaaagaactcttctccttctccttgggcagaaagttgtttacctttcttaacacttcagtgcttaaaactacagaatatcaaaactaaagaaaccatagagacgatccagcttttcgctcttttctttttctttttactattgtggtaaaccacgtataatgtaaaatttgccatcactatagagacatttggtacattcacaatgttgtgcaatctggttctagaatattttcatcattccaaaaagaaatcctatacccattagcaggtactgtacattccctcatcttcccagttcctggcaaccactaatctgctttctatctctatggatttgtctattctggacacttcacatcagtagactcatataatatgtggtcttatgtaaccatcttctttcacttaccgtaacattttcaaggtttgcccgtgttgtagttgtggcatgtgtcagcatttcattccttttaatggccttttcttttcttttatttttttgagacagggtctcactctgttgcccaggctggagtgcagtggcgtgatctcggctcactgcaacctctgcctcccgggttcaagcgattctcctgcctcagcctccggagtagctggggctacaggtgcctgccaccacgcccggctaatttttgtatttttttttagtagagacggggttttaccatgttggccaggccagtctcaaactcctgaccgcaggttatccgccttcctcggcctcccaaagttaatggcctttttacggtcatcccacattttgtttctctacttgttggtaaacattcggattgtttccacctttcagctctttgctttttgaagtgcagtctgtggaccagctgcatgagcatcacctggaatcctgttagaaatgcagaatctcaggccctccccctagaaatgctaaatcagaatatgcagggtcacatgatttcccaggcatttcaagtctgagatgcgctgccccagccacgggattctcagccttggctgtacgtggaaatcacctactgacttgttttccttagtactgatgtttattcgatcctataagtggtccatgtgttctgtttgaatgagaaaatacttggtgagcaccaaaacaagagtaaagctgactacttcccttcaaatgtccagcctggcaaccagggcacctacacacttatttgaaggctacagggaagtggggagctccaatacacatggaactggatttgtgctcagaaactctgaattttagttctgctgtgccccttactggctgtgtaacctctctgagcttctttcttcttttgaggaaaatggggataatggtttatctccttgttcaggaaaagaagacatccacaaccagccaacaccagatctatctccttggcagcatccacactcacttactttgccttcccacctcttaaccatagaggagcttcctatgtgcctctctaaagcctatcccctcctactggtataatataccctctctttttgcctacacaaggtcacacaagttttttgctacactgctccagcaattctcccctctctgtcctgcaacagagagaggttaaatgagctgtacacgcaggtaacaacaaagtctcacatctctaggttgtcctaacatttcttacaataactttttaaaggggtaccactattgaatatttatatatcaatggccttgcacgaaaagaatttttttttaattttgaaaattaaggattgaaatcatgtatactaggtggttttgtggttttcagtctttaactttttattaatatgacccaaagccagaaaaacatgaaatacttctgatcccatttcctataagctaccatcttgtttctttgttcccctccgtagaaaaacatttgagctagttgtctataagtaactgcctccatcttttcttctctcattcttattcccactccagtctggctctccattttaaccaaatctgctcttgtcaaaatcaatgacctctgcattgctaaatccaatgctcagttctcagttctcaatttatgggaagcatttactgctcatcactccctcttcctcagtggactttctcggcttccagggtaccacactttcctggttttcaaggacattggtggtctctcattctctacctccccagcctcttaattttggggggccccagggcttagtctctggtctcttctctacctatattcactgccttcattatttcatcctacctcctgatttttaaaaatgccatatgtaaggccgggtatggtggctcatgcctgtaatcccagcactttgggaggccgaggtgggaggatcacaaggtcaggagatcgagaccaacctggctaacacagtgaactctcgtctctactaaaaatacaaaaacttagccgggtgtggtggtgggtgactatagtcccagctactcgggaggctgaggcaggagaatggcgtgaacccaggaggcggagcttgcagtgagccgagatcacgccactacactgcagcctgggcgacagagcgagactccatctcaaaaaatagataaataaataaaaatttaaaaattttttaaaaagccatatgtagtcagacacttccaaatttatatctcagtctgggtttttctccccaaactctagatttgtatattactatttactgcatcttcacttgaatgcttgatagacatcttaaatgtaacacatctgaaatggaatcctctctgccacagcttggcccatctcagttgatggcaactctatctttccagttgttcaggccaaaatctcaggttcactctcgacttctctttccctccgcattgctaccctggtatgaaccatcatcttctctagcccagatgctgcagcagtctcctaaacggtcttcctacttctcaccttgccccctacagtctattctcatcacagaggtcaacgtgatcccttaaaaatacaagtcagattgtttggctcctctgttcagatctctgtactgattcttgccccattttatgcaaactcaaaactacagtggctttagagatctatgtcatctttgcctcccttcttatctcatcacctctttgatctcatgtactactcctgttcagctcactggcctcctgattgtttcttgagcataccatgccttagggccttttcactggctactgcctctggctggaagctacctcctcaccttccccaccctactccaggagctaactctctcacttctctcaagtctttgcccagatggcaccttctcaaggagatgtaccacaacaacctatttaaaattgcaactccctctccatcacatatttaccaaccccttaccttcttctattattttttccatagcatttgccaacttctaacatattatctaatttacttacttattatggcccttgttaattgtctcccacgacctcagaaaaactataagccccactggtccccttcatgctaactactccccagacacaaatactctacttttgcttttagctgtttcttctggtaatcaccttcatatgtctaaagcaccttcttatattttttccagttttagatattacttattgactcataaggatttaggaatatagatttcacttttttataccacccatcccacacacacacctccaaagttcttcatttcatccttccaatgtattgatttcactcattctggttaaataaatattcagtattacattagtataaccatgtaaacattataaatggttttccacatgaattgtgattatgtgttctttctcctacaactttttgttttacctggacttaataattgcttcggtttttcatttgcttcactttctaggtacctatcactaaatcatccctaaaattctctaccagatctgaaaattcccctgagtacaactacacacatcagatagtctgtccatttcattttgggagcatgttatgccccaggcttgatgattagctgttggtctggaatttcttccactctctccacggttggagttctgattcccaaatctcaggtctcatctttctctttcttaggttactccttgtttgatagaacatatccccaaatagtttcttgagaaagaaagcatgagaggcaaattttttaggccttatatgtctgaaaatgaaagcttgggtggctatagaatctattgaccatcttaatctgtttattaaaaatcttattacaattctgatttggccactacacactgtatacatgtattagaaaatcattctgtattctataagtatgtatcattattacttgtccactaaaaataaaagaaataaaattgattacaaaaactttcaaataaatatgacagtagaaagttaatacaataaacattcatgtatttactccccagatacaacagttgttgttctaaacaaggtgaataaaaataaatctactcttagatacattacaggtaaaaggcaaaggttgatttctttgaaatcagccgaagaagattacaagcaaaggaatggcagttaggctgaaagcaaatatatcgacagcaataatagaagtgggtatgcagtggaataatcttcaaagtgctaagagaaaatagctgttaacacgtggaaatcaaaagttttccaggcttgaactatactttgtttgttttcttttttctaaagtatgttaaagcaaatccaagatatcctgttatttcaccatcattctttaatatctcaaaaatacagtcattttcttaatcacaatgcctttatcactctcaatgatgttaacaataattttcccccatcgttttggggccttgcatttaccactcttgttcattactactgctgctgctgctgctgctgctgctgcttgcttctcccttgtattctattggattgagcaagatttctttattctctttcttctttcctactgattcgtcaattttacatttatttctatcatttcaatagttacccttaacattttaatataaatacttgacttaataaagtctaaagttagtcattatctctactttccttacaaatagtatatagatttgagaacatgttaacactgtaactatcttacatgaaaatgctgccagaattttgtttcattttgctttcatactacccctctttactgattattgttgttatttatgtaactcatgcctgtttagatatactcacatgtttttgtttttgctttttttctttctttctttctttttttttttgagacaaaagtctcactctgttgcctgggcttgagtgcagtggcacgatcttggctcactgcagccttcgcctcctgggttcaagcagttctcctgcctcagcctctcaagtagctggtactacaggtgtgtgccaccacgtctggctaatttttgtatttttagtagagatgggcttttccatgttggccaagctggtcttgaactcctgacctcacataatctgcccacctcggcctcccaaagtgctaggattacaggcatgagctactgtgcccggctggatatactcacaagtttacccttctctttactcacattcttccttggatcctaagctttccttctgggtatgatttctctcttcctgaaatacatctcagtagcttcttcaccaagaaccttgagtagtaaatctttagttgcctgaaaataagctttttgttttttgcatccatgaatgatagtttagctggatatcaaaatctagattaacagctattttctcttatcattttgaagattattccactgccatcccacttctgttattgctgttgatgtattttcttccagcctaattgccattcctttgtacgtaatctttatatttggttgatttcaagatcctctttgccttttacctgtaacgtgtttaagagtagttttatttttattcattctgttcagaacaatgtactcaaatgtgtttgcttttctcctgctcaggatttctctttccttaatataaagatttatgtcactaatcaggcctgaaaattctcatctattatctctttgaattcccaacattccccaactctcccacattctctcaactctccttctggaacataacacatgtatattaagcattctcattctagcttcatgactctcttttttttcatgactctccttttttttcatttctctcttttaatcgccttatgtctcttaacctttcatattttctctatttctatctcttatattctgggtaatttcctgaaattatctccaagttcattcattctttcttggccaaatctaattttctgtttttagcccatccatttaggttcaatacctgcatttttcatgtctagaagttcaatttatctttctttcaaatttgcctatttttgttctcactacaaaaaaaagataggtatgtgaagtgattgatatgttaattaacttgatttaatcatcccacaatgtatatatatattaaaatatcacattgtaccccataaatatataaagttattatttgttaattacaaattagaaaatttcaaatttacctgttctgtttttcatgagatgttattcttttcccagatttaatcatttttaattaatttattttacagtctctatcctatagttgcattacctgaacttcttggaggctaatctgactacttttgtgtctgtgactcttactcaaggtggattgcttccttgtgtgtttgtaattttggattgtgagtttctatctggtgggactctacctatgaggatcctctatgacctattttgaggctgttgtccctccagaggaattttgtgattgcttctgccagacatctcaatgtttatgttaattcttctgctcagggattcccagaccatgaggccaaagtaaatcctaatcccacacacaggaatggcatggacctgtgattttgagttttcaggggcataagttttcatctccacactcaaataccgacccaagaaagaaaagcttccttgccactttccttttctcattagctgatacttttcctcttacccaccataatttatcctttaaagtttccagctttatgcaggatcaatagagtcttacttccaaatccccacctgtgtggatgggactttcctgtcatccaagcccctagttacaaagttgaccctacatctcccataagcagtgtcaactcctgtgcttaaccagtccatttgtgctgctataacaggatgccacagacagagtaataataaagaacacaaatttatttcgaacagttctgaagactgggaagttcaagatcaaggcaccaccatttggtgtctggtgagggccttcttgctgcctcctagcatggtagaaagcaaaagagtagaaggctgtagccaaatacttcatgaatcctcttttataaggaccctaatctcattaaaaagggaggacctttcatgatctaatcacccccgaaggccccacctcttaataccatcacattggcagcacctgaattttggaggagacacattcaaaccatagcaaccagtcagaccttcattcctggaatgcaaaattttctttctttcctgcaaagccagctattaaattgaatgtctgtcacattttatacaccatataaaagtgtttacagtgggaatttcttgtgttatctagtctactgtattttctgaccattaaagctgaagtcattttaaaatttgatatattattcacaattgcagggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggtactcagcctctgttctctgcttacctttctgggaaccatccgcacagtgtcttaaaaaaatccaagacctgaaagatgttcacaaatgttgtggctgaaaaggccgttttctctgactcccacttctctgggtgcccaaatgcactatctcgtagcacttaccacctggtttatttgcatcacctccgagagactgagtcacctttgactcaagccaggtctttgaaggtagagccaggtccctcttctctgtgtctccagcttctaggccagggattgatttggagcaactgcttcaaaactgttgagtaaatgaatgaatcagaggatacccagtctatctctctcatggtgtagatatggcactgaggcccagagatgagatgtcttggtcaagatcctaagccagttggtggtggcttacctccagcagatcaaggtttgcttcaagaagatcagggtttgtaggcatctccctgaatatcatgatttttatgtcctaggttattttctagtaataataataactggcattagaggttgttaaccattgtgtgccagttacaatacagagctctttataatcttcatcataaacaataggcatgcattttatctccattttacagataaggtgaagtagctttccaaggagtatacaattagaaggtggcaggatccagcctgagtccacatgtatatagctccaaagtttatgctcttaagctccagattaaatgccttacttaaaaaatttattttttttcaaaatacataagtactagattttgttggagctagttgatataatatcatataaagaagtataaaagcaaagctaaccctaattccccaaccccataccctgagataccactttggacagtcttatgggcatcttttcaaagctctacctttgcatatacaagcctaaacaagcatatactgggttttacttgtttctttttccacacatattatcttactatactttttactctgccacatgcctttttcacttagtatatgatgcatgcttcttacaaaagacttagtatgccaaaacctttttttctaacttccttgtgcatctatgtatgcacataagcatataattttacaaaaatgggttcatttcatatttgctgggggtgttactagtgccatttttccttgcctcccacaatttggtatatttcctttcacagttttctccatccttatataacagagtcgccagatttagcaaataaaaatacaggacattcagtcaaatttgaatttcagagaaacaaagaattgtttttagtgtaggtatattccatgcaatgattgttttgctaaaattaaaatttaaccaggacaccctgtattttatttagcaatttcttatataaccaccatacaaacatacacatttggagtcctgttatatacattttttcacttttttttttttgaaccagtaaagctgccatctttttttttttttttttttttttgagacagagtctcgctctgtcacccaggctggaatgcagtggtgggatctcggctcactgcgatctctgcctcccgggttcaagcgattctcctgcctcagcctcctgagtagctgggagtacaggcacccgccaccacacccagctaatttttgcattttagtacagatggggtttcaccatgttgtccatgctggtcttgaaatcctgacctcaggtgatccacccgcttcagactcccaaagtgctggaattatagggcatgagccaccacgcccagcaacatttctttacatcctaatgtaaattcagcaatacccaaggaaatccctacaaacaaaacagtgtggcttatttttattaatggctgcctaagattccatggtgtgagtgttctcccatctgtccctccacccagtgatagcaacaggcccctgttaaactttgtcgcaagcctcctatacttctggctcagtgggctcctgaccttttctatgccattacactccagtctttgggcagggctcatgctctgtaacaagggacagcaatatccagagatattctaggagctagcacttcttactttaaccatatcaaactttttttatatccatttcttaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctctaa

SEQ ID NO: 2890 - DNA, 19809 bp, Homo sapiens; identical to SEQ ID NO: 2889
  source 1..19809: mol_type = genomic DNA

SEQ ID NO: 2891 - DNA, 19809 bp, Homo sapiens; identical to SEQ ID NO: 2889
  source 1..19809: mol_type = genomic DNA

SEQ ID NO: 2892 - DNA, 19809 bp, Homo sapiens; identical to SEQ ID NO: 2889
  source 1..19809: mol_type = genomic DNA

SEQ ID NO: 2893 - DNA, 19809 bp, Homo sapiens; identical to SEQ ID NO: 2889
  source 1..19809: mol_type = genomic DNA

SEQ ID NO: 2894-2999 - skipped (106 entries)

SEQ ID NO: 3000 - DNA, 40 bp, Homo sapiens
  misc_difference 20: note = T->C
  source 1..40: mol_type = genomic DNA
aataggcgtgatgttgctattgattacaactttgttattc

SEQ ID NO: 3001 - DNA, 40 bp, Homo sapiens
  misc_difference 20: note = C->T
  source 1..40: mol_type = genomic DNA
gagctcgtccagaatccatcagcctcacacacatatttac

SEQ ID NO: 3002 - DNA, 40 bp, Homo sapiens
  misc_difference 20: note = C->A
  source 1..40: mol_type = genomic DNA
actcggccactgggtagatcatcaggagggccacagtcaa

SEQ ID NO: 3003 - DNA, 40 bp, Homo sapiens
  misc_difference 20: note = T->A
  source 1..40: mol_type = genomic DNA
gcacgcgggcattggccggtcccaagatccatctttctga

SEQ ID NO: 3004 - DNA, 40 bp, Homo sapiens
  misc_difference 20: note = G->A
  source 1..40: mol_type = genomic DNA
ggcctcgaaccccgtgaacggcttctcgttggagtagtcg

SEQ ID NO: 3005 - DNA, 40 bp, Homo sapiens
  misc_difference 20: note = T->C
  source 1..40: mol_type = genomic DNA
cggcttctcgttggagtagtcggagcggaaggtaatgtcc

SEQ ID NO: 3006 - DNA, 40 bp, Homo sapiens
  misc_difference 20: note = G->A
  source 1..40: mol_type = genomic DNA
tcgttggagtagtcggagcggaaggtaatgtccaggctgg

SEQ ID NO: 3007 - DNA, 40 bp, Homo sapiens
  misc_difference 20: note = C->T
  source 1..40: mol_type = genomic DNA
agtcaagaaaaataagagacacatggctgaggtgaatgca

SEQ ID NO: 3008 - DNA, 40 bp, Homo sapiens
  misc_difference 20: note = G->A
  source 1..40: mol_type = genomic DNA
tggtggcaggagctgcaccgccacatagaggaaggactgg

SEQ ID NO: 3009 - DNA, 40 bp, Homo sapiens
  misc_difference 20: note = G->A
  source 1..40: mol_type = genomic DNA
ggtcgaaacatgtctgaccgctgctccacggccatcacca

SEQ ID NO: 3010 - DNA, 40 bp, Homo sapiens
  misc_difference 20: note = C->A
  source 1..40: mol_type = genomic DNA
cgggcagctacacccgcagcagttacctgccagctgagca

SEQ ID NO: 3011 - DNA, 40 bp, Homo sapiens
  misc_difference 20: note = C->T
  source 1..40: mol_type = genomic DNA
aaatttggaggtggcaaaactggcaagtgtttagtaatag

SEQ ID NO: 3012 - DNA, 40 bp, Homo sapiens
  misc_difference 20: note = G->A
  source 1..40: mol_type = genomic DNA
gtataatcctgttgttatcgattttgaggtaagtcttttc

SEQ ID NO: 3013 - DNA, 40 bp, Homo sapiens
  misc_difference 20: note = G->T
  source 1..40: mol_type = genomic DNA
aagcgccagaacctgcgccgcgccttggaccagtatctga

SEQ ID NO: 3014 - DNA, 40 bp, Homo sapiens
  misc_difference 20: note = G->A
  source 1..40: mol_type = genomic DNA
tggtctgtatgcagagcaggcatccaggaaaggagaagag

SEQ ID NO: 3015 - DNA, 40 bp, Homo sapiens
  misc_difference 20: note = C->A
  source 1..40: mol_type = genomic DNA
gcaccaccaattttaaaatcatttttggcacaggcatgga

SEQ ID NO: 3016 - DNA, 40 bp, Homo sapiens
  misc_difference 20: note = C->T
  source 1..40: mol_type = genomic DNA
ctgttggtaacacagtcttcgacttccttgtcagagaagt

SEQ ID NO: 3017 - DNA, 40 bp, Homo sapiens
  misc_difference 20: note = G->T
  source 1..40: mol_type = genomic DNA
ggagaagtaactctacaatgacaagaaaaatataattagt

SEQ ID NO: 3018 - DNA, 40 bp, Homo sapiens
  misc_difference 20: note = A->G
  source 1..40: mol_type = genomic DNA
gatgttcccttccccaaccagtatcagtatattgctgcag

SEQ ID NO: 3019 - DNA, 40 bp, Homo sapiens
  misc_difference 20: note = C->T
  source 1..40: mol_type = genomic DNA
agtttctacaaccaaaattccacctataacaaatattttt

SEQ ID NO: 3020 - DNA, 40 bp, Homo sapiens
  misc_difference 20: note = G->A
  source 1..40: mol_type = genomic DNA
gattattcaatgcaggtacgaaaagaatatggcaagtgct

SEQ ID NO: 3021 - DNA, 40 bp, Homo sapiens
  misc_difference 20: note = G->T
  source 1..40: mol_type = genomic DNA
agctactcgctgcacaagggtgactataatgacagcgtgc

SEQ ID NO: 3022 - DNA, 40 bp, Homo sapiens
  misc_difference 20: note = T->C
  source 1..40: mol_type = genomic DNA
tccttgacatagtgtagcatattgccatgaacagcatagg

SEQ ID NO: 3023 - DNA, 40 bp, Homo sapiens
  misc_difference 20: note = T->A
  source 1..40: mol_type = genomic DNA
ccacagagtcaggcagtagtttttcacctggccccaggca

SEQ ID NO: 3024 - DNA, 40 bp, Homo sapiens
  misc_difference 20: note = G->T
  source 1..40: mol_type = genomic DNA
cttgtaaatctccacctgagatttctcatggtgttgtagc

SEQ ID NO: 3025 - DNA, 40 bp, Homo sapiens
  misc_difference 20: note = C->T
  source 1..40: mol_type = genomic DNA
agtcgagtaccaatgccagccctactatgaacttcagggt

SEQ ID NO: 3026 - DNA, 40 bp, Homo sapiens
  misc_difference 20: note = G->T
  source 1..40: mol_type = genomic DNA
atataagccattttcccaggttcctacaggggaagttttc

SEQ ID NO: 3027 - DNA, 40 bp, Homo sapiens
  misc_difference 20: note = G->A
  source 1..40: mol_type = genomic DNA
gaaccaccaaaatgcttacgtaagtactttaatattcacg

SEQ ID NO: 3028 - DNA, 40 bp, Homo sapiens
  misc_difference 20: note = A->T
  source 1..40: mol_type = genomic DNA
atattataagagtttgcgtagactatactttccagcagct

SEQ ID NO: 3029 - DNA, 40 bp, Homo sapiens
  misc_difference 20: note = G->T
  source 1..40: mol_type = genomic DNA
tcaaaatccttttggactcgcataacgtgcgcagaagaag

SEQ ID NO: 3030 - DNA, 40 bp, Homo sapiens
  misc_difference 20: note = G->A
  source 1..40: mol_type = genomic DNA
aacatttcatgtgtagaacggggctggtccactcctccca

SEQ ID NO: 3031 - DNA, 40 bp, Homo sapiens
  misc_difference 20: note = G->A
  source 1..40: mol_type = genomic DNA
gggtcaacagtgacgtaccgttgccagtccttctataaac

SEQ ID NO: 3032 - DNA, 40 bp, Homo sapiens
  misc_difference 20: note = G->T
  source 1..40: mol_type = genomic DNA
ctcctgtgacagctttgacgaggaagtcaatgtccttatt

SEQ ID NO: 3033 - DNA, 40 bp, Homo sapiens
  misc_difference 20: note = C->T
  source 1..40: mol_type = genomic DNA
ctgagtgaaatccaggagacgttcattgtagcagtgtaac

SEQ ID NO: 3034 - DNA, 40 bp, Homo sapiens
  misc_difference 20: note = C->T
  source 1..40: mol_type = genomic DNA
caggtggatgttttcaaggcgactagagcacagaaggctt

SEQ ID NO: 3035 - DNA, 40 bp, Homo sapiens
  misc_difference 20: note = C->T
  source 1..40: mol_type = genomic DNA
aagacagagttgatcatttcgttcacaggtatagatgcac

SEQ ID NO: 3036 - DNA, 40 bp, Homo sapiens
  misc_difference 20: note = T->C
  source 1..40: mol_type = genomic DNA
cttcttgagctccttttcctttttattcttggcaggctct

SEQ ID NO: 3037 - DNA, 40 bp, Homo sapiens
  misc_difference 20: note = T->C
  source 1..40: mol_type = genomic DNA
ctgtgaccagggtggtaaatagctgtgttgattccatgag

SEQ ID NO: 3038 - DNA, 40 bp, Homo sapiens
  misc_difference 20: note = A->G
  source 1..40: mol_type = genomic DNA
acttaggcttctcctggcaatctctctcagtttgaagaca

SEQ ID NO: 3039 - DNA, 40 bp, Homo sapiens
  misc_difference 20: note = A->G
  source 1..40: mol_type = genomic DNA
gaaccaatgcagacactcaatgatgtgttagctcagctag

SEQ ID NO: 3040 - DNA, 40 bp, Homo sapiens
  misc_difference 20: note = C->T
  source 1..40: mol_type = genomic DNA
acgttggcacggagctcaccgtggagtttggcagcccgag

SEQ ID NO: 3041 - DNA, 40 bp, Homo sapiens
  misc_difference 20: note = G->A
  source 1..40: mol_type = genomic DNA
tgcagttgaggttggggccgacccaccacccgaacgagcc

SEQ ID NO: 3042 - DNA, 40 bp, Homo sapiens
  misc_difference 20: note = G->T
  source 1..40: mol_type = genomic DNA
ggaaagccaagtcgtcagggtcaccaacctctagcatatg

SEQ ID NO: 3043 - DNA, 40 bp, Homo sapiens
  misc_difference 20: note = G->A
  source 1..40: mol_type = genomic DNA
ccgaggtagcgttcagggggggcccctgggggccgatgct

SEQ ID NO: 3044 - DNA, 40 bp, Homo sapiens
  misc_difference 20: note = C->T
  source 1..40: mol_type = genomic DNA
tggtggcaaaagtgtaaagcggaagtcaccaagttcactg

SEQ ID NO: 3045 - DNA, 40 bp, Homo sapiens
  misc_difference 20: note = C->T
  source 1..40: mol_type = genomic DNA
aaaagtgtaaagcggaagtcaccaagttcactggtgtgcc

SEQ ID NO: 3046 - DNA, 40 bp, Homo sapiens
  misc_difference 20: note = G->C
  source 1..40: mol_type = genomic DNA
ggggagctctacaaaatgtgctgcttgtcagaatccgaga

SEQ ID NO: 3047 - DNA, 40 bp, Homo sapiens
  misc_difference 20: note = C->T
  source 1..40: mol_type = genomic DNA
aaacctattgcagaagctccttcagctttcacactgggct

SEQ ID NO: 3048 - DNA, 40 bp, Homo sapiens
  misc_difference 20: note = C->T
  source 1..40: mol_type = genomic DNA
ctctttgcttcctttccaacggaagaatcttcaatcaact

SEQ ID NO: 3049 - DNA, 40 bp, Homo sapiens
  misc_difference 20: note = A->G
  source 1..40: mol_type = genomic DNA
aaatgaactaaaatgaaataagaaataaacttacgaccat

SEQ ID NO: 3050 - DNA, 40 bp, Homo sapiens
  misc_difference 20: note = C->G
  source 1..40: mol_type = genomic DNA
ccccacggtcaacctgcagcctctggaatgggcctatggc

SEQ ID NO: 3051 - DNA, 40 bp, Homo sapiens
  misc_difference 20: note = C->G
  source 1..40: mol_type = genomic DNA
gcgagtcaccctccaccagcagtgagggacaggccggcct

SEQ ID NO: 3052 - DNA, 40 bp, Homo sapiens
  misc_difference 20: note = G->C
  source 1..40: mol_type = genomic DNA
gaagtggagctttctcttggaagagcacagtaaactaagt

SEQ ID NO: 3053 - DNA, 40 bp, Homo sapiens
  misc_difference 20: note = A->C
  source 1..40: mol_type = genomic DNA
cagtgaatgtatggaccctaaaaggtatatttgggaagct

SEQ ID NO: 3054 - DNA, 40 bp, Homo sapiens
  misc_difference 20: note = C->T
  source 1..40: mol_type = genomic DNA
tgtcactctggagcaagcccgcagagatgtggagcaactg

SEQ ID NO: 3055 - DNA, 40 bp, Homo sapiens
  misc_difference 20: note = G->A
  source 1..40: mol_type = genomic DNA
gtgtccaaaccaccctgtggcatctgctgacctcctgggc

SEQ ID NO: 3056 - DNA, 40 bp, Homo sapiens
  misc_difference 20: note = A->G
  source 1..40: mol_type = genomic DNA
ttcctagccaaggtgtttaattcttcacattccttcttag

SEQ ID NO: 3057 - DNA, 40 bp, Homo sapiens
  misc_difference 20: note = A->C
  source 1..40: mol_type = genomic DNA
acccaaactgtatgtcttgatgacactacagtaaagtttg

SEQ ID NO: 3058 - DNA, 40 bp, Homo sapiens
  misc_difference 20: note = T->C
  source 1..40: mol_type = genomic DNA
gagagcatcctggagcgggtgcagcagcacatcgagagca

SEQ ID NO: 3059 - DNA, 40 bp, Homo sapiens
  misc_difference 20: note = A->G
  source 1..40: mol_type = genomic DNA
agcaagctcctgggctccaattcctccaggatgtacttca

SEQ ID NO: 3060 - DNA, 40 bp, Homo sapiens
  misc_difference 20: note = C->T
  source 1..40: mol_type = genomic DNA
ctggaagtggactgtggaacacattgtctataaagccttg

SEQ ID NO: 3061 - DNA, 40 bp, Homo sapiens
  misc_difference 20: note = C->T
  source 1..40: mol_type = genomic DNA
taacacagattctcctctgcgctatgtggacattgccatc

SEQ ID NO: 3062 - DNA, 40 bp, Homo sapiens
  misc_difference 20: note = G->C
  source 1..40: mol_type = genomic DNA
tccagccgcccagtcaggagcttggagccattcagggtga

SEQ ID NO: 3063 - DNA, 40 bp, Homo sapiens
  misc_difference 20: note = C->T
  source 1..40: mol_type = genomic DNA
gcgtcaccccccgtccactcgtccgcctcgggcagctcgc

SEQ ID NO: 3064 - DNA, 40 bp, Homo sapiens
  misc_difference 20: note = G->A
  source 1..40: mol_type = genomic DNA
cacgcaccacccacagtatgggtccctgtgagcaaggcaa

SEQ ID NO: 3065 - DNA, 40 bp, Homo sapiens
  misc_difference 20: note = C->T
  source 1..40: mol_type = genomic DNA
gcatggacgaacatggcaccctcctggcccgcacctgcag

SEQ ID NO: 3066 - DNA, 40 bp, Homo sapiens
  misc_difference 20: note = C->T
  source 1..40: mol_type = genomic DNA
ggatcttccttagctaatacgggcttgtttataaagtctc

SEQ ID NO: 3067 - DNA, 40 bp, Homo sapiens
  misc_difference 20: note = C->T
  source 1..40: mol_type = genomic DNA
agaccaatcagcagcagagcggagcaactacaaggcagca

SEQ ID NO: 3068 - DNA, 40 bp, Homo sapiens
  misc_difference 20: note = C->G
  source 1..40: mol_type = genomic DNA
ccatatttcgtttctgtctccttcttccccaccttaattt

SEQ ID NO: 3069 - DNA, 40 bp, Homo sapiens
  misc_difference 20: note = G->C
  source 1..40: mol_type = genomic DNA
ttaccttcttgtatcttgggatcgctgggagacacgtcgt

SEQ ID NO: 3070 - DNA, 40 bp, Homo sapiens
  misc_difference 20: note = A->G
  source 1..40: mol_type = genomic DNA
tctacctcctctccctcaaagtggagttcccgcgtgtcca

SEQ ID NO: 3071 - DNA, 40 bp, Homo sapiens
  misc_difference 20: note = A->C
  source 1..40: mol_type = genomic DNA
tcctgaaatgggttcctgcatgtggtttcctgccaaggta

SEQ ID NO: 3072 - DNA, 40 bp, Homo sapiens
  misc_difference 20: note = G->A
  source 1..40: mol_type = genomic DNA
agaaattgggtatgacctcggaggagtcaagaaagagttc

SEQ ID NO: 3073 - DNA, 40 bp, Homo sapiens
  misc_difference 20: note = C->T
  source 1..40: mol_type = genomic DNA
tatgaaaggaaataattcccacattcttttaagtgcttta

SEQ ID NO: 3074 - DNA, 40 bp, Homo sapiens
  misc_difference 20: note = G->C
  source 1..40: mol_type = genomic DNA
tggaagcctttatagagcagatctcgatggtgtgggagtg

SEQ ID NO: 3075 - DNA, 40 bp, Homo sapiens
  misc_difference 20: note = G->C
  source 1..40: mol_type = genomic DNA
tgcaatgtccctttttggtgaccgtatcttctattcaaca

SEQ ID NO: 3076 - DNA, 40 bp, Homo sapiens
  misc_difference 20: note = C->G
  source 1..40: mol_type = genomic DNA
gccgtctggttatagccagctctgatctaatctggcccag

SEQ ID NO: 3077 - DNA, 40 bp, Homo sapiens
  misc_difference 20: note = T->C
  source 1..40: mol_type = genomic DNA
ctctccctcctttttgttgtctgcagtttgtggttataaa

SEQ ID NO: 3078 - DNA, 40 bp, Homo sapiens
  misc_difference 20: note = C->A
  source 1..40: mol_type = genomic DNA
ccctcctatgggacacagacccttgaagggggtgtcgaga

SEQ ID NO: 3079 - DNA, 40 bp, Homo sapiens
  misc_difference 20: note = A->C
  source 1..40: mol_type = genomic DNA
gcctgggtccacggggccgagccgcgccaggtgttccaag

SEQ ID NO: 3080 - DNA, 40 bp, Homo sapiens
  misc_difference 20: note = G->T
  source 1..40: mol_type = genomic DNA
gtggaccaccgctcctaccgcatcatccgcggcaatgagg

SEQ ID NO: 3081 - DNA, 40 bp, Homo sapiens
  misc_difference 20: note = C->A
  source 1..40: mol_type = genomic DNA
gcaagacattaatgacaaccccccggtttttggcagttct

SEQ ID NO: 3082 - DNA, 40 bp, Homo sapiens
  misc_difference 20: note = G->A
  source 1..40: mol_type = genomic DNA
aagtgcccgggaccagggagttcaccccaaggtgtcctat

SEQ ID NO: 3083 - DNA, 40 bp, Homo sapiens
  misc_difference 20: note = G->C
  source 1..40: mol_type = genomic DNA
ccagggagttcaccccaaggtgtcctatgcccagcttgta

SEQ ID NO: 3084 - DNA, 40 bp, Homo sapiens
  misc_difference 20: note = C->T
  source 1..40: mol_type = genomic DNA
gggtgacaacggaacagtgcgcttctccttacaagaggca

SEQ ID NO: 3085 - DNA, 40 bp, Homo sapiens
  misc_difference 20: note = G->A
  source 1..40: mol_type = genomic DNA
ctggatataaatgataacagccctgtcttctacccggtcc

SEQ ID NO: 3086 - DNA, 40 bp, Homo sapiens
  misc_difference 20: note = C->T
  source 1..40: mol_type = genomic DNA
gtggtttttgagaacgtggcgctgggatatcatgtgggta

SEQ ID NO: 3087 - DNA, 40 bp, Homo sapiens
  misc_difference 20: note = A->G
  source 1..40: mol_type = genomic DNA
tccccatttccttcaggcaatagagagtgtaaatgtggtg

SEQ ID NO: 3088 - DNA, 40 bp, Homo sapiens
  misc_difference 20: note = G->T
  source 1..40: mol_type = genomic DNA
gtctgaagcaaaaccccaagaacctgtttgctatcaatga

SEQ ID NO: 3089 - DNA, 40 bp, Homo sapiens
  misc_difference 20: note = A->G
  source 1..40: mol_type = genomic DNA
ccccaagaacctgtttgctatcaatgaaaagaatggcact

SEQ ID NO: 3090 - DNA, 40 bp, Homo sapiens
  misc_difference 20: note = A->T
  source 1..40: mol_type = genomic DNA
actttgggccaaatggagaagtaaggtattcttttgaaat

SEQ ID NO: 3091 - DNA, 40 bp, Homo sapiens
  misc_difference 20: note = C->G
  source 1..40: mol_type = genomic DNA
atcagcagccaatctgacacaagtgttaagagtatctgcc

SEQ ID NO: 3092 - DNA, 40 bp, Homo sapiens
  misc_difference 20: note = T->C
  source 1..40: mol_type = genomic DNA
gactttgaaacacagtctttgtataaattaaatataacag

SEQ ID NO: 3093 - DNA, 40 bp, Homo sapiens
  misc_difference 20: note = G->A
  source 1..40: mol_type = genomic DNA
ttcatctacaatgtcagtggttattcacgtgagggacttt

SEQ ID NO: 3094 - DNA, 40 bp, Homo sapiens
  misc_difference 20: note = C->T
  source 1..40: mol_type = genomic DNA
caaatattcactgctagttcgtgctgatgatggtcttcag

SEQ ID NO: 3095 - DNA, 40 bp, Homo sapiens
  misc_difference 20: note = G->A
  source 1..40: mol_type = genomic DNA
cacaggtgccatcactgtcgctaaacctttggatagagaa

SEQ ID NO: 3096 - DNA, 40 bp, Homo sapiens
  misc_difference 20: note = G->A
  source 1..40: mol_type = genomic DNA
cagaactgatacctccacggtcagcattgttctactggat

SEQ ID NO: 3097 - DNA, 40 bp, Homo sapiens
  misc_difference 20: note = A->G
  source 1..40: mol_type = genomic DNA
caatgtccccgatgaggaaaggtgtagctttgccactgtt

SEQ ID NO: 3098 - DNA, 40 bp, Homo sapiens
  misc_difference 20: note = A->C
  source 1..40: mol_type = genomic DNA
ttccacaggaactgtgcatatcacagttatagaccaaaat

SEQ ID NO: 3099 - DNA, 40 bp, Homo sapiens
  misc_difference 20: note = C->T
  source 1..40: mol_type = genomic DNA
agtggagtaaaggtggaatctgtggatcatgactcctgtg

SEQ ID NO: 3100 - DNA, 40 bp, Homo sapiens
  misc_difference 20: note = G->A
  source 1..40: mol_type = genomic DNA
gacaaccagacaggcgaccgggctgagtttttggcccttg

SEQ ID NO: 3101 - DNA, 40 bp, Homo sapiens
  misc_difference 20: note = A->G
  source 1..40: mol_type = genomic DNA
gacagaatatataacagagatattatccaccctactcagg

SEQ ID NO: 3102 - DNA, 40 bp, Homo sapiens
  misc_difference 20: note = C->T
  source 1..40: mol_type = genomic DNA
aagattggctgccgtggcccgaacatttgtgccagcaacc

SEQ ID NO: 3103 - DNA, 40 bp, Homo sapiens
  misc_difference 20: note = C->T
  source 1..40: mol_type = genomic DNA
tctgcctttgtgggctgtgcctgccatcgtgggcagctgc

SEQ ID NO: 3104 - DNA, 40 bp, Homo sapiens
  misc_difference 20: note = C->G
  source 1..40: mol_type = genomic DNA
gcccctttctccaaatcttctacgttctatagaaacagcc

SEQ ID NO: 3105 - DNA, 40 bp, Homo sapiens
  misc_difference 20: note = G->A
  source 1..40: mol_type = genomic DNA
gaattgcatcttcctataagggatggtaatactttggaaa

SEQ ID NO: 3106 - DNA, 40 bp, Homo sapiens
  misc_difference 20: note = G->A
  source 1..40: mol_type = genomic DNA
aactatgccacaaggctgggaaggagaagcaagagtcctc

SEQ ID NO: 3107 - DNA, 40 bp, Homo sapiens
  misc_difference 20: note = C->G
  source 1..40: mol_type = genomic DNA
gatgaagataattatggagccagactgaagcctcgaaggt

SEQ ID NO: 3108 - DNA, 40 bp, Homo sapiens
  misc_difference 20: note = A->T
  source 1..40: mol_type = genomic DNA
cggcgcgacgccagcgaggaggagctcaagaaggcctatc

SEQ ID NO: 3109 - DNA, 40 bp, Homo sapiens
  misc_difference 20: note = C->T
  source 1..40: mol_type = genomic DNA
tacacgacaggcttcaaaccgctgggaaaaacgagccatg

SEQ ID NO: 3110 - DNA, 40 bp, Homo sapiens
  misc_difference 20: note = A->T
  source 1..40: mol_type = genomic DNA
gagttccataggtttccaaaaaggcaaaatattctccctt

SEQ ID NO: 3111 - DNA, 40 bp, Homo sapiens
  misc_difference 20: note = G->C
  source 1..40: mol_type = genomic DNA
ggcttcatatctggccttagttacctagagctggacaatc

SEQ ID NO: 3112 - DNA, 40 bp, Homo sapiens
  misc_difference 20: note = C->T
  source 1..40: mol_type = genomic DNA
agggaagaaaacaagaagccgtgaatgcaataacccacct

SEQ ID NO: 3113 - DNA, 40 bp, Homo sapiens
  misc_difference 20: note = A->C
  source 1..40: mol_type = genomic DNA
ttttgtttaggatgaaggtacaatgtttcctgtggggaaa

SEQ ID NO: 3114 - DNA, 40 bp, Homo sapiens
  misc_difference 20: note = A->G
  source 1..40: mol_type = genomic DNA
gggaagaataattgagttaaaatcagaaatcctaagtaag

SEQ ID NO: 3115 - DNA, 40 bp, Homo sapiens
  misc_difference 20: note = C->T
  source 1..40: mol_type = genomic DNA
caggcacaagcagctgatccgattcctgaaacggctcgac

SEQ ID NO: 3116 - DNA, 40 bp, Homo sapiens
  misc_difference 20: note = G->C
  source 1..40: mol_type = genomic DNA
gagctccggcagcggaacagaggggacctgacagcggact

SEQ ID NO: 3117 - DNA, 40 bp, Homo sapiens
  misc_difference 20: note = A->G
  source 1..40: mol_type = genomic DNA
actttttcttcccctagtaacctgagatgtgggctcagag

SEQ ID NO: 3118 - DNA, 40 bp, Homo sapiens
  misc_difference 20: note = T->A
  source 1..40: mol_type = genomic DNA
ctcctgtcacatctgtctgtctttctggtagcagtttctc

SEQ ID NO: 3119 - DNA, 40 bp, Homo sapiens
  misc_difference 20: note = G->A
  source 1..40: mol_type = genomic DNA
tgggatcctctcttcttccgcatcagtgtcgctgtcgatg

SEQ ID NO: 3120 - DNA, 40 bp, Homo sapiens
  misc_difference 20: note = A->G
  source 1..40: mol_type = genomic DNA
ctcccgttccctccgccctatggaccccaggggccttacc

SEQ ID NO: 3121 - DNA, 40 bp, Homo sapiens
  misc_difference 20: note = C->T
  source 1..40: mol_type = genomic DNA
gctgccccacctgctgccccttctaccccagctccaccac

SEQ ID NO: 3122 - DNA, 40 bp, Homo sapiens
  misc_difference 20: note = C->T
  source 1..40: mol_type = genomic DNA
ccctcctgcccaatctactcctactccaggtgtggctgcg

SEQ ID NO: 3123 - DNA, 40 bp, Homo sapiens
  misc_difference 20: note = G->A
  source 1..40: mol_type = genomic DNA
ggctgtgccagctccacaggctccacccccgccccccaag

SEQ ID NO: 3124 - DNA, 40 bp, Homo sapiens
  misc_difference 20: note = A->C
  source 1..40: mol_type = genomic DNA
ggctccacccccgccccccaaggccctgtacccaggtgct

SEQ ID NO: 3125 - DNA, 40 bp, Homo sapiens
  misc_difference 20: note = G->A
  source 1..40: mol_type = genomic DNA
gccacacccgctgaaccccgcccacttacctcacctctgc

SEQ ID NO: 3126 - DNA, 40 bp, Homo sapiens
  misc_difference 20: note = G->C
  source 1..40: mol_type = genomic DNA
gcccctcgaacagggggatgaaacccccaaacccccaaag

SEQ ID NO: 3127 - DNA, 40 bp, Homo sapiens
  misc_difference 20: note = G->A
  source 1..40: mol_type = genomic DNA
cctctgtcccctgtggcgcgcggaggcagcaatggaggta

SEQ ID NO: 3128 - DNA, 40 bp, Homo sapiens
  misc_difference 20: note = C->T
  source 1..40: mol_type = genomic DNA
aggtatttcagccatgtcccgcggagatctgagccagaga

SEQ ID NO: 3129 - DNA, 40 bp, Homo sapiens
  misc_difference 20: note = G->A
  source 1..40: mol_type = genomic DNA
cagcagcagtggaggaggcggtgggggtcctggaggaagg

SEQ ID NO: 3130 - DNA, 40 bp, Homo sapiens
  misc_difference 20: note = G->A
  source 1..40: mol_type = genomic DNA
aggaggcggtgggggtcctggaggaaggaccgggccagga

SEQ ID NO: 3131 - DNA, 40 bp, Homo sapiens
  misc_difference 20: note = G->A
  source 1..40: mol_type = genomic DNA
ccccctaaacgtcgggagcggcctcccagaaaaccagagc

SEQ ID NO: 3132 - DNA, 40 bp, Homo sapiens
  misc_difference 20: note = G->A
  source 1..40: mol_type = genomic DNA
ggcacagaacgatcacagcgtacagaccgaggcacagagc

SEQ ID NO: 3133 - DNA, 40 bp, Homo sapiens
  misc_difference 20: note = A->G
  source 1..40: mol_type = genomic DNA
gtccagtttggcactagtgacaaggtctgtgtgggctgga

SEQ ID NO: 3134 - DNA, 40 bp, Homo sapiens
  misc_difference 20: note = C->T
  source 1..40: mol_type = genomic DNA
accacctcctgccccacctcccctttctctgttacctgtg

SEQ ID NO: 3135 - DNA, 40 bp, Homo sapiens
  misc_difference 20: note = T->C
  source 1..40: mol_type = genomic DNA
cccctttctctgttacctgtgggccctgctctgcagcccc

SEQ ID NO: 3136 - DNA, 40 bp, Homo sapiens
  misc_difference 20: note = C->T
  source 1..40: mol_type = genomic DNA
tgggggacctggatcatcacggactcccccaactggaagg

SEQ ID NO: 3137 - DNA, 40 bp, Homo sapiens
  misc_difference 20: note = T->C
  source 1..40: mol_type = genomic DNA
ccttcttcccttaggtccttctctggcctcaattcccgtc

SEQ ID NO: 3138 - DNA, 40 bp, Homo sapiens
  misc_difference 20: note = C->T
  source 1..40: mol_type = genomic DNA
ccttgggagcggacagggccgccacctcgagaagggccct

SEQ ID NO: 3139 - DNA, 40 bp, Homo sapiens
  misc_difference 20: note = C->T
  source 1..40: mol_type = genomic DNA
tgccccagaccacgagagcctcaagcttctccagagaggt

SEQ ID NO: 3140 - DNA, 40 bp, Homo sapiens
  misc_difference 20: note = C->G
  source 1..40: mol_type = genomic DNA
gggcctgagggatgcctgccgctccctgccgcagtccatc

SEQ ID NO: 3141 - DNA, 40 bp, Homo sapiens
  misc_difference 20: note = C->T
  source 1..40: mol_type = genomic DNA
cagtggaaaacccatcaagcctgtcaaggatttgctaaag

SEQ ID NO: 3142 - DNA, 40 bp, Homo sapiens
  misc_difference 20: note = G->A
  source 1..40: mol_type = genomic DNA
aaggggcaaaaacgaaagcgcaagaaatcccggtataagt

SEQ ID NO: 3143 - DNA, 40 bp, Homo sapiens
  misc_difference 20: note = T->C
  source 1..40: mol_type = genomic DNA
attggataatgcctaaaaatgaaacagtatattttgagaa

SEQ ID NO: 3144 - DNA, 40 bp, Homo sapiens
  misc_difference 20: note = G->A
  source 1..40: mol_type = genomic DNA
cgcaggcaggtgacctgccgggatacaggccgctggtgat

SEQ ID NO: 3145 - DNA, 40 bp, Homo sapiens
  misc_difference 20: note = C->T
  source 1..40: mol_type = genomic DNA
gggtatggttctgattcatcaacctccacaggaatgcttc

SEQ ID NO: 3146 - DNA, 40 bp, Homo sapiens
  misc_difference 20: note = T->C
  source 1..40: mol_type = genomic DNA
cgaagactggacagcatcgttgggccccagctcacagtgc

SEQ ID NO: 3147 - DNA, 40 bp, Homo sapiens
  misc_difference 20: note = G->T
  source 1..40: mol_type = genomic DNA
aagaacctgagcagctcctgagtgcccaccctgtcgtcca

SEQ ID NO: 3148 - DNA, 40 bp, Homo sapiens
  misc_difference 20: note = C->T
  source 1..40: mol_type = genomic DNA
gagggtctccactgggctgcgtgtgttccgctgcaccagg

SEQ ID NO: 3149 - DNA, 40 bp, Homo sapiens
  misc_difference 20: note = G->A
  source 1..40: mol_type = genomic DNA
agctcccaagtggtttgacgggcagcgggccgccgagaac

SEQ ID NO: 3150 - DNA, 40 bp, Homo sapiens
  misc_difference 20: note = T->G
  source 1..40: mol_type = genomic DNA
caaaaaattgtacatcatatggtgtgctagacatcagcaa

SEQ ID NO: 3151 - DNA, 40 bp, Homo sapiens
  misc_difference 20: note = T->C
  source 1..40: mol_type = genomic DNA
gatcataaaggaataaaaatcctcaaagtttttatgctgt

SEQ ID NO: 3152 - DNA, 40 bp, Homo sapiens
  misc_difference 20: note = C->A
  source 1..40: mol_type = genomic DNA
ggatctcttgggtcatccacagaggacagtaatagaaata

SEQ ID NO: 3153 - DNA, 40 bp, Homo sapiens
  misc_difference 20: note = A->T
  source 1..40: mol_type = genomic DNA
tggattaagatattccaagagtccagcaaacctatctgct

SEQ ID NO: 3154 - DNA, 40 bp, Homo sapiens
  misc_difference 20: note = G->A
  source 1..40: mol_type = genomic DNA
tagtttcctgacttctgaagctctttctctctgccataaa

SEQ ID NO: 3155 - DNA, 40 bp, Homo sapiens
  misc_difference 20: note = G->C
  source 1..40: mol_type = genomic DNA
ttattagactctccttttggatacctagatgttttaacag

SEQ ID NO: 3156 - DNA, 40 bp, Homo sapiens
  misc_difference 20: note = G->A
  source 1..40: mol_type = genomic DNA
atattaattttgcatgaaggtagcagctatttttatggga

SEQ ID NO: 3157 - DNA, 40 bp, Homo sapiens
  misc_difference 20: note = C->T
  source 1..40: mol_type = genomic DNA
cctaactgagaccttacaccgtttctcattagaaggagat

SEQ ID NO: 3158 - DNA, 40 bp, Homo sapiens
  misc_difference 20: note = T->C
  source 1..40: mol_type = genomic DNA
atagcaattttggatgaccttctgcctcttaccatatttg

SEQ ID NO: 3159 - DNA, 40 bp, Homo sapiens
  misc_difference 20: note = C->A
  source 1..40: mol_type = genomic DNA
aggacaagggccaatggagccccctgaaggtcagcgccca

SEQ ID NO: 3160 - DNA, 40 bp, Homo sapiens
  misc_difference 20: note = C->T
  source 1..40: mol_type = genomic DNA
aaggacgccccgccactgccgcccctggtgagtgattgcc

SEQ ID NO: 3161 - DNA, 40 bp, Homo sapiens
  misc_difference 20: note = C->T
  source 1..40: mol_type = genomic DNA
gttctttagatcacagggtcggaaggaggctgagaggcag

SEQ ID NO: 3162 - DNA, 40 bp, Homo sapiens
  misc_difference 20: note = G->A
  source 1..40: mol_type = genomic DNA
gatgaatgggagatcccccggcagtctctcaggctggtca

SEQ ID NO: 3163 - DNA, 40 bp, Homo sapiens
  misc_difference 20: note = A->C
  source 1..40: mol_type = genomic DNA
tgcctgctggatttcctgaagacagatgaagggagcagat

SEQ ID NO: 3164 - DNA, 40 bp, Homo sapiens
  misc_difference 20: note = C->T
  source 1..40: mol_type = genomic DNA
gcgcatgaattccatccaccgcgacctgcgggcggccaac

SEQ ID NO: 3165 - DNA, 40 bp, Homo sapiens
  misc_difference 20: note = G->A
  source 1..40: mol_type = genomic DNA
ttgatgaagaaactttcgagtatcggcaagaaactgacat

SEQ ID NO: 3166 - DNA, 40 bp, Homo sapiens
  misc_difference 20: note = T->C
  source 1..40: mol_type = genomic DNA
tacctgtttaagtctacaatatatttatgtacactttgaa

SEQ ID NO: 3167 - DNA, 40 bp, Homo sapiens
  misc_difference 20: note = A->C
  source 1..40: mol_type = genomic DNA
ggggaagcatggactctttagccagcttagttctctgtgg

SEQ ID NO: 3168 - DNA, 40 bp, Homo sapiens
  misc_difference 20: note = C->T
  source 1..40: mol_type = genomic DNA
gatacgaaccatgaagatgcgtcaacaaggtaacatgccc

SEQ ID NO: 3169 - DNA, 40 bp, Homo sapiens
  misc_difference 20: note = C->T
  source 1..40: mol_type = genomic DNA
ctggtgaagccggatgggacagtgctccatgtaagagcca

SEQ ID NO: 3170 - DNA, 40 bp, Homo sapiens
  misc_difference 20: note = C->T
  source 1..40: mol_type = genomic DNA
agatctcactgcttggacccttagtgacagtaagtaattc

SEQ ID NO: 3171 - DNA, 40 bp, Homo sapiens
  misc_difference 20: note = G->A
  source 1..40: mol_type = genomic DNA
atgcattatccatcccgacggacagcaggtgtctaaaaag

SEQ ID NO: 3172 - DNA, 40 bp, Homo sapiens
  misc_difference 20: note = G->C
  source 1..40: mol_type = genomic DNA
ctcttatcaaggatcagttgcctaagaaggaagaccgggt

SEQ ID NO: 3173 - DNA, 40 bp, Homo sapiens
  misc_difference 20: note = T->C
  source 1..40: mol_type = genomic DNA
gatgttaacatttgccttgtctctacaatgtaagaaaatt

SEQ ID NO: 3174 - DNA, 40 bp, Homo sapiens
  misc_difference 20: note = C->T
  source 1..40: mol_type = genomic DNA
acctggttcccccttttctcccttggtgccatcacgccca

SEQ ID NO: 3175 - DNA, 40 bp, Homo sapiens
  misc_difference 20: note = C->T
  source 1..40: mol_type = genomic DNA
ccccttttctcccttggtgccatcacgcccatctttgcct

SEQ ID NO: 3176 - DNA, 40 bp, Homo sapiens
  misc_difference 20: note = G->A
  source 1..40: mol_type = genomic DNA
tctcccttggtgccatcacgcccatctttgcctgggaagc

SEQ ID NO: 3177 - DNA, 40 bp, Homo sapiens
  misc_difference 20: note = G->A
  source 1..40: mol_type = genomic DNA
caactgcccaaagaaattcggagggcagcactgtgaaata

SEQ ID NO: 3178 - DNA, 40 bp, Homo sapiens
  misc_difference 20: note = A->C
  source 1..40: mol_type = genomic DNA
ctcccacagtgattacccaaagaaggaggactacatcgtc

SEQ ID NO: 3179 - DNA, 40 bp, Homo sapiens
  misc_difference 20: note = T->C
  source 1..40: mol_type = genomic DNA
ggagtgtcagcagccccactactacggctctgaagtcacc

SEQ ID NO: 3180 - DNA, 40 bp, Homo sapiens
  misc_difference 20: note = G->A
  source 1..40: mol_type = genomic DNA
acacctagatggtaacaacgaggcagccctggaatgctta

SEQ ID NO: 3181 - DNA, 40 bp, Homo sapiens
  misc_difference 20: note = T->C
  source 1..40: mol_type = genomic DNA
catcaggtcaaggatagtctggagcaattgagatgtcact

SEQ ID NO: 3182 - DNA, 40 bp, Homo sapiens
  misc_difference 20: note = C->T
  source 1..40: mol_type = genomic DNA
tcttgtctcttgcccagtccgccagaagaagcagcgccag

SEQ ID NO: 3183 - DNA, 40 bp, Homo sapiens
  misc_difference 20: note = C->T
  source 1..40: mol_type = genomic DNA
tccccagctctggaaggggctctgcatcgctcctccatgc

SEQ ID NO: 3184 - DNA, 40 bp, Homo sapiens
  misc_difference 20: note = G->A
  source 1..40: mol_type = genomic DNA
tcccagtccccatctcaccgctgaaaggactcttcttcat

SEQ ID NO: 3185 - DNA, 40 bp, Homo sapiens
  misc_difference 20: note = C->G
  source 1..40: mol_type = genomic DNA
gcgtcctccctggcgccccccggtggctgccccacgtccg

SEQ ID NO: 3186 - DNA, 40 bp, Homo sapiens
  misc_difference 20: note = C->T
  source 1..40: mol_type = genomic DNA
cctggtgcagatgctctcccggaacctggaggggcaccac

SEQ ID NO: 3187 - DNA, 40 bp, Homo sapiens
  misc_difference 20: note = C->T
  source 1..40: mol_type = genomic DNA
ggccaagctgctgcctctgcgggctctgcctctgctcttc

SEQ ID NO: 3188 - DNA, 40 bp, Homo sapiens
  misc_difference 20: note = G->T
  source 1..40: mol_type = genomic DNA
gctgcaggagctgaacgtggcgtacaacggtgctggtgac

SEQ ID NO: 3189 - DNA, 40 bp, Homo sapiens
  misc_difference 20: note = C->G
  source 1..40: mol_type = genomic DNA
ggcaggcaaaagaccgtctcggttttcactgcagggactt

SEQ ID NO: 3190 - DNA, 40 bp, Homo sapiens
  misc_difference 20: note = T->A
  source 1..40: mol_type = genomic DNA
tttttaccatctttgctcatcttttctttatgttttcgaa

SEQ ID NO: 3191 - DNA, 40 bp, Homo sapiens
  misc_difference 20: note = A->T
  source 1..40: mol_type = genomic DNA
ctgatttttttcaatctgtattgtcggatctccctcacca

SEQ ID NO: 3192 - DNA, 40 bp, Homo sapiens
  misc_difference 20: note = C->G
  source 1..40: mol_type = genomic DNA
tggtcctagcagctttgaacagggtatgttgaatataagt

SEQ ID NO: 3193 - DNA, 40 bp, Homo sapiens
  misc_difference 20: note = A->G
  source 1..40: mol_type = genomic DNA
attcatttgacttagtaatattccatcaaatgtcttccaa

SEQ ID NO: 3194 - DNA, 40 bp, Homo sapiens
  misc_difference 20: note = G->T
  source 1..40: mol_type = genomic DNA
atcagcttgctcttaaggaggctggccctggatgtggcca

SEQ ID NO: 3195 - DNA, 40 bp, Homo sapiens
  misc_difference 20: note = A->G
  source 1..40: mol_type = genomic DNA
gcaaagtgccacagttggcatagatgtgaaagactggcct

SEQ ID NO: 3196 - DNA, 40 bp, Homo sapiens
  misc_difference 20: note = C->T
  source 1..40: mol_type = genomic DNA
ctctaatctttatttaggtcgtgaggaattctatagtact

SEQ ID NO: 3197 - DNA, 40 bp, Homo sapiens
  misc_difference 20: note = G->A
  source 1..40: mol_type = genomic DNA
tctaatctttatttaggtcgtgaggaattctatagtactc

SEQ ID NO: 3198 - DNA, 40 bp, Homo sapiens
  misc_difference 20: note = A->G
  source 1..40: mol_type = genomic DNA
agagggtttgaagtttccaaatgagtttgatgaattagaa

SEQ ID NO: 3199 - DNA, 40 bp, Homo sapiens
  misc_difference 20: note = C->T
  source 1..40: mol_type = genomic DNA
ggggccgagagctgtcgcacatccagattggagacattgt

SEQ ID NO: 3200 - DNA, 40 bp, Homo sapiens
  misc_difference 20: note = C->A
  source 1..40: mol_type = genomic DNA
caggaccctcagcttcccccttctttggctcagtgcctgc

SEQ ID NO: 3201 - DNA, 40 bp, Homo sapiens
  misc_difference 20: note = T->C
  source 1..40: mol_type = genomic DNA
tgcaatgggatcaatgatatcttctgcagcaaatttgtcc

SEQ ID NO: 3202 - DNA, 40 bp, Homo sapiens
  misc_difference 20: note = G->A
  source 1..40: mol_type = genomic DNA
atcgctagggaaggaccctggccccaggatggggccactc

SEQ ID NO: 3203 - DNA, 40 bp, Homo sapiens
  misc_difference 20: note = G->C
  source 1..40: mol_type = genomic DNA
tgcttctccagctctgtttggctaaggccggacatgcctg

SEQ ID NO: 3204 - DNA, 40 bp, Homo sapiens
  misc_difference 20: note = C->T
  source 1..40: mol_type = genomic DNA
cagcccttgagcagcatcaccttggtgatctggggcagaa

SEQ ID NO: 3205 - DNA, 40 bp, Homo sapiens
  misc_difference 20: note = A->G
  source 1..40: mol_type = genomic DNA
caggggtgcccaagctgcaatcgtggtttacgacattact

SEQ ID NO: 3206 - DNA, 40 bp, Homo sapiens
  misc_difference 20: note = GGGA->G
  source 1..40: mol_type = genomic DNA
agagtgaaccccagaatctgggaggtgcagcaggccgaag

SEQ ID NO: 3207 - DNA, 40 bp, Homo sapiens
  misc_difference 20: note = G->A
  source 1..40: mol_type = genomic DNA
tcaggctgaaagcaacagtgcagacgatgagaccgacgat

SEQ ID NO: 3208 - DNA, 40 bp, Homo sapiens
  misc_difference 20: note = G->C
  source 1..40: mol_type = genomic DNA
gagaccgacgatcccaggaggtatcagaaatatggttaca

SEQ ID NO: 3209 - DNA, 40 bp, Homo sapiens
  misc_difference 20: note = G->A
  source 1..40: mol_type = genomic DNA
gggactcttgatccagagaggacaaagctcctcagtgagc

SEQ ID NO: 3210 - DNA, 40 bp, Homo sapiens
  misc_difference 20: note = C->T
  source 1..40: mol_type = genomic DNA
cgagatcatctccgagatccgagcccagctggaggcatgt

SEQ ID NO: 3211 - DNA, 40 bp, Homo sapiens
  misc_difference 20: note = G->A
  source 1..40: mol_type = genomic DNA
gtatgcctgggagcagggcgggaaggactcccagttcaac

SEQ ID NO: 3212 - DNA, 40 bp, Homo sapiens
  misc_difference 20: note = A->G
  source 1..40: mol_type = genomic DNA
aattctaaaagaaacttctagagatcatctggcaatcgct

SEQ ID NO: 3213 - DNA, 40 bp, Homo sapiens
  misc_difference 20: note = T->C
  source 1..40: mol_type = genomic DNA
ctcaaaatctttttttttttcccctcaggtggcgacatgt

SEQ ID NO: 3214 - DNA, 40 bp, Homo sapiens
  misc_difference 20: note = T->A
  source 1..40: mol_type = genomic DNA
atcgtgggtgagttcattttccaggtgctgtagtttcccc

SEQ ID NO: 3215 - DNA, 40 bp, Homo sapiens
  misc_difference 20: note = C->A
  source 1..40: mol_type = genomic DNA
taagaatcaagaaaatggaccagtttgttcgttacgaggt

SEQ ID NO: 3216 - DNA, 40 bp, Homo sapiens
  misc_difference 20: note = T->A
  source 1..40: mol_type = genomic DNA
caaggagaaacaaatgagttctaggaaagacaaagaaggg

SEQ ID NO: 3217 - DNA, 40 bp, Homo sapiens
  misc_difference 20: note = G->A
  source 1..40: mol_type = genomic DNA
actgacgggcattgacttcgtgaagcggctgccgtgtggc

SEQ ID NO: 3218 - DNA, 40 bp, Homo sapiens
  misc_difference 20: note = G->A
  source 1..40: mol_type = genomic DNA
cccccagttgacccccacagcctccgcagcctcaccggca

SEQ ID NO: 3219 - DNA, 40 bp, Homo sapiens
  misc_difference 20: note = G->A
  source 1..40: mol_type = genomic DNA
gcaccattcgcctgtgaacgtttttcatcatactgctctc

SEQ ID NO: 3220 - DNA, 40 bp, Homo sapiens
  misc_difference 20: note = C->T
  source 1..40: mol_type = genomic DNA
ttgcctaaaagagacctacctccggatcaagaagaatgaa

SEQ ID NO: 3221 - DNA, 40 bp, Homo sapiens
  misc_difference 20: note = T->A
  source 1..40: mol_type = genomic DNA
gacggcactgagtcctacctcaccgtgagttcccatccca

SEQ ID NO: 3222 - DNA, 40 bp, Homo sapiens
  misc_difference 20: note = C->G
  source 1..40: mol_type = genomic DNA
gctgcgcgtgcacactgagcaagtccgctgcaagtctggg

SEQ ID NO: 3223 - DNA, 40 bp, Homo sapiens
  misc_difference 20: note = G->A
  source 1..40: mol_type = genomic DNA
tctccttctcacccaggacgtggacaccatttaccatcgc

SEQ ID NO: 3224 - DNA, 40 bp, Homo sapiens
  misc_difference 20: note = A->T
  source 1..40: mol_type = genomic DNA
ccagagcagctgctgcaagatgccttcactaggctcaggt

SEQ ID NO: 3225 - DNA, 40 bp, Homo sapiens
  misc_difference 20: note = C->T
  source 1..40: mol_type = genomic DNA
ctcaagcagctgcccggctcgtggactggagggtgtctct

SEQ ID NO: 3226 - DNA, 40 bp, Homo sapiens
  misc_difference 20: note = G->T
  source 1..40: mol_type = genomic DNA
gtctctgaccccagaatcagctcccgaatccagggccgta

SEQ ID NO: 3227 - DNA, 40 bp, Homo sapiens
  misc_difference 20: note = T->G
  source 1..40: mol_type = genomic DNA
gcaaacattagaaaacatctcaaacatagcaggaaatggc

SEQ ID NO: 3228 - DNA, 40 bp, Homo sapiens
  misc_difference 20: note = G->T
  source 1..40: mol_type = genomic DNA
gggcgcggaggacttggaggacacgcagttccccagtgag

SEQ ID NO: 3229 - DNA, 40 bp, Homo sapiens
  misc_difference 20: note = C->A
  source 1..40: mol_type = genomic DNA
acttctcggtgtgcaggaactggtaagaaagtgctttctc

SEQ ID NO: 3230 - DNA, 40 bp, Homo sapiens
  misc_difference 20: note = C->G
  source 1..40: mol_type = genomic DNA
agctgtgtcccaggagctacgggagggggacccagtttct

SEQ ID NO: 3231 - DNA, 40 bp, Homo sapiens
  misc_difference 20: note = C->G
  source 1..40: mol_type = genomic DNA
cactggccttcttgtcccccctcccactgactggagcagg

SEQ ID NO: 3232 - DNA, 40 bp, Homo sapiens
  misc_difference 20: note = G->A
  source 1..40: mol_type = genomic DNA
ggtggcgatgtggacgttcgggagctactgccagggagtg

SEQ ID NO: 3233 - DNA, 40 bp, Homo sapiens
  misc_difference 20: note = A->G
  source 1..40: mol_type = genomic DNA
cgcaaagcaaaacctctccagctaaatctcacttgtgggt

SEQ ID NO: 3234 - DNA, 40 bp, Homo sapiens
  misc_difference 20: note = T->C
  source 1..40: mol_type = genomic DNA
acttgtcctcctgtgcctattcggtctctggactgaagac

SEQ ID NO: 3235 - DNA, 40 bp, Homo sapiens
  misc_difference 20: note = C->T
  source 1..40: mol_type = genomic DNA
ctgcttctgtgggactctgcggcggtgagagcgaggtcca

SEQ ID NO: 3236 - DNA, 40 bp, Homo sapiens
  misc_difference 20: note = G->T
  source 1..40: mol_type = genomic DNA
ccctgacctgccttttcccgcaggagtccctgtttctgct

SEQ ID NO: 3237 - DNA, 40 bp, Homo sapiens
  misc_difference 20: note = A->T
  source 1..40: mol_type = genomic DNA
tcagtggcagtttaataagacatctgcaagttagtcacac

SEQ ID NO: 3238 - DNA, 40 bp, Homo sapiens
  misc_difference 20: note = G->A
  source 1..40: mol_type = genomic DNA
tctcttcctttggcgtgacggtgttgggatgtgctatggg

SEQ ID NO: 3239 - DNA, 40 bp, Homo sapiens
  misc_difference 20: note = G->A
  source 1..40: mol_type = genomic DNA
ggagggcactgaagcagccgctggcacaggaggtgttatg

SEQ ID NO: 3240 - DNA, 40 bp, Homo sapiens
  misc_difference 20: note = G->A
  source 1..40: mol_type = genomic DNA
gcccgcgcgtgctgccgccgcagctctgtgatgtagttgc

SEQ ID NO: 3241 - DNA, 40 bp, Homo sapiens
  misc_difference 20: note = G->A
  source 1..40: mol_type = genomic DNA
acccaggcgcccagcttacggtcgcagaaggcgtcgttcc

SEQ ID NO: 3242 - DNA, 40 bp, Homo sapiens
  misc_difference 20: note = C->T
  source 1..40: mol_type = genomic DNA
ctagtcctgccagcgactcccccacaacttgtcagccccc

SEQ ID NO: 3243 - DNA, 40 bp, Homo sapiens
  misc_difference 20: note = G->A
  source 1..40: mol_type = genomic DNA
agaagggaccgaggtgacagtgaagtgtgaggcccaccct

SEQ ID NO: 3244 - DNA, 40 bp, Homo sapiens
  misc_difference 20: note = C->G
  source 1..40: mol_type = genomic DNA
tctcaatctcgtcccagggccgctctccgcagacatgcta

SEQ ID NO: 3245 - DNA, 40 bp, Homo sapiens
  misc_difference 20: note = A->G
  source 1..40: mol_type = genomic DNA
ggcgggaaaggagcaggtgatgtcggaagcgaagcagtaa

SEQ ID NO: 3246 - DNA, 40 bp, Homo sapiens
  misc_difference 20: note = T->A
  source 1..40: mol_type = genomic DNA
aagaatggtattgttgacttcgaacctgtagggcgaaaag

SEQ ID NO: 3247 - DNA, 40 bp, Homo sapiens
  misc_difference 20: note = G->A
  source 1..40: mol_type = genomic DNA
ctgtccgtgttgacgccacgctggggagagagaacacaga

SEQ ID NO: 3248 - DNA, 40 bp, Homo sapiens
  misc_difference 20: note = C->T
  source 1..40: mol_type = genomic DNA
ctctacgcctgggagggggcctgcgtctggatcccctgca

SEQ ID NO: 3249 - DNA, 40 bp, Homo sapiens
  misc_difference 20: note = T->C
  source 1..40: mol_type = genomic DNA
aggtgggcatgttggcacattgaggcggttgcacagcctc

SEQ ID NO: 3250 - DNA, 40 bp, Homo sapiens
  misc_difference 20: note = G->A
  source 1..40: mol_type = genomic DNA
ctggaccacgtctacaaccggctcgctcgataccgttagg

SEQ ID NO: 3251 - DNA, 40 bp, Homo sapiens
  misc_difference 20: note = G->C
  source 1..40: mol_type = genomic DNA
cacccgacgatgagcccgagcctggattcgaggtcatttc

SEQ ID NO: 3252 - DNA, 40 bp, Homo sapiens
  misc_difference 20: note = G->A
  source 1..40: mol_type = genomic DNA
ggcttcctggaggaggacaggagggcctatttcctgagac

SEQ ID NO: 3253 - DNA, 40 bp, Homo sapiens
  misc_difference 20: note = T->C
  source 1..40: mol_type = genomic DNA
ctgcttactgagtactgcatcgagaccggagcccctgacg

SEQ ID NO: 3254 - DNA, 40 bp, Homo sapiens
  misc_difference 20: note = G->A
  source 1..40: mol_type = genomic DNA
gtttccattcatcttccaaggccaatcctactccgcctgc

SEQ ID NO: 3255 - DNA, 40 bp, Homo sapiens
  misc_difference 20: note = G->A
  source 1..40: mol_type = genomic DNA
tgcccggaccaaggtaggcgtggtcccgcggctccggggc

SEQ ID NO: 3256 - DNA, 40 bp, Homo sapiens
  misc_difference 20: note = C->T
  source 1..40: mol_type = genomic DNA
ggtatcgccagcatgccaccgcttacagctgttgctccag

SEQ ID NO: 3257 - DNA, 40 bp, Homo sapiens
  misc_difference 20: note = A->G
  source 1..40: mol_type = genomic DNA
gcaatggatcctcggtgtaaagggatgccactctctagtt

SEQ ID NO: 3258 - DNA, 40 bp, Homo sapiens
  misc_difference 20: note = G->A
  source 1..40: mol_type = genomic DNA
gatcagctaccggaacaccgagctagagcttcaggaccct

SEQ ID NO: 3259 - DNA, 40 bp, Homo sapiens
  misc_difference 20: note = A->G
  source 1..40: mol_type = genomic DNA
ggagaaggtgcgcccctgcatcgacctcattgactccctg

SEQ ID NO: 3260 - DNA, 40 bp, Homo sapiens
  misc_difference 20: note = G->A
  source 1..40: mol_type = genomic DNA
ggccctgccagccatcgccgtcatcggggaccagagctcg

SEQ ID NO: 3261 - DNA, 40 bp, Homo sapiens
  misc_difference 20: note = G->A
  source 1..40: mol_type = genomic DNA
cgagggagacaggaccatcggtgagagtgggggagcccca

SEQ ID NO: 3262 - DNA, 40 bp, Homo sapiens
  misc_difference 20: note = C->A
  source 1..40: mol_type = genomic DNA
tggctcgcaggaatcttgacgaagcctgatctggtggaca

SEQ ID NO: 3263 - DNA, 40 bp, Homo sapiens
  misc_difference 20: note = G->A
  source 1..40: mol_type = genomic DNA
tagggatctgctggaggaaggaaaggccacggttccctgc

SEQ ID NO: 3264 - DNA, 40 bp, Homo sapiens
  misc_difference 20: note = C->T
  source 1..40: mol_type = genomic DNA
aagtatggtgtcgacataccggaagacgaaaatgaaaaaa

SEQ ID NO: 3265 - DNA, 40 bp, Homo sapiens
  misc_difference 20: note = G->A
  source 1..40: mol_type = genomic DNA
ttccaggaggccagcaagcgcatctccagccacatccctt

SEQ ID NO: 3266 - DNA, 40 bp, Homo sapiens
  misc_difference 20: note = G->A
  source 1..40: mol_type = genomic DNA
gcacggctgacgcaggctcggcgccggcttgcccagttcc

SEQ ID NO: 3267 - DNA, 40 bp, Homo sapiens
  misc_difference 20: note = T->C
  source 1..40: mol_type = genomic DNA
gtccagagagctgtggccatgtcctccggggacgtcccgg

SEQ ID NO: 3268 - DNA, 40 bp, Homo sapiens
  misc_difference 20: note = G->A
  source 1..40: mol_type = genomic DNA
agctgtggccatgtcctccggggacgtcccgggagcccga

SEQ ID NO: 3269 - DNA, 40 bp, Homo sapiens
  misc_difference 20: note = G->A
  source 1..40: mol_type = genomic DNA
ggctcctggtgcgcgttgcggggtgtgcggagatggtacg

SEQ ID NO: 3270 - DNA, 40 bp, Homo sapiens
  misc_difference 20: note = T->G
  source 1..40: mol_type = genomic DNA
ccagagatggacagccatctggtagagaagttgggccagc

SEQ ID NO: 3271 - DNA, 40 bp, Homo sapiens
  misc_difference 20: note = T->C
  source 1..40: mol_type = genomic DNA
gccttgtcctaggtctgccttcagcgaggatgacggtgac

SEQ ID NO: 3272 - DNA, 40 bp, Homo sapiens
  misc_difference 20: note = T->C
  source 1..40: mol_type = genomic DNA
tatgaaacacaggcctccttgtcaggcccctacttaacct

SEQ ID NO: 3273 - DNA, 40 bp, Homo sapiens
  misc_difference 20: note = G->A
  source 1..40: mol_type = genomic DNA
gtacctgtgtgacaaggtcgtccctgggaacagggttacc

SEQ ID NO: 3274 - DNA, 40 bp, Homo sapiens
  misc_difference 20: note = T->C
  source 1..40: mol_type = genomic DNA
ctgccatccctacgaccactgcccctcacatcaccttctc

SEQ ID NO: 3275 - DNA, 6673 bp, Homo sapiens
  source 1..6673: mol_type = genomic DNA
acatacacatacacatgcacacacacactcatatacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggtaagtccactttatggccaccacttcttgctactgcggttcttctgaggccagttgcattccctgcctgggagattcttttttttgttttttgttttttttaacggagtctcactctgttgccaggctggagtgaagtggcgcaatctcggctcactgcaacctccacctcctgggttcaagcgattctcctacctcagcctcttgagtagctgggattacaggtgcatgccaacacacccagctaatctttgtatttttagtaggggcagggtttcactatgttggccacggtggtctcgatctcttgacctcgtgatctgcccagctcagccacctgaagtgctgggattacaggcgtgagcccagttcttgttggtaaaatcgggaaactcatctccttgccagaaattactttgcatgtgtgcatattcgtgcactatgaagggggtaacattctagccccggtctcaaatagctctgggctcaaactacatttctcttgccctcacattttcctaagaaatgccaagtatataatgagtttgttccctgtatggtgtggataaaacccacagagggatccaggaaaatcccctgatgagaagccacctagcaatttcctagggatggagagaacttctggagcttctttctatgtatcctgccttggttatcatatatgctggctttattactgaggtttcactggggacctggacgcggttaggtgaccatgggcaaggtggcgtttatctggatatccttttctcctcaaccttattcctccctatcaaggcccaactcctgggaaacatctctccgctgcatggcccggaaccccactgtccagcagatagagccaatccagtaccccagagaggatctcagccacctgggactgtggcagctactgtccttctgtgctcccgctttctccagggcttcagggatgatggtgcaggtagcactagagatctgagagcagtgggggttggcagttggtgcctgaagggagctttagaaacactcctagatgcagatatgggtgaacgaggagcctagacctcagagctgaggtccagtctgacctcttttcactttcaattttatcttggctcatcaaaacacacagaaagcagcaaggctgtttatgtttacctccaacctttggggtgttccttgattgtgttgagcaaacctgaaataagctacattcaaggtcatccaagccgcaaatgatcaatgcagtgaatttcaaacagttcagagcaaagaggcatctccattggtctggctccactgattaggatgacctcaaatctcactcttttggtctgaaaggatgatgcttttgtatctccaaagagtcatttcaggaacttaaaaggcagtcgagtgaaaagacccctctcactttagtatcaggaacatctgaaattaaatcattgctccatcatttattagtgatgagggcctctatttcttaagtgtaaaatatagttagtaggatgcatcatgcaacactcttacagattgtagatgatctatacacacacacacacacacacacacacacgtatagtggcacatagttggcagaagctatgattgttattattataattactgttacgtgcattctttggaaactattaagagacaggtgagtcaaattcagttttgcaatctttgaatgctcttttattatttgtcctacggtgcaattcaaaataaaatgactggtactggggacctgtcattgtactgggagctgcattgcactgtcttctgcaacaagatttgccctgtgaggcccacatcctgccccctccactgagagtctgtgaggcttttgtttatggtttttgtctgatgtaagaaaatttgaagtcaaaacgagtcatatgcacccagtcaagacccagcagctcctgggcttccaggatacagatgggcagtactcctggcctccctactccaggggcatcatggacataggatctggactctgtgactgatcaaccctgtaatctcagggaagtggattaaattctctaaatttcagctcctcatctgtaaaaaggggctaattatagtatagttatgagaattaaatgagataatttacataaagtacctaatgcacacatagcaatcgtaagcagtctcttccagatgggaagagctctcttttagaaaacctcaaaccaacctcacatcaactcagcctgaatctgcctaaagaatccacctgacccaaccttctcatgtccaggatccctagccctgcatgctccatagctgcctctccacaaggtgcaagtgcttggctgatggaggtctaagcagagaacccccatgacctgcaccaagcagcctctctccttccagtgtctgcatattctgtatcctctgggttttcagagcttgcttcagctttcttccgcccctccaggctatgcttatgctccttttttgtctctaacattttctacttattttcccacccagaattcctggtggagtctgggtcccaaacccatctgttttggtctagaatttcaaaagtgctctccagagcctcggaagccctggaatctgggaatccaagctagggtcacccagaagacacccacagggtccctacaagaaaattaactgccttggccaaataccagcttcctagatgccttggtaacaatgtttatcaggaatatgatcttgcctaagatgaggaaatcaggaactgtattagtaccaccagctattcccacccccaaacctggccaaaccaaagtcaatctgagatgccatggacaataagggtgaggtagaggtaggagaagctcctttagttcccgacactgctatgagagttctcaaacattcagaaaagttggagcatttaccctgaacattcataggcctactacctagattctaacacaaacgttttactttgcttgctttatcactcgcctgcccatctaaccatccctctacccacccatatttttaaaaatatgctcctttttacttcattggctcttcacaatttgcagcaacctgctttcatttcatttttaccatatcccttgaagaaaatggtgcaggtatgagcatttcaatcttttagataagattcactgaaaaattcagaaatgtacccaaagtcacaaggctaattcctctactggaacagaaacccagaagatctgtttcacagattgttgtggctgcttttaagggagacagtgtttggggaatggaggaattaatgactgtgctaggcaattgacctagaagaaggaggacaagaatctcatttcatttctcagcatctgacatttatgcccaatgtatattcacagagtgaaagaaagaaggctagctcaaggagtctagctgctcctccaagtccctcttctatctctgcaggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatggtgagttccagagagcttctgtgttttgatcttttcttttttttatttgtgcaaatttatggggtatgtgtgaaattttgttatatgtatatagtgcatactgatcaagtcagagttttcagtgtgtctgctgcctgagtacaatatattcctgttaagtatagtcaccctactctgctatcaaaaattgaattgattttctctatcttactgtatgtttgtaccctttaacccacttctcttcatcatccccccaccacccactccccacactcacccttctcagtctctgctatctatctttccaccatccacttccacatgatcaaaatttttagtaccaacatataagtgagaacatgcgatatgtgtctttttgtgcctagcttatttaacttaagataatgacctccagtttcagccacattgctgcaaaagacatgatttcattcttttttatggatttttaaattgtttaaatatatttagggggtacaagtgtagatttattgcatgcacatattgcatgctggggaagtctgggcttttagtgcacccatcacccaaagagtgaccattgtactcaatagataatttttcagccctcactcctctcccaccctcctacctcttgtaggctccgctatccattattcctactctgtatgtccatgtgtacccattgcttccacttataggtgagaacgtgtggtattttactttctgtttctgagttatttcagctaggataatggcctccagtttcatccatggtgctgcaaaagacatgacttcattcttttgtggctgattagtattccatgatgtgtataaatacatgtatgtatgtgtatactgcattttctttatccattcttccgctaagggacacagattaattctatatctttgctattgagaatagtgctgcaataaacatacaaatgcaggtattccttgcatatatcaatttcttttcttttcctttgggtagatatccagtagtggtattactggatcaaatgctaattaaatgtttagttttttgagaaatcttcatattgttttgcatagtggctgtactggtttccatccccaccaagagtgtctaagatttccccttttctccacatcctgccaacatgtggttagtgtttaaataacagccattctgactggagtgagataatatctcattgtgattttgatttgtatttctcagataattggtgatattgagcatttttaatatatctgttggtcatgtgtatgtcttcttttgagaaatgtctgtatcctttgcccactttttaatagaattattcgttttttcttgttgagttatttgagttccttgtatgttctggatattacttccctgtcagatgaatagtttacaaatatatctgccattcaactcgttgtctcttcactctgttgattatttcttttgctgtgcaaaagcttgttagtttaaatcccgtttgtctatttttgtttttgttacctgtgcttttgaggtcttagtcataaatttatttgtccagaccaatgtccaggagagttttccctaggttttcttctagtatttttatagtttcaggtcttacattcaagtcttttaactgattttgaggaggttttttatatgatgagaaataggggttcaacttcattcttctgcatgtgactattcaattttcccagcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccgccgcctcccatggcacgtcgggaacaccggagccgccaacttggagactcctggtctgtgaagagccgctgacgcccgcaggaaccgggctgggccttgtgtgccagtggggtttgtgcttggtctttctccgcttggatttgcttatttattgcattgctggtagagactcccaagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaataaaaataaataaataaataaataaataaaaagtatcttttctcccca

SEQ ID NO: 3276 - DNA, 32182 bp, Homo sapiens
  source 1..32182: mol_type = genomic DNA
acatacacatacacatgcacacacacactcatatacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggtaagtccactttatggccaccacttcttgctactgcggttcttctgaggccagttgcattccctgcctgggagattcttttttttgttttttgttttttttaacggagtctcactctgttgccaggctggagtgaagtggcgcaatctcggctcactgcaacctccacctcctgggttcaagcgattctcctacctcagcctcttgagtagctgggattacaggtgcatgccaacacacccagctaatctttgtatttttagtaggggcagggtttcactatgttggccacggtggtctcgatctcttgacctcgtgatctgcccagctcagccacctgaagtgctgggattacaggcgtgagcccagttcttgttggtaaaatcgggaaactcatctccttgccagaaattactttgcatgtgtgcatattcgtgcactatgaagggggtaacattctagccccggtctcaaatagctctgggctcaaactacatttctcttgccctcacattttcctaagaaatgccaagtatataatgagtttgttccctgtatggtgtggataaaacccacagagggatccaggaaaatcccctgatgagaagccacctagcaatttcctagggatggagagaacttctggagcttctttctatgtatcctgccttggttatcatatatgctggctttattactgaggtttcactggggacctggacgcggttaggtgaccatgggcaaggtggcgtttatctggatatccttttctcctcaaccttattcctccctatcaaggcccaactcctgggaaacatctctccgctgcatggcccggaaccccactgtccagcagatagagccaatccagtaccccagagaggatctcagccacctgggactgtggcagctactgtccttctgtgctcccgctttctccagggcttcagggatgatggtgcaggtagcactagagatctgagagcagtgggggttggcagttggtgcctgaagggagctttagaaacactcctagatgcagatatgggtgaacgaggagcctagacctcagagctgaggtccagtctgacctcttttcactttcaattttatcttggctcatcaaaacacacagaaagcagcaaggctgtttatgtttacctccaacctttggggtgttccttgattgtgttgagcaaacctgaaataagctacattcaaggtcatccaagccgcaaatgatcaatgcagtgaatttcaaacagttcagagcaaagaggcatctccattggtctggctccactgattaggatgacctcaaatctcactcttttggtctgaaaggatgatgcttttgtatctccaaagagtcatttcaggaacttaaaaggcagtcgagtgaaaagacccctctcactttagtatcaggaacatctgaaattaaatcattgctccatcatttattagtgatgagggcctctatttcttaagtgtaaaatatagttagtaggatgcatcatgcaacactcttacagattgtagatgatctatacacacacacacacacacacacacacacgtatagtggcacatagttggcagaagctatgattgttattattataattactgttacgtgcattctttggaaactattaagagacaggtgagtcaaattcagttttgcaatctttgaatgctcttttattatttgtcctacggtgcaattcaaaataaaatgactggtactggggacctgtcattgtactgggagctgcattgcactgtcttctgcaacaagatttgccctgtgaggcccacatcctgccccctccactgagagtctgtgaggcttttgtttatggtttttgtctgatgtaagaaaatttgaagtcaaaacgagtcatatgcacccagtcaagacccagcagctcctgggcttccaggatacagatgggcagtactcctggcctccctactccaggggcatcatggacataggatctggactctgtgactgatcaaccctgtaatctcagggaagtggattaaattctctaaatttcagctcctcatctgtaaaaaggggctaattatagtatagttatgagaattaaatgagataatttacataaagtacctaatgcacacatagcaatcgtaagcagtctcttccagatgggaagagctctcttttagaaaacctcaaaccaacctcacatcaactcagcctgaatctgcctaaagaatccacctgacccaaccttctcatgtccaggatccctagccctgcatgctccatagctgcctctccacaaggtgcaagtgcttggctgatggaggtctaagcagagaacccccatgacctgcaccaagcagcctctctccttccagtgtctgcatattctgtatcctctgggttttcagagcttgcttcagctttcttccgcccctccaggctatgcttatgctccttttttgtctctaacattttctacttattttcccacccagaattcctggtggagtctgggtcccaaacccatctgttttggtctagaatttcaaaagtgctctccagagcctcggaagccctggaatctgggaatccaagctagggtcacccagaagacacccacagggtccctacaagaaaattaactgccttggccaaataccagcttcctagatgccttggtaacaatgtttatcaggaatatgatcttgcctaagatgaggaaatcaggaactgtattagtaccaccagctattcccacccccaaacctggccaaaccaaagtcaatctgagatgccatggacaataagggtgaggtagaggtaggagaagctcctttagttcccgacactgctatgagagttctcaaacattcagaaaagttggagcatttaccctgaacattcataggcctactacctagattctaacacaaacgttttactttgcttgctttatcactcgcctgcccatctaaccatccctctacccacccatatttttaaaaatatgctcctttttacttcattggctcttcacaatttgcagcaacctgctttcatttcatttttaccatatcccttgaagaaaatggtgcaggtatgagcatttcaatcttttagataagattcactgaaaaattcagaaatgtacccaaagtcacaaggctaattcctctactggaacagaaacccagaagatctgtttcacagattgttgtggctgcttttaagggagacagtgtttggggaatggaggaattaatgactgtgctaggcaattgacctagaagaaggaggacaagaatctcatttcatttctcagcatctgacatttatgcccaatgtatattcacagagtgaaagaaagaaggctagctcaaggagtctagctgctcctccaagtccctcttctatctctgcaggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatggtgagttccagagagcttctgtgttttgatcttttcttttttttatttgtgcaaatttatggggtatgtgtgaaattttgttatatgtatatagtgcatactgatcaagtcagagttttcagtgtgtctgctgcctgagtacaatatattcctgttaagtatagtcaccctactctgctatcaaaaattgaattgattttctctatcttactgtatgtttgtaccctttaacccacttctcttcatcatccccccaccacccactccccacactcacccttctcagtctctgctatctatctttccaccatccacttccacatgatcaaaatttttagtaccaacatataagtgagaacatgcgatatgtgtctttttgtgcctagcttatttaacttaagataatgacctccagtttcagccacattgctgcaaaagacatgatttcattcttttttatggatttttaaattgtttaaatatatttagggggtacaagtgtagatttattgcatgcacatattgcatgctggggaagtctgggcttttagtgcacccatcacccaaagagtgaccattgtactcaatagataatttttcagccctcactcctctcccaccctcctacctcttgtaggctccgctatccattattcctactctgtatgtccatgtgtacccattgcttccacttataggtgagaacgtgtggtattttactttctgtttctgagttatttcagctaggataatggcctccagtttcatccatggtgctgcaaaagacatgacttcattcttttgtggctgattagtattccatgatgtgtataaatacatgtatgtatgtgtatactgcattttctttatccattcttccgctaagggacacagattaattctatatctttgctattgagaatagtgctgcaataaacatacaaatgcaggtattccttgcatatatcaatttcttttcttttcctttgggtagatatccagtagtggtattactggatcaaatgctaattaaatgtttagttttttgagaaatcttcatattgttttgcatagtggctgtactggtttccatccccaccaagagtgtctaagatttccccttttctccacatcctgccaacatgtggttagtgtttaaataacagccattctgactggagtgagataatatctcattgtgattttgatttgtatttctcagataattggtgatattgagcatttttaatatatctgttggtcatgtgtatgtcttcttttgagaaatgtctgtatcctttgcccactttttaatagaattattcgttttttcttgttgagttatttgagttccttgtatgttctggatattacttccctgtcagatgaatagtttacaaatatatctgccattcaactcgttgtctcttcactctgttgattatttcttttgctgtgcaaaagcttgttagtttaaatcccgtttgtctatttttgtttttgttacctgtgcttttgaggtcttagtcataaatttatttgtccagaccaatgtccaggagagttttccctaggttttcttctagtatttttatagtttcaggtcttacattcaagtcttttaactgattttgaggaggttttttatatgatgagaaataggggttcaacttcattcttctgcatgtgactattcaattttcccagcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccgccgcctcccatggcacgtcgggaacaccggagccgccaacttggagactcctggtctgtgaagagccgctgacgcccgcaggaaccgggctgggccttgtgtgccagtggggtttgtgcttggtctttctccgcttggatttgcttatttattgcattgctggtagagactcccaagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaataaaaataaataaataaataaataaataaaaagtatcttttctccccagtgtaagtttttgttggatttgtcaaaggtcaattggctataaacctgtggctttatttctgtgttctctattctgttccattggtctatgtgtctatttttataacaccatgctgttttggttgctatagccatatacagtatactgaagtcgagtaatgtgatgcctctagctttgttctttttgcttagcattgctatgactattcatggtcttttgtgcttccgtatatattttaggatttttttttctggccaggcacagtgattcatgcccgtaatcccaacactttgggaggctgaggcaggcagatctcttgaggtcaggagttcgagaccagactggctaacatggtgaaaccccgtctatactaaaaatacaaaaattagacaggggtggtgatgggcacctgtaatcccagctactcggaagtctgaggcgggagaatcactttaatctgggaggcagaggttgcagtgagccaagatcacgccactgaatgccagcctgggtgacaaagtgaaaaccgtgtctaaaaaaaaatttttttttttaaaaagtattgtttttctaatctgagaagaataaggttggtattttgatactgattgccttgaatctgtagattctttgggcaatatggtcattttaacaatattgattcttctggtccatgagcatgggatatttctccatttgtttgtgtcatctatgattttttcatcagtgttttgtagtttgccttgtagagatctttcacctccttggttatacttgttcctagggttttttaatagctattataaaccggattcacttctttatttctttcttgattaaataattattggtgtatagaaatgctactgatttttgtacactgatttctatcctgcaactttaatgaattcatttatcaaatctaagagttttttggtggagtctttaggtttctctagttataagatcatatcctcaggctaagcgtggtggctcacacctgtaatcctagcactttgggagaccaaggcaggtggattgcttgagctcggaagttcaagaccagcctgagcaacatggcaaaaccccatctctacaaaaaaatacaaaaattagctgggcatggtggcatgtgcctgtagtatcagctactctggaggctgaggtgggaggattgcttgaatcccaggaggctgaggctgcagtgagtcatgactataccactgcactacagcctgggtgaaaaaatgagaccctgtctcaaaaaaaaaattacatcatcagcaaagaggaacaatttgtctttctcttttacactttgaatgttttttatttctttattttgcctaatttctctgagtagaactttcagtactatgttgaataaaagtagtgaaagtgggtatccttatcttgttcgagttctcagaagaaaggctttcagcttttccccatttggtacaatgctaattgtggaattgtcatatatgggctttactattttgaggtatattccttctatgcctagtttgttgagaaattttttcaggaagggatttggactgtatcaagtgctctttctataaccattgagatgatcatatggtttttatccttcagtctattgatgtgatgtatcacatttattgatttacatacgttaaaccatccttgcatccctgggataaatcccacttgatcatgtattatctttttgatatgctgttggattctgtttgctagtattttgctgaggattgttgcatctatgttcatcaggaatattggcctgtagttttctttttgttgttgtgtccttgtctgattttggtattagcataatgctggcctcatcgaatgagttaaggaaaattccccccactttgatttttaagaatagttttaggaggattgatattagttattatttgtatatttggtagaatttggctgtgactccatcagtctcgggcttttctctgttgggagacttttttattacagattaatttcactacttgtcgttggtgtctgttcagattttctattttttactgattcagtcttggtaggttgtatgtttctaggaatttatccattttctctaggcttttcagtttgtcagagtatagttgttcataatagtctctgacggtcttttggattttggtcttttgtattcctgtaatgtcagttgtaatgtctccactttttctgattttgtttatttgggtcttctttcttcttttcttaattagcctagctagcaggttattaattttgtctgtcttttcaaagagctaactttttctttcattgattctttgcatttttttagtccctacttcatcgagttttgctctgatatttattatttcttttcttctactaattttgggcttagtttgttcttgcttttctagctccttaaagttcattgttacattattaatttgtgatctttatacatttttcatgtaggcatttatttctataaacttccctcagcactgcttttgctgtactccatagcttttggtatgttgtgttttttttttcatttgtttcaagaactttttttaaatttccatcttaatttctttgttgacccaatggtcaggagcatgttgtttaatttccatgtatttgtatcatttccaaagttcctgttaatattgatttctagttttattccattgggattgaaaagatatttgatatgatttcaattttttaaaatttgttgagacttgtactgtggtctaacaaatagtttatcctggagaatgcttcatctactaatgaaaagaatgtatattctgcaactgttggatagaatgttctgtaaatatctgttaggtccatttggtccaaactccaatttaaatccaatgtttctttgttgattttccatctagaagctctgtctaatgctgagagtggagtgctgaagtcctccactactattctgttgcagtctctctctctctgtctcacacacacacacacacacacacacacacacacacacacactcttactctcactctctctctggtaatatttgctttatgaatttgggtgctccagtgttgggtgcatatacatttagagttgttatatcctcttgctggattgatcccttcatcattacataatggcattctttgtcttttttttttttttttttttttactgtttttgacttaaagtttgtttatttgatataaatatagctagctattcctgcttgcttttggtttccatttgcatggaattgtttttccatttctttacttgtagtctatatatctttactgttaaggtgaattttcatgtaattaacatatagatggatcatgtttttaaatccattccaccattctacatcttttaaatggataatttaatccatttacattcagagttactattgatatgtgaagctttttcctgtatactgttaattattttctggttgtctcatatattctttgtttctttctctcttattgtttgtcactgtggtttggtgggtatctgtagtgacatcattcaagtcctttctcttcaccctttgtgtgattgctttacaaatgagttttatacttctgtgtgtttccatcatggtaaatgtcatcttttgcttctgggtttaggattcccttgagcatttcttgtaagaccccatctagtggtaacaaattctctcagcatttgcttgtctgggaaacgctatttctccttttttatgaagaataattttcccagatatagtatttttggttgactctttgaatatattattccattttcttctggcctgcaaagtttctgctgaggaatccaccattagcctgctgggctttcatttataggtggctagatgtttttctcttactgtttttatgatttactctttgactttagatagtttgactgtgatgtgtcatggagatctttttgcattgtattttcctgggaattgctgagcctcctgtatctggatgtctaagagtcttgctagacttggggagttttctgctattgtttcattaaatacattttctaatcagctctttgtctctttgccctcagggatgaaataatttgaatattttatcactttatgaagtcccaaatgtaacaaaggtttagctcattcttttttattctttttatttatttattttttgtttggctgaattatttcaaaagacctgtcttcaagttgtgagattctttcttcagcctaatctagtttattgttgaagctttcaagtatattttgtatttccttcagtgaaatcttcaattccagaattctattcattctgttttttaaatatctatctctttggttaatttgtcattcatatccaaaattgtttttctgatttctttgtattgtttttcagaattctcttgtatctcactgagcttcttcttatttttttaagttactttcatggggaggtctttttcctgaatatgtgtctattgtgttgttggggtagggcactctggctttgattctgggtgcatgcagtagtatagtatttgtatgatttatttggctgtaaataacattagtggtatctgtgatttcctcagtaggtcagagtgtgtttattagcagaggctgtggtgaagttgcgctgaggattgaaatgtcaagtgggccagtcatcaggccacagtggtggcagcatacctatctttgtgcctcaaggcagtgtatgctgtcacttgtgtttatgcttatcagcaggtcgatttttaggtctccaggtggcttgctcagataccgataatggcagcagtggactgaagggtggtgagcaggctctcaggccccctggcagtcagtgtggcatggggaatgacagtagtgggatgattctctgggtcccaagcagtgtgcattgatgttgatggtggctgcaatggcctgggcagaccagtctccaggaccacaggtggcacttgcaggtaggtggtagtggctgggagttaggcccaccctaggcccctgtggaaaaatgctcaggtgcccaaggcagtggattgggttgggcaatccccaagatgctggcctatgtgttctctttccaagggggaagggggaagccaggctgagtgggcttgcactcaggccccccagtggtgaaagcaaacaccagctatggtatgtggaagcagggccatcctcaggccccaggcagagtgctcaggtgaggacagtagccgccaccgtgaggccctgccactggagaaggtgaggccaggttcagtggccacagccttggatggcagatggggaatatgcatccctctcagcctcagtcctaggagggcttcccccaagccagcactagctgcaggagcttttgcccagcttgcaaccaagttgcagcagcagctcacagcccactactttacccagtctcagtcacagcagcattcacttcctaggaccagaaactgcagcccacacctctcttgctacttagctctacctgcagagtgctcccaatccatactctagtcttggcagcaacagttttagttttcctaacacctcagacccagcactgttgggccccaggacagcgtgcattctgccaaaggctcagtttgaaaatggtcccttactataactgcagaggtctcagaaagagtatggaacccagcaggagctccctccctggagcagttccgccccacagtctcccagcagctccctatggtagtttcagggattgggagggtcaaaggggtctcatgtggccaggactgcatgattctgcagtgggatgtgggccactggaggtctctcgctcacctctattgggaaatcactcccagctcccagcagatctcagccagggaggctgtctctgttccttctccttccctgcttttagtgtttcctgtcacatctctgttgaattccagcattctcccttggaaaatgtatttgaaatatgactgtttgtatactacttttgttcttctaagtagaggaggtaggcattaaatgcttctagtcagccatttcgaagccccttctcttgatcttttatttttaaaaacagacattctttttctccaggaatttctctctctaggataaatatgactactatattgatcgtttttcacctaattccatatacacagatgtcaaaattagaagacacacccgtaaattccttacatgttatataatcgccataattcatgtaacgggtctcctacttgtagaaatattgtttctgcttatagaaatattgtttccaatatttcctcttataaacaatgctgcaatgaatattcttgtgcacctatcttttcacgcttatgtgactaggttatattctgatggataaatctagaatatatatatggggtcaaattactgaatctaatggtatatgcattctttttttttttgagacatcatcccactacatcacctaggcttgcctccaattcctgggctcaagtgatcctcctgcctctatcttccaagtagctgggactacaggtacttgccaccatgcccagcttttaaatcctgaatttattattattattattattattattattactactactattaccagtatttcatagagacatagtctcattttgttgtccaggctagtcgcaaactcctggactcaagctgtccccttccctcaacctcccaagtagctgggactacaggcatgtgccaccatgcctggctttaaaatcctcaatttttatttattattattttattttgtagagactggttctcactatgttgcccaggctgattccaaactcctggcctcaaacaatccttccacctcagcctccaaagaagctggtattacaggcaccactgcacctagcttagtatatacatttttaatgttgctagatattgctgaatttccctccgtgttatcaagtaatcctcccaccagcaatgtttgagagacaccatttccttatattctcaataacaaagtattgtcaaacatttctttgttgataaattgagtagttacaatagtatttcatggcttaaatttatatttttcttatgaatgagatgagcatctcttcatgttttatgttttatgtttgttttgatagacagtcttgctctgttgcccaggctggagtgcagtggtgcaatctcagctcactgcaacctccaccttctgagtccaaacaattcacccgtcttggcccccgaggaagttgggattacaggcatgcaccacatgcctggctaatttttgtattgttagtagagacagggttttgccatgttggccaggctgatcttgaactcctggcctcaagcaattcactctcctcagcctcccaaagtgctaggattataggcgtgagccactgtgtctagccatcttttcatgtattgaatagccatttgtattctcttttctgtaactctctattaatattctttactcatctgtattagtgtgatagggatgccataacagaatatcccagaatagatggcttacacaacagaaatttatttctcacaattctggagactagaaatccaagttcaaggtgttggcaggttcggtttttcctgggacctctctcttcggcttgtagttggccaccttttcactgtgcccccacagtcattcctttgtctgtgttgtctatgtcctaatctcttcttataagcacatcggtcatactgtattagggttcaccctaacaattccattttaacttaattacctctttagatgccctgtctccaaatacagtcacattcagaggtactcgggattagaacttctacatatgaatgttgtgggaggacagaattcagccctaacattctaccctctggcctctcaaaattcatgtccttctcacatgcaaaatacattcaccacattccaacaataccagaagttttaacccattccagcatcaactgtaagtccaaaatccatctaaatattatttaaatcaggtatgggtgagacttgagatatgattcaccctgaggcaaaattcttcttcagttgtgaacctgcaaaaccagagaagttatctgcctccaaaattcaatggtggaacaggtatggaatagacattgccattccaaaagagagacattgggaagaagaaaaaagtcacaggtcccaaacaagtccaaaacctaacagggtaaattccattagattttaaggctcaagcataatactctttggctcagtgctctatcctctgggcccactggagtagcagccccacctccttggccctgagcggcagttctgccccctggaaccaaggaggaaaccacctcaccctacccaaggcttgtgccctctaggcctatggtggcagtggcagctctgcctacttctgaactgcctgtggggtcactcttcccttttcttgaaggataatacatatttgcagctgtacagctgtattgacttatttcataaaatcccagaagcctgacacactccttcatttgtcctgtctctgtcccttacagtccagactggcagcatttctgctgaggtggtcaaatctcataacctctttagcaaacattgccaagccacaatctttgtgttctctccagacacactttctcgtttttcgcaatatgaataggtgacattttttcaaagctttaagttctggctccatcttgcttgacaattccttatttaacctctctctctcttctcacattttatataagtagcaaggagaaactaggcagtgccttcagctctttgattagaaatctccacagctaagtacccaaatttatcacttaaacattctgctttccacaaaacactagaatacaacgtggccgagttctttgccactttacaacaagtatgccctttcctccagtttccagtaacatatttctaatttctgtctgagacctcaccagcaacacatttaatatttatatttttaccaacattctgctcatgatcacatatgtatatctctaaggtaatagcagcattccctgcagtgttcctattttctttctgagtgctcacccaaattttcgttaacattcatgtttctacccagagtctcttgaagacaatctaggatttttctagcacacacctcaaaattcttccaatctccacccatcagcccattccaaagccacttcacatttttagatttttagagcttcatcccacttctggtatcaaaatctgtgttagttttctagggctgccataacaaaatactgcagactgactagcttaaacaacagaaacgtattccacatttctccagaacacaattctggaggccaatgaaggtatcagcggcttggtttcttctgcggcctctctccttggctcccacatggccactttctctccatgtcttcacatgggtgtccctctgtctatattgtctgtgctctaatctcatcttcttataaggataccactcatatcagactagggcccaccctaatggccccattttaacttaattacttctatctccaaatatagttctatcttcaaatacggtcacattctgaggtgctagaggttaagacttcaacatctaaactttgcagagacacagtttagctcataacaccatctttctatcagataatttgaccgttttcattgatttgtagggtattctgtatctattaaggaaacggaattctgtgcagttaatagaattagaatgaatcaactccacatgtgttgacaaatgacgtacaataatttccaagatatattgttaattttttaaggttcaaaacagtgtgtaaagtatgcatatatctgtctatatctagaatacctctggaaagatcaacaagaaacccataacagtaattgcctccaggaatagtaattcttggggagatgaaataaatggctggaggctagaaagcttacttttttcattatgtagctttggtattttctcaattttttttaatgtattacctattcaaaagaagaaatattgggccaggtgcagtggctcatgcctgtaatcccagcactttgggaggccaaggcagacagatcacctgaggtcaggagttcgagaccagcctggccaactggtgaaacttcatctctactaaaaatacaaaaattagccgggtgtggtgctgtgtgcctgtaatcccagctactcaggaggctgaggcaggagaatcgcttgaacccaggaggcagaggttgcagtgagcagtgatcacgccactgcactctagcctgggtaacagagtgagactctgtctcaaaaaagaaatataacttaatgaaacattcacacatgtgcacatacatggtgagcagtggagatggaacaaaaggaaaggagaagacaaggaagaagatctagaagcacaatgcatcctaaattcagaccaaagacacgggcaactcaaattctagaagcagaggtccccactccatagcgtttggggctgggccattcacctatttattcattgaacattcatgagtgtttttcataaggcaggctgggtgttagatgttcagacacaggaatcagccctgtcatcaaggagttcttacactggtcggggagagagagaagtaatcagactattagtcatgctgagtcatggtgataacacctgtagcggatgttatgggagtacagaggagaggctgtcaacccagcctgcagagaagatgtccctgcgacaggtaacgctggcctctctctgctgcccccaactcccctattgtcactcccttcttctctcagcgctttcctgctggcaaaaggatctgagcatcttcccatgctgttgtccctgcagagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacaggtaactggctccaacttggcccttgagggaattccagaaacaatatgagcagctgtggagtctaaaccctaggatcctggtcagacacacagggggtggggaagcaagaggacaggccccaaaaccccttattctctactctcagggacatgacagaggctggcaggacttgggaaagcccagaacactgtgatactctaaggttagagcaagggaggagaagacaatatggatacaggagtccagattggtctttgcttgggtggaggtgtttccgggtaccctcagaagggcagagaggggacatgagagtccaagtattcagtgggcacagcccagtggaacaggtggtcatggagaagtagcaggcatgcccctcagaggaggaggccaggagaaagaggaagaggaggagggacttcagtcccctcagtcccctttaggatgcctgggggccaagggagtagggacagtgactgaagctgcaatgtctcatctgtgaccccagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgtgagtctctgggcagggcacccatcaccagattccttctctgaaagctttctcctctgctgccttctccaccttccgcttctccaagggtcttccctcatactgaaatgcctcagaccactaggacagctgttcagttcacaccagttgattcataggaggcaaactcatgactagctgctggacaagtctacccgccaaagtgcccctggctctaggctgccagttaggcctccaccacccaactttaggtgcttgccccggtccttctgcactgagtgtcagaagggactaggaggccaggtgcggtggctcacacctataatcccggtactttgggaggctgaggcaggtgaatcacctgaggtcaggaatttgagaccaggctggccaacatggtaaaccccgtctctactaaaaacacaaaaattagctgggttcggtggtgggcgcctgtaatccaagctactctagaggctgaggcaggaaaatcgctcgaaccccaaggggcggaggtttcagtgagccgagatcatgccacttcactccagcctgagagaaagagcaagactccgtctaaaaaaaacaaaacaaaacaaaacaaagggactgggaactcaccaacctgcatttttaaatttttgagatggagtcatgctctgtcacccaggctggagtacagtggcacgatctcagctcactgcaacctctgactaccaagttcaagggattcttctgcctcagcctcccaagtagctgggactacaggcacacgccaccacaaccagctaatttttgtacttttagtagagatagggttttgccatattggccaggcaagtctcaaactcctgacctcaggtgatccgctgcctcagcctcccaaagtgctgggattacaggcatgagccatggcacctggccccaacctgcatttttataaactattatcattttgaataaggccaaagttggctggggtgaaatcagagaagactgaggagaagcccttggtgtccaaagacactgtggcctccaagaaggtgggccactcagttcccctgggggtgaggaacagaatttgcattctacctcctcagccctgggcctcacaggagcttggcttggcaatttgcatggtttatgtttacctgttccttcacttgtgccattcagacatggtcagcataccccctgcctgagtttgtcaatgtctaggtatctgtgaagagtcactatcatggttttgttaaaatatgaagcaagtcggccaagtccatgcctattgcacacaatgcctcaaatataaaggaacccacaaggttaagtaaaaataataaacaggaaacaaatagagtcagtcttattgtttcttttaaagttgctaacatttattgaacatttactctgtgtcaggtacagcgctcacctctctgcatcccttatctcatataagtaaacaaatcagcctcaaagccaagccttgaagggtcttcacagcacatggaagtgttgcgctcatctgtgttgattggtttgcttgctttcacagctgtaactaactgtatagaatgaggttgtgtctttctttcttcacttttcatcatttcccttgtttctcacctgagcatcaagaggcaaagaggtgtgtctgagatgtcacaagtagtgaggaaaatgccaggtatactccaaaattcctgtggctcctggaggcactttgccggcagtatcaacactcagcttcatgaatatattttcaatgaatgaagacaggtgactgctcagggggcaggcctgattccacatggagtctgcctctctcctcacaggcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggtttctctccatctctatttactcaggtcacaggaccttggggcctccaagagtttgcatcctgactgattctttatgaagtgcagtaagaggctgtgggtgagagccctttagagtggcatgcttccacagatatatgagagtcacgcatgtgattttaatgttctaatagccacgttagaaaaagcaagaagaaataaagttattttaataatatgttttatttaactgaatatatccaaaatatcattattcaacgtgtattcaatacaaaaaaattcattagacactacattttattttgtactaagtctttgagagccagtatgtattttacacttagagcacgtctcgattccgatgctaaattttcactgaaagtgtttaatctatattcagacttcgtaaaatttacagttgaaaaaatagatttatgcacccaagttattccaagcatatttatcagtttttcaagaaggaattgagtagccatttttaaatttaaactaaaactaaataaaagaagcaatttggtgtctcagtaatactagccacacttcaagggcttatgcatagcttgtggctaccatattgaacagcacagagttacaggcttgtggagaaaagccaataggaagctgatatggaaagggatgtggaccacacaggaacaaaggctgcgtgagtgggagctagaaaagaagccccagtggcccttaataaatgctaagtactattctaggccttcaggcatttttgcacaatcttcgcaacaatcctacagagtagatattctcgtttttcccctttatatggataaagaaactgaggctcagaaaagataagggacttatccaaggtcacaccataaaagctggtttcgaaccctgagctctatcttctgctcttccgtagaaggaagcagaaaaaaggtacggtctacccaggatctgacaatgttgggtcagattgtgtctggcagacagatctagagtccagcttaacaggaatctggaactcccctcatatcatttacagcggggcagtgtaatgtggcgattaagggcgctgtaggatctgcactcgaacctcaggtcagacacttgaaacactgtgacactgggcaagccgtaaacctctctacccagggactgtctgcctcaggtactgctataacctcttgcctagagtaatgcttgctcgaaaaatggttgtagaatgaatgaaaagaaagactttccacaacgtcatggattttaaggggcaggtaggatggccatcatgttctgtgcattgtttgctccagtgtgtcttgtcattatttgaattaacatcactcatttcctcctcaaaggacctgagagaaacacaaagctttggattgggttgttcctgatggtttgccttctgtgcgttgggatcttcagctggtgcatttggaagcgaaaaggacggtgtgagtttccgagatcaatgttgtccgccagtgctaggccatttccctgggacttgtggaggcttctctgccctcacacaatcccgtgctacccctccctgccagcatcttatttcttctcagagcaatgggggaggggtgtcagttgggactctttactcacaaataatagaagcccagttcaaactggcttagacagaaaaaaaaaggcatgtgggagcagggagagtgatttattattttttcacttaaataatcaatctgtggggaaggcagggatagagctggcataatggagaaatgtcaccagaggctcaaaagtcatcagagctctccacctttcatctctactgtgtattttgagtcagcttaactcttcctactgcagcccgctgagggaaggggtgggagcgaggggaggagtgtaccacaacacaacagctggcagctccagacccacacatactaacagctccgacaccagacagggaagaaaatgtgcttccctctaactccaatttaaagaatgtcagaaatagctctgattggcccaagttaaggtcatgtggctgctgcttggaccaatttctatagccaagaagatacactattatgattggcagctcctctagaatcccagtattggagtggaaatgaagtagtagccaaaaagagcagaatgggtagaacacatggggtccctggaagaattactgaattgcaggcaaactactctgatcagtggctatggcagaggagctctctcttctggagggatggcaggaagctccagagcctccacctctgcagaaagtagccctagactctggccaccccttcacataggcctggcttctcatcagggttcatcctccttcctgaagccttttccctgtctatgtcccagaagtctctccccttctcatttgactctcacagaataaaagacacctctcacctcacagccctcttgataaaccttctctaactttgtttctcaggttcagtcccagccttctgttccagccaagctgaggccccagcggatacaccaggtaacatcacccatgacacaggctatggggtatctggtccaaatggaagttctaaagtcttgctgctcaaagtgtggtctgctggccagcagtgtgggcatcacccaggaaacttgttagaaatgcaaaatctgaccaggtgccgtggctcacacctgtaatcccagcacttcgggaggctgaggcaggtagatcacttgaggccaggagttcaagaccagcctggccaacaaagtgaaaccctgtctctactaaaaatagaaaaaattatctgggcatggtggtgcacgcctgtaatcccagctactcgggaggctgaggcatgagaatctatttaacctgggaggtggaggttgcagtcagcctagatcacgccactgcactacagtctgggcaacagggcaagactctgtctcaaaaaaaaaaaaaaaaaacagaaagagaaagaaagagagagaaagaaaggaaggaaggaaggaagggagggagggagggagggagggagggaatcttgggcatcaccccagaatactgattccaaacctgtattttaacaagatccataagtgattcatatgcctactgaagtttgaaaaggaaggtagcatagaaacaaaagccaagatagactccttagagatggtcaccagagctaggagaggcagtctgtcccccagggtctctagggttccttgggcattagccattcaccatttgaatgtggactacaatgaggatggagttattgtctccattctgagaacagagaaacaaaggccagatggaacagtacatctgtggtagaaaaaaatttaaaacttaattaaaattaaacttcaggagactgtacaacctattacctaagagcatcgtgggaaatggaactgctctgacaggttttagtgtggggagctgagatgcctgcctttactcccccactcccatgccacagtgtcctaaaatttcaccttaaactctggagctctggagtgctaaggaatccccaacctgtgctcactctaaccaaatcctgctttaaaaaataaataaataaataaaaaataaaactatatgtcacccctcatggcagggattccccatggagatggaatcagaggcaggactgggcagggagcatgtgacgatatgggctcttctgatggaaaagcataaccaagagacagggggcaaggaagggaattaggctggactatgaagctccccatcagctccctcctcactactgacaggacagagccctggtgtccccctgcctgaaccctccttccttgggcagagggtaaagagatgttggggccaccaccacctccctacctcttctctcccccagaacccttcttgaacctccaaggcctgcttctttaacctctccaaggtctcctcttccctagatccactgccactgccttagttcatgttgtcaccaatttgttgtttaattgaatagtttttttttttttttaattcaaaagtcagactgggcacggtggctcacgcctataatcccagtactttgggaggctgaggcaggtagatcacctgaggtcaggaattcaagaccagcctggccaacatggtgaaaccccgtctctaccaaaaatataaaaattagccaggcatggtggcacatgcctgtaatcccagctactctggaggctgaggcaggagaatcacttgaacctggaaggcagaggttgcagtgagctgagactgcaccattgcactccaacctgggcaaaaaaagtgaaactttgctaaaaaaaaaaaaaaaaaaccatatattcacatggcatacagttaaaagtagttctctttccaaattccatctccaggttctaagtctctcccccaagagacaaccactgctgagatttctacagacctgaatcctttcagaaacttttaatgcatttgcaggtttcatacatatttgtgtggggagggtgttcctttaacttcacatatgggagcaatctataacactttttttctaaaccttgctttttgatcttaacagtacatcccagcaatattaatgtttgtagattaaaactgattcccatttattccattctacacatttgtttaactaatttactttaccagtccttattaacagacattctcattccttgttacttctttcctaaaatatgctaatagtttctttgcagactatttcctctcatcactttgccaagctcaactctgacttctctaaaaccctcaatagcccctaatggcctttgtctgttcaaaaggcgatataaccaagtggtcaagtgtatgggttctgaggtaggataaccctgtgctcaaaccctagctctcctccttatgaatccctaagcctcagtttccttaccttccaaaatgaaggtatctattttcactcagtattgagcgaaagagaaagaggggccagccgggagggggcaggattgagcagcggttaagagcatcagggacaagactagctgtagtcaaatcctggccctaccacttactcgggaaaatacttaatctttacgtgcccgagtttcctcatctacaaaaaataaatacggatagttattgtctatgcttcatggggttttaggcagactaaataaacttattcatgaaaagcatttagaactgtgcctcgcacacggtaggcacttactaaatatgagcatcaggtcaaattgaaggggctatgttgtctgagatataaactcagggtttgtcctcgcgtgccgggaaagtttaggacacagacacacaggaggagtttaggagcggacgttcaataagtagaagaaaagaaaaagagaaacagcttcctctatagaggaaggggtctcagaggggtggggaccggctgctggtgaatgcgctgagttctatagtccagtttgaggaggcggtgtctgatttacctagggctcacagattggttcgataaggcatgacgtttacgtagtgcctgggaaaggctggttgccgcaccctaatcttcttatgcaaatggattttccagtttattggcaccatcttatctgctcctttcaatacagtggctggcagggaagggaagatggagccgccattttgaaaatgtctattccttagtccctgctggtgttcacccatgcaagctcccagcttgcaggctgctctttgttagaaaatgatttggggctgcttttcaataaaaagaaaagcctgaccaaggactcccatatccttactatctgcctaagtaatttcttcttaactcctgtatcaaaatgggctacttcatgtgccccacaggcagggttgacatccacccagtgtgccatgacagcgttcacagcatatccacccagtgggccacaccggccctcacagcgcatccaccatgccactgttcacaggtgcccatgctgattgcctaaggcctgaccattgcaattgttaagtatttttaatatcatcctttcggaaaaagagactgctccaggctttacacctgcctctaatcatgctgttccctcctccacctagaatacccttccactcatcgaaatattgaatccctattcaagacccacctcaattctgccactttcatgagttcctctctgcttctctaaccagagtcatctcctctcaactctgcactttcctcatacgttccataggatacttggcaaagctggccttacattactgatttacacatgcacctgactccccagctagacagggtgctcctccagggccaggtctaatttacctttgtgtttccccagagtacctgcaatgatgcttggcatggtttatcccacagggccagagagttgctaaagtctatcacatgtcatatttaatatttatcaaatgaatgaataaatgaatgcttgaaaggaaggaggaagggagagtggaatggaccccctgagggaagacaggacaaaacaatctccttcggttctctaggcctcatctaatgcaggcatcagagcaggctggggccttgcagcaaagcaagaagagaggtggggttggcatacttttatcagccctgcacaatgtgttccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacaggtgagcccttctgatcaatacaccttcctcctcctcccatgtctagcggcatctgagatcctggatgactagttcctccaaactgggggctggggcctggaaacaggactaggggcatacgggcagggactcatggctgtgtccatgtttaccaaaccttgggatcctgtggaacgagggacttgtccctcagctctcattcttgggccactaataaggaaggtgttggagaaccagaggcaccgtccccactgcactaaggcagctcccaccctgtgtgtgagatgggaagccagggggtatcccctctcctcaagggttgagggtaaaactgaaaagctctcatgtggtcactagggctcatctgctgttggtgtgttacagggaaagaccccagtttctcagaaggaagagagctcagccacaatctactgctccatacggaaacctcaggtggtgagaactacattctctgtatcccaaggcccacagagtgaggaactattccttagaccctttgaactgaaaatccgagattcccatggctaaggatcttaaattctacccactatgcacccctcagatacattccatggtcaacagagatgcataaacaaatattcctgacatctgtgtgaccaaaggctgaacatttctaattgatttaataatatcttatgttggttatttttaacactgacctgaatgacagcttatacactcaaacaaggtagggtctttatagctttttaaatctatctctaaccctaatcctaatctacctaaatgacaacttctcaaaaccattgaaaattagctaacaatttaacaacaagaatttttggaaaatacaccaccacctacagtacattagttttattctagtgtttaaaaaaatcccagccgggcgcggtggctcatacctgtaatcccagcactttgggaggccaaggcgggtggatcacaaggtcaggagatggagaccatcctggctaacatggtgaaactccgtctctactaaaaatacaaaaaaaattagccaggcgtggtggcaggcgcctgtagttccaactactcagagactgaggcaggagaatggcgtgaacccaggaggcagagcttacagtgagccaagttcgtgccactgcactccagcctgggcaacagaacaagactccatctcaaaaaaaaaaaaaaaaaaaaaattcccagcctgggcaacatggtgaaaccctgtctttataaaaagttcaaaaaaaattacccaggcctgtggtggtacacacctgtagtcccagctacttaggacacttaagtgggaggaccgcttgagccggggagttcaaggctgcagtgagccaagatcatgccactgaaatctagcctgggtgacagagtgagaccatgtcttaaaaaaaaaaaaaaatcccttacaggtagaatttatcattaaataatcataatgataataataactgacttgcttttatatgaagttttgcagttacaataccttgatacacattcttctttgatctttgtaatacttctagaaaagtgttgtcatccacattttatagccaaagaaacagattcaaggaagttaattttgcctaaggtgacaaagatagtacttggaagttccagtattaagaaccatgaggcgttttaagatcatcctgagtaatcttaaataattcaccttgatctggctgtccatttcattttcactttcctgaaaacatcgtgtccattcatacttttgctttcaaatctcccccaaattccctccctataacatattcaaaaaaatattttttaaaaaactctcggctgggcgtggtggctcatgcctgtaatcccagcactttgggaggccgaggcaggtggatcacctgaggtcaggagttcaagaccagcctggccaacatggtaaaaccccatctctactaaaaatattaaaattacctgaatgtggtggcaggcacctgtaatcccagctactcaggaggctgaggcaggagaattgcttgaacccaggaggtggaggttgcggtgagcagagatcacaccattgcactccagcctgggcaacaagagcaaaactccatctcaaaaaaaaagaaaagactacagttgacccttgaacaattcaggggtttaggagtgccaaccccaccccactccatgcaatcaaaaatcattctataactttgactctccagaacttaactactaacagcctactgttgaccagaagccttaccaaaaacataaacatttgattaacacatattttgcatgttacgtgtattatatactgtattcttacaataaagtaagctagagaaaagaaattattaagaaaatcataaggaagataaaatatgtatactattcattaagtggaattggatcattgtaaaggtcttcatcctcaccttcacattgagtaggctgaggaggaagaggaagggttggtcttgttctttcaagagtggtagaggtaaaagaggtagaggaggtaaaaggggaggcaggagaggcaggcacactcagtgtgatgtttattgaaaaaaaatctgcatataagtggccatgcagttcaaacatatgttgcacttatgcctggtgttccattattggaacactaagcgtgtaggagttatttatattctactgctcaagatcatcaccagggtctgatttttcactcatgcacaaattcaaaaaattgcaacctcctgcgtaaatgggttaaagttacttgactacttaataaattgtatgcacagttcctaagggtttttcagaagctgaaggtgggggatatcactgcactgtggtaaagaggaaacacatcatgaaaaaggaatttgggttgggccttaaaagatggatagaatttgctcagtaaacacttgttgggatgtgtggtttggttcaaccatcatccatctcatcctgacttctagacagtagtctaatgcttagccagctagagactttgccttggaacctaaggccaaatctgtgctgttcactgcattcccagagctgctttctactctggcctggccctttgtgtttgggtcaataccggtcaaacttaaagtcagtccctgctctgagtttcagaatgaccaccacatgtctggtcagtcctgcaaggcacacacactaccctggagactgagacccctgaaaccacctcacttacagtgtaagttgaaatcattgcatttcctgagccaaactcttgacaactatatcttttgtcttcagaattgtcaggaccaggaattctggttttggatctctgaaggccattattgcctacttgatctggaaattctcaaacctactttagttcttatttctgatatacctctctgtacaacatctcaaaggtttatgctatccccaagctgttgctggtacccaacctcccgctcctctgggtcagcacagagcttatctgctctttagagccttccctgaacactctcagacagggaagcctaagaacccttgggaacagcttggggactaatggtctggaccattactttggaacttaacctctgccatctaaattatcttcttataaatgttcgttttgtttctccagctagggcagagattggaatcatttgacagtagcttcgtgagggcaagccccttcattgtcatttttttatcccctggatttgctgcactaaactgtcttgtgttgtccttgcagagagtccagcccacagcctttcctattaggagcctccataaatgcttggcatcaggctggttgattgcgccatccctgggccagcacatatgactctacttctgtaggatggaccagtcatagcctggccttgccttcctctttcatcagcctcactcttccaaggctttattaaccatattcttttgtggatttttggctcacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 3277 - DNA, 32182 bp, Homo sapiens; identical to SEQ ID NO: 3276
  source 1..32182: mol_type = genomic DNA

SEQ ID NO: 3278 - DNA, 32182 bp, Homo sapiens; identical to SEQ ID NO: 3276
  source 1..32182: mol_type = genomic DNA

SEQ ID NO: 3279 - DNA, 6709 bp, Homo sapiens
  source 1..6709: mol_type = genomic DNA
accagaagagatggagctggacagagctgtgggggtcctgggcgctgccaccctgctgctctctttcctgggcatggcctgggctctccaggcggcagacacctgtccaggtaagggcactccagggcctcctcctggaaacttctcgtccctgaaagctggcagcttcgtgattggtggcttcctggcttccaggccttgcaccaggccgtgtggagcatcgtctaacgagacagcagctctgcatgcctcatcttatgtgaacaaacgcagaggccccgaatggatgtggcatctcagagacggagcttcctctgcttgccctcccataatggaaaccgaggcaggtttccagtctccctgggccacatgtccccctctaagcgtaaaaagcgtagtcatggtgttgtgtggggaggtgaggcttgtggtgccagctgggtagacaccagtcagatattctgccatggtcgccatcacagagagacagggtgtgaggtggggataagcacccggaaagacagggtgtcaggcggggatgagcactgcaggacctttccatccaggacctgctgggctctggagatggcagttcccatggtgtccctgatgcggcacaataagggtggcattgtccccgtgagttctggacctccttcggggctcccgaggggacactcgggtgccaaaccatgggctccggcgcatgcgagggcaggttgaaaatgcaggttctggagtcaggtcctgactccgtctacccggggctgggatgcagggtcaggaatttgtgatgctcctgatgcttgcagagattcgtgtcaggatttctggaatgcatgtgagacacagagctctgcggtgtgctgtgactagcatcgcattcaaggagcaatccgtggcgtgaagtgtgacacaggccaggaacagcggggattcgcttggaaactcctagtggctcgttgtggagtggtggggttagggtggcattattttcttccttaaatacttctagagtttctaaatgatcaaataatagcacgtgttatttttgtaacacactcacttgaatttgagttatctaattaaaaacaacaagctgcattccagctctagtttcgcaccaacttgttcagtgtccttgaaggacgcctccctctgtggaggaacaaggtggacccacaggagcccatccactctcagatctgctccaagatcaggcgtgggagttgcaatggtagcctctctccctgtgtccttctcacccgatattgattacaatgatatgatagatgagaacagacgagattaggatgctgtcttaaatggtaggagctgaaatgaacctgcacccctcggtaggtaagggaacagaggctcagaggggttaagggacttgtttcaggacacacagtactgaggaagtaaggtttgccttcaggcagggtagcctccaaggccagggttctgccccaaatcacctttctgcctgaccagtgcccaagaggtgaggacagaccaagtgcccaccagggcaggaaaacctcccttccaggtgaccctccagctgagggaggtggctgtggctatagccatctgcccagtcctgatgtcaccaagatggcagatgcctttcagttgagtggtatatctatggctcagtggagtcttcaggcccaggtgacactgagtggccacctgtgtttttctgcagaggtgaagatggtgggcctggagggctctgacaagctcaccattctccgaggctgtccggggctgcctggggcccctgggcccaagggagaggcaggcaccaatggaaagagaggtaggtgcaggcatggctgggggcactggctcttgctctttttgaaaccagatgctgagttgggcaacacccccaccatggttcctagatcgagagctgggtcaggcccctgcaagagccaggaaaagaactgactcccagggcccaacagggttctgacatggagggagcgtctttcttagctatttcatgagctcacatttggacatgcttctgtagctctgtctcctagtccttgatccaataccagctttgctcggccgctggcacgacttcaagctctgtgtccctccaccttcccacctcaacacggaggccatgacactcttctccacctgtctcagatgaggaaactgaggctcagagagtccagggatttcgctctgttctcacacttggaaggaaaagagccgagattctacccatggtctctggatttccagctcccggcccctgagtgaacaggagagccccgtgaggcctgggtcctggatctagaaccttctggtgcaggatgggcaagcctgggcggggccacagtcacgtcgtagcacgagcagggtcatggtcatgattggaaatgacagccgccagctccagggtgggccctttgatcctgggctgggcagttttcctcaagtcagtgtctttggaaattgcaggagaacgtggcccccctggacctcctgggaaggcaggaccacctgggcccaacggtaaggaggggacaagagtgagaagcggcttcaaggcccttccagacctggctgcagaggaacgtgaggcgggtcttctggggctgccacgctgtcctcgccagagccaacgcctgcccaggcagggctcttggggcttagtccagggcaggggtctcagtgtgggggaaggggtctcaatgtgtgtgtgggttctcagtctgggggagtggggttatcagtgtgggagctggtctcaatgtgtgtagggggtctcagtttgggggagtggggtcatcagtgtgggggcagggttctcaatgtcggaggaggggttcttggtggtgtagggagaggttcttggggtgtgtgttgggggaggggttcccggtgggcaggctgtggggaggtgttatcagcagggagggaggagctgtcaatatgggggagagattctgggatgggggagaggttctgattattcggggagggacttttagtgtggggaggggttcttagtgggggggctgtctgtatgggggggttctcaggtaggggaaggttttcagtgcaggagcatctgccctgtgggtgggcctgagaccaaatcctgtccctctaatgtggaagtggtcttgagagggtggggggggattgtctgcccacctctctaagcctcactcagtcctggcctctgtcccctgagcatgaggccctgtcttgtcccctcctcctgactctgcttgaaaaccaggatcagccccggatggcttggagaaccatgccaacaagttccaaacacagaattagtggaaattctctgctttaaaacaaagaattttctgatatattttcttgaggaataaattttgaggaatcggagaaatacgcagtaggaaattgaagctccctttactcactcacctttacccacagacctactcagaataagaccaccctacactcaccaaaccccaggctcagtcatgggttgtgtctaaacataaaatacgcaggtttggtgcccacaccgcaaacaacactccccacatcatattactgtgtccaccaagatgggctgtttgcaggccttggggcctcaggagaagcctgaagatccaggcttcctttagttggcatgtggaggcctcagcagtctctgggatggtggcctctgcttccccaggaacctctgaaaggggtgcatgtggtggaggggccagtgtaggcatccctcgagggaaagaaaaatttggtcaacagaaccagggtcagggactccttggctggacccataccatcacctcctggggaggcccagaaaatggtgtccgcggaccaatgggggctgaagggctctgatttccaaactgtgacacgtgtgtcctctctcatccatgaacaggagcacctggggagccccagccgtgcctgacaggtgactgaccacccccacactcctcccacggcttgtggctgcccttggctggaagtccagggtcatacgacgccattgccagaatgaagtgacaaatatgaacagaagaaaatggttgcttgcccgtttccttgtcccctaattattcaaggaagtgacaaatattgtccagacaacttacatacactccatggcaatttttttctatttataatctacgccagaaggccgggtgcccaggagctgaaggtgggggtgacactgggaggtgggagggccaggccaactggctgcggccatcacagctgcgtggccctgggggccgtgtccctgtccaggcctcagagtcccgctctgttcatacagacgcctatggccctgcttcttcctcccaggcctccctcctactgcctgtgccctgcccagggctcctgtcctgcagccattccccgggttcccttcccaggcccgcgtacctgcaaggacctgctagaccgagggcacttcctgagcggctggcacaccatctacctgcccgactgccggcccctgactgtgctctgtgacatggacacggacggagggggctggaccgtgagtgtggggctgggcagaggcggtcagcctgggagtcccggaggccaggctgcacacctggtgggagaacacactctggaattctctattctcctggtcggggacagtcagagatgatgggggagatgaccggtgggtaaaagtccaggcctttgggggaggctgggagaggttgggtgctctcctgctgtgtggcttggggcttgttgcctcccctctctgagcccccatttcctccttcatcctgtggagtctgtgaggagaacaggtgggcgtgctggtgaccccgcctgtgatgctctgccaactacaaatgctgctcctctggagggcgggtcccccgtgctgtgggacgtcggcctggcccccccggctcctgtcccctggcttctccacaggttttccagcggagggtggatggctctgtggacttctaccgggactgggccacgtacaagcagggcttcggcagtcggctgggggagttctggctggggaatgacaacatccacgccctgaccgcccagggtagggccgctgctggggcttgggggtcgggggccctgaatgggggtgcccctgcctcttgggcctgggctgcctggaacacaagagcctcttggcccacaggggattgggccctgagcacactcagggtggcactgggacctccgagggcttcgtccctgctgcaggctctggcagcatcgggacgggagagggtcagagctctgggatgaaggcctcttcaggtcttggccccactggcatctcaggtcctgagaggggaaggagggacacagtggccccatagtggagtttgggcccaaccccaactctgcctctaatccgctaggatttgggagtcaagagtcttgccctgctgctcagcacaccctgccgggtcagagctacacaggccccggggatgctgcggtgctctccgccctctgcctccatggagtccagacctccttccaggccctgccccagatccccagctcccatgtctaaaggtagagagcccttccgctgagaccctgaaacctttctctaacaggaaccagcgagctccgtgtagacctggtggactttgaggacaactaccagtttgctaagtacagatcattcaaggtggccgacgaggcggagaagtacaatctggtcctgggggccttcgtggagggcagtgcgggtgagtgtctgcttggggctgtgtggcctgggcttctgaggggggtttgggaagtggagagagcgtgctcagtgtcctggtagccttgtggaagaggcctcacctctctgagccaattcgtccatctctacatgcagacactaacatctgtgctctgtgtagcatgggggtcatgggacacatcagtgtatgactgcagaaatcccagcaagggcatctggtaggaaggaagtctctgcagagcagggacctatgcacggtgacagcagctgatatctctgcggggcatggctggaaggggtctgccatgatggaatccagagtagagaatgatgatcctgacccctgcctcctgttcttctgtgaaataaacatagtacacattaggtggcagggctagacctaaagacaatttgccaagaccactgccaacagcagggcagtattcactggagtcatggattgcacttcttggattgtgcagtgcacaacctgcctaaccatacatggaggacacaccaggccaggcctcaggtataaagacttatactgtctgtaatgatgttactgcctgtaacgatgctcacatttcctcctgcacaggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattct

SEQ ID NO: 3280 - DNA, 6709 bp, Homo sapiens; identical to SEQ ID NO: 3279
  source 1..6709: mol_type = genomic DNA

SEQ ID NO: 3281 - DNA, 12599 bp, Homo sapiens
  source 1..12599: mol_type = genomic DNA
tgctttaaactggggctttatgtggccaggtacaagcccaggcagctctgtgactttcccgcgccgggatccagggctcctgggtgagcgggcgctgggctggctggctgtcctggccccacgcctaccggtcttaccgtcccagggggagtggttggttttccaggggatctgccgaggaagcgtgacttccatggacccctctccccagaagcccaatagtgagcagcgcccccggggaatcgccagggtccctccagccctcccagagtgtccacgtaccgcagaagtcgacatcatcgtacacctccgtctccctggcagagcacagttgggtcagcaaggggcaccgtggcccattccccccaccctgcaccacacaccccgcactcccccaccacggtcagggctggcactcacaggggcaggagcgctgttctgggcacgtagccatctgtggagagagtgggcatggtgggttctgaggcccagggtggcggcggggacctcccggggctgcggggccgggcgcactcacatttgcctttggggtcccggcacagcatctcctcattgctggtgaactcgatcacctccaggatctccccgcgccggatcccgaggtgcttgccacccccgcgacgtgtcttagcgttggggtcgatcatcatcttcgtgtgaaccacgatctccccttcaaactggggcgcgagatgttagggcctctgcttgtgctgccgcccttgggcccctgtcttctttctgagcctgggatcggtgggaccctggtctccgccctgccaggactcctgcttagctcagaggcctcaccttgaacttcttccggaactccctctcggccttctctgccttcctcagctgcttcagcaactttgggtccatgggtggcaactgctgtggctggggatccttctccttcctgatagcccccaccaaggaattgtgtgctcgtgagcaagttgtgctcctctgggggttcctggagctcgccccccgtctgcccaccccctctgcccatggcacctgagcgctgggtcttgtggtggcctcctggcggcttgctgaactgagggcgcttcatctggggacagtcaggactccgagtcaaggcagggcccgccggctcagcctttaccctggtagctgttttttgtttgtttttgtgtttttgttttgagacgaagtcttgctctgtcacccaggctggagtgcaatggcacaatctcggctcactgcaaccttcgcctcctgggttcaagcgattctcctacctcaggctcccgagtagctgggattacaggtgtccatcaccacacctggctgatttttgtatttttaacacagacaggtttcaccatgtgggccaggctggtcttgaactcctgacctcaggcaatccactcgcctcggcctcctaaagtgctgggattacaggcgtgagccactgcgcctggcaggtggctggatcttgagtaaggcctccctgtgtcagttctgaggactccccaaatcccaccaggtcccctcccaaacctctccctgcccaccttcttccgcaagcctttctcaggggtcatgggttcttctggattgccttccattcccttaactcctgccacgtgctcagcatggtgggaactgctgggccacgcccctcatggcagccctctcagcaaccttgttcatgccagtagacgccactgtcatgcccaacttgtccacaaggaaataaaggctcagagaggtcaagcaaactgcccaaggtcacccagctggtaaatggtaaaggcaggatttatctgtaggcttcgaggccatttcacttctgcctcctagagcaagttgggtctagggttcttttttattttttgagacggagttttgctcttgttgcccaggctagagtgtgcaatggcgcgatctcagctcactgcaacctccacctcctgggttcaagcgattctcctccctcaacctcccaagtaggtgggattacaggcacatgccaccacacccggctaatttttttttttatttttagtagagacgggtttcaccatgttggccaggctggtctcaaactcctgacctcaggtgatccacccgcctcggcctcccaaagtgctgggattataggcgtgagccaccgtgcctagccgtttttttttttgtttcttttgtttttgtttttgtttttgagacggagtttcattcttgttgcccaggctggagtgcaatggcatgatctcagctcactgcaacctctgcctcctgggttcaagcgattctcctgcctcagcatcctgagtagctgggattataagcacccactgccacacccagctgatttttgtatttttagtacagatgaggtttcgtcatgttggccaggctggtctctaactcctgacctcaggtgatgcccctgcctcagcctcccaaagtgctgggattacaggcctgagccactgcacccggtaggttctggggttctactgtaatgagatttgggtgaaaaactaaggcagaagggaggatgaggagaggctggcccatgggtacaaagttacagttaggaagaagaaattgggtgttccattgcacaggagggcaatgatagttgacagtaaaatatcatggccaggcatggtggctcatgcctgtcatcccagcactttgggaggccaagtcgggcagatcacttgaggtcaggagtttgacagcagcctggccaacatggtgaaaccctgtctctactaaaaatacaaaaattagacgggtgtggtggtgggcgcccataatgccagctactcaggaggctgaggcaggagaatcgccggaacctgggagctggaggttgcagtgagtcaagatggcgccgctgcactccagcctgggcgacagaccaggaccctgtctcaaaatagtaaataaaaataatttttaaaagatgctgctagggtaagcgtcctggactggtgactgatgatgagactctggactgaggggtctcccatggtgccagtctccctgtgccacttcctggcaaatgaccaggctcccaagtcagagccctgctggccaaggaattggcttcaggtgggagccccaggaaccctggtgagtgaaagatccagaacccagagccccagcatgtcctttccgaatggctcaaagtatcccgccggacatttcaggcctgtagtccctccaagcagcccaaggagcagcacctgaatcgtgcccgccagataccaggcatggccatccacagtctcacctggaacacacagcccctccagctgctcctgcctctcagaggcttccctggccgtgagcagtcactccaccaggagcgaacctgaccttggcactccagggtccctgcaaacccgccacattagagcacctcttggcaccgccatgcaggcagccctggttcatccacagctgacccagagcaggcctctgcccgccttccccgcatggccagctcagatccctgggaaaggctgggctctccccacctgcagaggagccccctgccttccaggaacctctgcagtggagctgccactgctccaagtaaggcagacagtgggaaaggggagtccagagtcctggccccaagagacctaagctgcctttgagaagctgcacccacagtgagaagcccacgccactcctgagaagcgggagatccagggaagtgggacctttttttttttctttttttcttgagacagggtctcgttctgttgcccaggctggagtgcagaggtgcaatctcggctcattgcagcctccatctcctggattcaagcgatcctcccacctcagcctccccagaagctgggactacaggtgtgcaacaccatgtccaactaatttttgtatttttagtagagacggggtttcaccatgttggccaggctggtctcgaactcccaacctcaactgatccgcctgcctccacctcccaaagaactgggattttaggcatgagccaccgcgcccggccccttttttcttttttcctatcagaacctcaaatgactggcaaggaagggggagaaggttatttggtgacaggaacaatgggccaagggtggggactgtatgaagtttgaggagaggcagatgctcctagcctcggaagaggtgggggattccagcagggcttctgggagtggttggaggcaggctgtcactagcccaggcgctcagcagccccactcctggccatccgcatccccaacggtggcccccagacccaagccacagagcctcccctagagcggaagcagaaggggccccaccaggaagctgtgtgctcacagggaggtgttgcaagaagctcagggagaaagcccaggagaagcagagggggcctctctgccccaggccctctgaggctgtcagcgagagcaggagcaccttagaagctcaagctctggcccccgctgaaagccctgccacagatccagctcgtggaccagctgtgcaagccagggcaagccccatcccagagcctcaaccttgcgtacctatttttttttctttttttttttttgagatggagtctcactctgtcacccaggctggagtgcaatggcaggatctcagcttactgcaacccctgcctcccaggttcaagcgattctcctgcctcagcctcccaagtagctgggattacaggcgcctgctaccacacccagctaattttttgtatttttagtagagacaggttttcactatgttggccaggctggtcttgaactcttgacatcaggcaatccacccgccttggcctcccaaagtgctgggattacaggcgtgagccactgcgcctggccttttttttttttttcaactgagacagacacagagtctcactctgtcacccaggctggagtgcagcggcgcgatgtcagctcactgcaacctccacctcccgggttcaaggaattctcccacctcagccttccgaatagctgggatgacaggtgcatgccaccatgcccgactcatttttttttttgagattgagtctcactctgtcgcccaagctggagtccaatggcgtgatcttggctcactgcaacccttccttcccaggttcacgcgattctcctgcctcagcttctctagtagctgggactacaggcacgcaccaccacacctggcgaatttttgtatttttagtagagatggggtttctccatgttgttcaggctggtctcgaactcctgacctcaggtgatccacccgcctcggcctcccaaagtgctgggattacaggcgtgagccaccacgcccggccccagctagtttttttatttttagtagagatgggtttttgccatgcgggccaggctggtctggaactcctgacctcaagtgatccgcccaccggacctcccaaactgctgggatgacaggtgtgagctgccacgccgggccagccttgtgcatctgtaaaatgggggtgcattgccttactgccctgtggggatttgggagtggagggtacggatttagggacaggcaggcaaggtgcttgcctggaagctgcttgtgttttcatgaaggcattaactttggagtggagggtacggatttaaggacggatttaaggacagatttagggacatgcagggagtggagcgtacagatttagggacaggcaggcaaggtgcttccctggaagctgcttgtgttttcatgaaggcattaactttggagtggagggtacggatttaaggacagatttagggacatgcagggagtggagggtacagatttagggacaggcaggcaaggtgcttgcctggaagctgcttgtgttttcatgaaggcattaactgtggagctgggcaggaggtgcgggcctgctccctattcacccagcacaaacttctaagaaacctttggcagcctccctcccctgccactgccacacctgcctgcaggccacacctccccctgagtttcaggcccaagttctgcctggacatcccctcagctaccttgaacacaacaggtctaagtaaatcaggctgggcgtggtggctcacgcctgaaatctcagcactttggtaggctgaggtgggcggatcacgaggtcaggagttcaaggccagcctggccaatgtagtgaaaccccagctctactaaaaatacaaaaattaactaggcatggtggtgggcgcctgtaatcccagctacttgggaggctgaggcaggagaatcgcttgaatccaagaggcagaggttgcagtgagctgagatggcaccactacactccagcctgggcgataacagagcgagactgtgtctccaaaaaaataaaaaataaaaatataaggccgggcgcggtggctcatgactgtaatcccagcacttgtggaggctaaggtgggtggatcgtttgaggtcaggagcttgagaccagcctagccaacatggtgaaaccccatatctactaaaaatacaaaaagtagctgggcttggtggcacgtgcctgtaatcccagctactccagagggtgggacaggagaatcgcttgaacacggaaggcagaggttgcagttagccaagatcacggcactgcactccagtctgggcaacagagcgagcctccatctcaaacaaaaaaacgaatacataaataaataagggtcaggcgtggtggctcacgcctgtaatcccagcactttgggaggccaaggcaggtggatcacgaggtcaggagatcgagaccacggtgaaaccccatctctactaaaaatacaaaaaaattagctgggcgcggtggtgggtgcctgtagtcccagctactggggaggctgaggcaggagaatggcatgaacccgggaggcggagcttgcagtgagctgagattgctccactgcactacagcctgggtgacagagcgagactccatctcaaaaaataaataaataaatgaatggatggatggatggatggatgaatgaatggaacctaacatcttgtcgtcaacccaggggcggctctgtcatgcccttgggtgctaggcttgaaacttccctgctttatataccaccaaatcctgctttttttttttttttttttgagacagggtgtttgctgcccaggctggagtacagtggtggagtcacagcctcactgcagtctgcagtctcgacctcctggactcaagcaatcctcttgtctcagcatcccaaatagctgggactacagatgcttgtcacacctggctgatttttaagtttttttgtagagatgaggtctcgctctgtggcccagactggtctggaatcttgggcttacgggatcctcctgtcttggcctcacaaagccctgggattggctcaaacgatcctcctgcctcgggctcccaaagctctgggattacaggcatgagccactgcacccggcctgatgcctgcttttgattactgaattcacccactgctcccacatctcctgctgccaacctgggccacacctctgcctacaacagccttctcactggtccttcgcctctgggctccccttatgtagttccacccagcaggagccagcaggtcctaaaatgttacttgctcttacaccaggagcatggcagaaaatggccttgccccgaatgttttgcagggactcgggcaggccaccaacaaacctctgcccttggggctggggctggagtcatctctgggttccacatcgtcatacagctcgtagatctcatctgggaccctgcggggatacctgagatgaggcctcttctttttttttttttttttttttttttgagacggagtttttctctgttgcccaggctggagtggtgcaggggcatgatctcgggctcactgcagcctccacctcccgggttcaagcgattctcctgcctcagcctcccaagtagctgggattacaggtgccccccaccacaccgggctaatttttgtatttttagtagacggggtttcaccacgttggccaggctgttgtcgaactcctgacttcaggagatccgcccacttcagcctcccgaagttctgggagctccaggccgagatgaggcctctttgagccccacaatccgcacccacctccgcttcctccccacactcactgcgggatgtcttcaggctgtcggtcctggaagtggagcccagcggccgagcgggtcctccgtagatctgtggggtagagagtagggcagggaagccggcactgcctgggacctcagcccccgctcctgccggtgccgcccgccctcacccacctatggatgctgcagagggtctccgaaagctctgcatatccacgggccccgggggcagcgggggcttggctggagggtgtcccaggctgctggcagggggcagaggcctccgccggggtggatggctgggtctgaggcctggcctggcccctccactgtgaaccaggcctcctgacctccagcggggtgtcccagccgctccaaacccagggctgagcgggtgccgggagctgaagccggccacggccgcaggcagtgagctctcggaagcggagctggggagtggaggctttcgagggagatcaccgaagaactcaggctgcgggtgtctcttgaggacagcgctgggctcaggctgtgagaacttgcggggtggcccccggcgctccggctgcagcagcttcctggggagtgagttgaactcgggctctgaggaggtcctggggaggccgcccagctcgggctgcgggggcttcttggagagcgctttgaattcggccggccgcggcctcttgggaagcacgctgacttcgggctctgaggaggtcctggtgaggtccccaagctcaggctgcggaggcttcttgggaaagtcactcagcggaggctgggaggcctttttgggaaaggcgctggagtcgcgcttcggctcgctggactgaggcttccagaggggagtctgagcggcctcgctgaactcaggctgcggcacggacttcttagggaggccaccgacctgaggctgcggaggctttttggggtacacgttgaactcaggctgcgcaggcttcttgggaaaggtactcaactcaggctgcggggacctcggggtagcctcaccggcctcgggttgccagagcttcctggggaatgcgccggatttgggttcggaggggggtctggcggggtgactgagttcgtcgggctgcaggggtttccgggccggcgcaccaggctccggcagcgaggccttcaaaggggcctcaccgacctcaggctgcaggggcttccttggaaacggagtggcccccagctgtgggaacttcttggagaggtcactcaactccagtttggacggcttcttggggaggtcagtgacctcaggcggcgggggcttcttggggaggtcagtgacctcaggcggcgggggcttcttggggaggtcagtgacctcaggcggcgggggcttcttggggaggtcagtgacctcaggcggcgggggcttcaaggacactgcaccaaactcaggcagcggggccttcttggggtgctcgcttagctcaggctgggagaacttcttcagtttaccaaactcaggcttcggaggttttttgggcaggtcgctgggctccggctgagaggcctggaactttgctttgatgctccggaagtcctgatggctctcctaggagacgcagagccaatgaggcaggggctcaaacacacagaaggggcatggaaggatgggcctggggaccctcaggcacagcccacaaccaccacccctgcgcccaggcccggtcagccctcagctctttcccaggagcccccatggatcctaggatcctgggaccgacacccctccctacttctccatttagtgctgattccacacccaacctcctctagcagcactggagatcccgacatccctcctgcagcctccagtcccactgccctccccccatgggtggtaccccacccccccagcatccttgaccccctcattctttcacccctcccactgcatgtctccagtctcgttccattgcccaggctggagagcagtggtgcaatcatagctcactgcagcttgcaactcctgggctccaatgattcccccgacctcggcctccccagtagctgggattacaggcttgagccgccgcgcccaggcccccagtcccttctgtgctaatttcaaaacacatccggaatccaaccacttctcactgccttcaccactgtcaccccaggaggtagtgggaggcagtgtctgccctcccccaaccaattgcctggattactctaacaagcccttccctgggcctctgcctacccccttccctggtcagttccccccatggcagctggagggagaagcctgttgaaccctgagtctgtttgtgtccctctgctcaaaactcggcaatgcttcctcatgtccccacagttcaagctaaatgcctcataaaagcctgggcgaaccagcctccctacccagccaccttctcctccctgcaccctgaacacttccctccgacctcggggcctctgccctgtccctgacccaggacatgtctctgcaccacctgggtctctccttttcctcctcccagcctctgttctcatattttcttattagagaggccatccaaggccaccctatttgtttatttttattttttgagatggagtcttgctctgtcacccagactggagtgcaatggcgcgatctcggctcactgcaatctccacttcccaggttcaaatgattctcgtgcctcagccgcccaagtagctgggattacaggcactcgccaccacacctggctaatttttgtattttaactagagacagggtttcaccacgttggccaggctggtctcaaactcacgacctcaggtgatccaccctccacccgcctcagcctcccaaagtgctgggattacaggtgtgagccaccgtgcccaacctagaccaccctatttttctttctttcttttttttttttttttttgagacggagtctcactctgtcacccaggttggaatgcagtggtggaatctcgccatactgcaacctccgcctcctgggttcaagcgattctcagcctcctgagtagctgggatcacaggtgtctgccacgacgcctggctaattttttttgtatttttaatggaaacagggttttaccatgttggccaggctggtctcgaactcctgacctcaagtgatccacccacctcggcctcccaaagtgcatgagccatcacgcctggcctagaccaccctattttaaatggatcaccccatcccactactgccctgcattcagcatgcatgattttctccatcgtacccacccctacgtattatactattttacattgtttttaatgtgtcttgatttttttttttttttttttttgtctctctacaccacaacttccctcagttcctcagcctctgcaaggcagagacttggctcattcattgctgtcttcccagggcctggaacatggtaggtgctcagtaaatatttgctgaaataaacaatattcaggcagcacaaagacagccatgtactcagcctgaccatcaggaaaacacagagatgcctggagacggccatgcggtccctctcacaccgtctctgacatgcgggctgatggtcaggaatgctcacagttgacagtgcctgagaggattggtgcagacaccgtgggcacaggcgctgtctcctgcatacccagctgtcccagctgccctcctagctggccctgcaaccactcctcacagaggtaggcagattcacaagaaggccaggcctccttagtcctacaaacgcccctttcacctgtggtcaaggagattgggggagggaaagggcagaaacgtgtggcctttgcttcctgcgtgtgcctcactttccccatccagaggaccagagaccaggattgctccttggaaaggcagcaattcccacctggggcctgaagtgcccctgtcaaagccccgagtggtttgaaggaagtgctcccgggcgaccacagggctagataagtcagggttagcaggtcacaacttgggtgactggacgggggagggtcatgacccactttgtcaccccgcaggaaagcactgctctcaccccagcagcccgttcccacatggctgctcatgttgacctggggagacgggagttgtccccccggggagtcccatctgtccccctcgcagtcccaacctgagcgtgaacccccaggagcccgcgctgtcctggggtgtgcctggtggccgcctacctcgggtcctttttgccgacccttcccgtttcccagatgtctttcgcagccaccccccgcccccccgcccgcccctccacaggtggatcctatccttctgggaacatctgtgtcccttgcttcccagccagtgaggcacaggcctcttccagcactcaccatggctgcaggcaggtgatgggccatgggatgagtgggacccgagctggggccgctgccttcaggaagtgactgtggcttctgctccac

SEQ ID NO: 3282-3299 - skipped (18 entries)

SEQ ID NO: 3300 - DNA, 40 bp, Homo sapiens
  misc_difference 20: note = T->C
  source 1..40: mol_type = genomic DNA
cgcgaccctccccccaccctcccccaccacgtagccttct

SEQ ID NO: 3301 - DNA, 40 bp, Homo sapiens
  misc_difference 20: note = T->C
  source 1..40: mol_type = genomic DNA
gccagtgcggccgcgaccctccccccaccctcccccacca

SEQ ID NO: 3302 - DNA, 40 bp, Homo sapiens
  misc_difference 20: note = A->C
  source 1..40: mol_type = genomic DNA
cctccccccaccctcccccaccacgtagccttctctacct

SEQ ID NO: 3303 - DNA, 40 bp, Homo sapiens
  misc_difference 20: note = C->T
  source 1..40: mol_type = genomic DNA
aagagcagggatcacgccgcggggtgatgagcagtgttgc

SEQ ID NO: 3304 - DNA, 40 bp, Homo sapiens
  misc_difference 20: note = C->G
  source 1..40: mol_type = genomic DNA
ctaagagcagggatcacgccgcggggtgatgagcagtgtt

SEQ ID NO: 3305 - DNA, 40 bp, Homo sapiens
  misc_difference 20: note = C->T
  source 1..40: mol_type = genomic DNA
caccctgaccacccttcccctctgcccagcacctaagagc

SEQ ID NO: 3306 - DNA, 40 bp, Homo sapiens; identical to SEQ ID NO: 1003
  misc_difference 20: note = C->A
  source 1..40: mol_type = genomic DNA

SEQ ID NO: 3307 - DNA, 40 bp, Homo sapiens
  misc_difference 20: note = G->C
  source 1..40: mol_type = genomic DNA
aaaagagtcccttcacacagtgcagataaaagaaggcaag

SEQ ID NO: 3308 - DNA, 40 bp, Homo sapiens
  misc_difference 20: note = T->G
  source 1..40: mol_type = genomic DNA
cgcggggtgatgagcagtgttgcagtctcgcctggccttc

SEQ ID NO: 3309 - DNA, 40 bp, Homo sapiens
  misc_difference 20: note = G->A
  source 1..40: mol_type = genomic DNA
gatcacgccgcggggtgatgagcagtgttgcagtctcgcc

SEQ ID NO: 3310 - DNA, 40 bp, Homo sapiens
  misc_difference 20: note = C->G
  source 1..40: mol_type = genomic DNA
gatgacatagcttaggacacttgctcatttatttaaaaga

SEQ ID NO: 3311 - DNA, 40 bp, Homo sapiens
  misc_difference 20: note = G->A
  source 1..40: mol_type = genomic DNA
ccagagtaaatgaaaacccgattccttagaaataatattg

SEQ ID NO: 3312 - DNA, 40 bp, Homo sapiens
  misc_difference 20: note = A->G
  source 1..40: mol_type = genomic DNA
gtggagccggcccgcccccaccgcgcatggcctgcactca

SEQ ID NO: 3313 - DNA, 40 bp, Homo sapiens
  misc_difference 20: note = A->G
  source 1..40: mol_type = genomic DNA
accccctatataaggaggcactgcaaatgctgcgggatgc

SEQ ID NO: 3314 - DNA, 40 bp, Homo sapiens
  misc_difference 20: note = C->T
  source 1..40: mol_type = genomic DNA
agggcttcctccctctgcccggtgccccatcggcctcccc

SEQ ID NO: 3315 - DNA, 40 bp, Homo sapiens
  misc_difference 20: note = T->C
  source 1..40: mol_type = genomic DNA
cttttgttttgtattgaaatacttttgatcttgcaagacc

SEQ ID NO: 3316 - DNA, 40 bp, Homo sapiens
  misc_difference 20: note = G->C
  source 1..40: mol_type = genomic DNA
ctggaggtgaggggtgaggggctctggcagtgagcctgag

SEQ ID NO: 3317 - DNA, 40 bp, Homo sapiens
  misc_difference 20: note = A->C
  source 1..40: mol_type = genomic DNA
cccacccctgcctgcccccacccatacctgcccccaccac

SEQ ID NO: 3318 - DNA, 40 bp, Homo sapiens
  misc_difference 20: note = C->CT
  source 1..40: mol_type = genomic DNA
tgagggagcccaggcccatctacaagtcccctttcctaat

SEQ ID NO: 3319 - DNA, 40 bp, Homo sapiens
  misc_difference 20: note = A->G
  source 1..40: mol_type = genomic DNA
acttgctcttctgattctcatcttcggtaggcctggcatc

SEQ ID NO: 3320 - DNA, 40 bp, Homo sapiens
  misc_difference 20: note = G->C
  source 1..40: mol_type = genomic DNA
cccgccccctcggctccccgcccccacctgctcttgaggc

SEQ ID NO: 3321 - DNA, 40 bp, Homo sapiens
  misc_difference 20: note = T->C
  source 1..40: mol_type = genomic DNA
acatggccggcccgccccctcggctccccgcccccacctg

SEQ ID NO: 3322 - DNA, 40 bp, Homo sapiens
  misc_difference 20..21: note = CT->C
  source 1..40: mol_type = genomic DNA
attacatactaattcataactttttttttcgttttagaaa

SEQ ID NO: 3323 - DNA, 40 bp, Homo sapiens
  misc_difference 20: note = A->G
  source 1..40: mol_type = genomic DNA
gtttaaatggaaactggacagaaccacctcaatgcaaagg

SEQ ID NO: 3324 - DNA, 40 bp, Homo sapiens
  misc_difference 20: note = T->C
  source 1..40: mol_type = genomic DNA
ccctccctccctccctccctccccggaggcccaccccgct

SEQ ID NO: 3325 - DNA, 40 bp, Homo sapiens
  misc_difference 20: note = C->T
  source 1..40: mol_type = genomic DNA
ggcctggcttgagatgaggctctcattgtgaaaccactgt

SEQ ID NO: 3326 - DNA, 40 bp, Homo sapiens
  misc_difference 20: note = C->A
  source 1..40: mol_type = genomic DNA
aaaaaaaaaaaaaaaagcacaataaaactcattttttaaa

SEQ ID NO: 3327 - DNA, 40 bp, Homo sapiens
  misc_difference 20: note = T->A
  source 1..40: mol_type = genomic DNA
aaaaaaaaaaaaagcacaataaaactcattttttaaaaaa

SEQ ID NO: 3328 - DNA, 40 bp, Homo sapiens
  misc_difference 20: note = G->A
  source 1..40: mol_type = genomic DNA
tcccagagctgtatagcccgctggagagaaggggctgctt

SEQ ID NO: 3329 - DNA, 40 bp, Homo sapiens
  misc_difference 20: note = G->T
  source 1..40: mol_type = genomic DNA
tgccgctgcctgggtatgggacgctggaagaaacactggt

SEQ ID NO: 3330 - DNA, 40 bp, Homo sapiens
  misc_difference 20: note = T->TG
  source 1..40: mol_type = genomic DNA
atggtcagggcagcagcgatggggggtgtccctaaagccc

SEQ ID NO: 3331 - DNA, 40 bp, Homo sapiens
  misc_difference 20: note = T->C
  source 1..40: mol_type = genomic DNA
acccactccggacaccccatgggggctgggcgccggtgcc

SEQ ID NO: 3332 - DNA, 40 bp, Homo sapiens
  misc_difference 20: note = A->G
  source 1..40: mol_type = genomic DNA
ggcgccggtgcctggacccactccggacaccccatggggg

SEQ ID NO: 3333 - DNA, 40 bp, Homo sapiens
  misc_difference 20: note = T->C
  source 1..40: mol_type = genomic DNA
tgagcactgagcctgggagtggacctggggtcctgagcgc

SEQ ID NO: 3334 - DNA, 40 bp, Homo sapiens
  misc_difference 20: note = C->G
  source 1..40: mol_type = genomic DNA
cactgagcctgggagtggacctggggtcctgagcgctgag

SEQ ID NO: 3335 - DNA, 40 bp, Homo sapiens
  misc_difference 20: note = A->G
  source 1..40: mol_type = genomic DNA
cgccttccccgccccggggagcccgccccctgccccgcgt

SEQ ID NO: 3336 - DNA, 40 bp, Homo sapiens
  misc_difference 20: note = A->C
  source 1..40: mol_type = genomic DNA
cacctcctccccctcccccaccaccaccacctctgcctgt

SEQ ID NO: 3337 - DNA, 40 bp, Homo sapiens
  misc_difference 20: note = T->C
  source 1..40: mol_type = genomic DNA
ctcccccacctcctccccctcccccaccaccaccacctct

SEQ ID NO: 3338 - DNA, 40 bp, Homo sapiens
  misc_difference 20: note = T->G
  source 1..40: mol_type = genomic DNA
gcatgcgcggtggagcttgtgctccggaatccggtgcgga

SEQ ID NO: 3339 - DNA, 40 bp, Homo sapiens
  misc_difference 20: note = C->CT
  source 1..40: mol_type = genomic DNA
cttcttcttctcctttttgctttttttggtcagaaattat

SEQ ID NO: 3340 - DNA, 40 bp, Homo sapiens
  misc_difference 20: note = T->C
  source 1..40: mol_type = genomic DNA
taagctgaaccttgaaggctgaacaggcacatggaaggcc

SEQ ID NO: 3341 - DNA, 40 bp, Homo sapiens
  misc_difference 20: note = C->T
  source 1..40: mol_type = genomic DNA
ccaggttatcactgctgcccgttgactcgccccctaggtc

SEQ ID NO: 3342 - DNA, 40 bp, Homo sapiens
  misc_difference 20: note = C->T
  source 1..40: mol_type = genomic DNA
catctccaggcccctttccctgacacatttcccttatctt

SEQ ID NO: 3343 - DNA, 40 bp, Homo sapiens
  misc_difference 20: note = T->G
  source 1..40: mol_type = genomic DNA
gctccgcctcaaccagccgtactgcgggtatgccgttggc

SEQ ID NO: 3344 - DNA, 40 bp, Homo sapiens
  misc_difference 20: note = T->C
  source 1..40: mol_type = genomic DNA
cctgcttcctgccgtcctattgctggctcgtttgtgccac

SEQ ID NO: 3345 - DNA, 40 bp, Homo sapiens
  misc_difference 20: note = T->A
  source 1..40: mol_type = genomic DNA
aaaaaaaaaaaacacagaataaaagcacactgtataaaat

SEQ ID NO: 3346 - DNA, 40 bp, Homo sapiens
  misc_difference 20: note = A->G
  source 1..40: mol_type = genomic DNA
caaagcccagacagggccaatggggtgagcgtccactcat

SEQ ID NO: 3347 - DNA, 40 bp, Homo sapiens
  misc_difference 20: note = G->GT
  source 1..40: mol_type = genomic DNA
caggagagccaaggcctaagtggcggggggggttctgggc

SEQ ID NO: 3348 - DNA, 40 bp, Homo sapiens; identical to SEQ ID NO: 1145
  misc_difference 20: note = A->C
  source 1..40: mol_type = genomic DNA

SEQ ID NO: 3349 - DNA, 40 bp, Homo sapiens
  misc_difference 20: note = C->T
  source 1..40: mol_type = genomic DNA
gcggagtaaggagcgctccctactgcatggggacttccac

SEQ ID NO: 3350 - DNA, 40 bp, Homo sapiens
  misc_difference 20: note = G->C
  source 1..40: mol_type = genomic DNA
ccccctgcccgccagccccgccccttactggagtctgtcg

SEQ ID NO: 3351 - DNA, 40 bp, Homo sapiens; identical to SEQ ID NO: 1287
  misc_difference 20: note = A->C
  source 1..40: mol_type = genomic DNA

SEQ ID NO: 3352-3399 - skipped (48 entries)

SEQ ID NO: 3400 - DNA, 40 bp, Homo sapiens
  misc_difference 20..21: note = CG->C
  source 1..40: mol_type = genomic DNA
ggagttaggaggacccccccgccccaaaaaaggcaccaaa

SEQ ID NO: 3401 - DNA, 40 bp, Homo sapiens
  misc_difference 20: note = G->C
  source 1..40: mol_type = genomic DNA
gagttaggaggacccccccgccccaaaaaaggcaccaaaa

SEQ ID NO: 3402 - DNA, 40 bp, Homo sapiens
  misc_difference 20..22: note = TAC->T
  source 1..40: mol_type = genomic DNA
aaaaaattaatttttcccttacactttaaaaactctcacc

SEQ ID NO: 3403 - DNA, 40 bp, Homo sapiens
  misc_difference 20: note = G->A
  source 1..40: mol_type = genomic DNA
ggttttttgatcttacagtgtgtggaaccggagtcagtaa

SEQ ID NO: 3404 - DNA, 40 bp, Homo sapiens
  misc_difference 20: note = G->C
  source 1..40: mol_type = genomic DNA
agtggggtggtttgagtgtggtaggcttgcaggcggattt

SEQ ID NO: 3405 - DNA, 40 bp, Homo sapiens
  misc_difference 20: note = C->A
  source 1..40: mol_type = genomic DNA
cagtgtgtggaaccggagtcagtaatcaaagctccctgtt

SEQ ID NO: 3406 - DNA, 40 bp, Homo sapiens
  misc_difference 20: note = C->G
  source 1..40: mol_type = genomic DNA
gcaggcggattttcaaggccttttcattatcatctgatcg

SEQ ID NO: 3407 - DNA, 40 bp, Homo sapiens
  misc_difference 20: note = C->CT
  source 1..40: mol_type = genomic DNA
gtgtttttgagagcttatccttttttctttgtcatccaca

SEQ ID NO: 3408 - DNA, 40 bp, Homo sapiens
  misc_difference 20: note = T->C
  source 1..40: mol_type = genomic DNA
cccctggggaacaaggggttctcatcagcatgcctgtcct

SEQ ID NO: 3409 - DNA, 40 bp, Homo sapiens
  misc_difference 20: note = C->G
  source 1..40: mol_type = genomic DNA
ccctggggaacaaggggttctcatcagcatgcctgtcctt

SEQ ID NO: 3410 - DNA, 40 bp, Homo sapiens
  misc_difference 20: note = G->T
  source 1..40: mol_type = genomic DNA
gaatggaaggttcaggtggggtggggtgggtgggggcagg

SEQ ID NO: 3411 - DNA, 40 bp, Homo sapiens
  misc_difference 20: note = C->T
  source 1..40: mol_type = genomic DNA
cagtggtcctcacctgctgcgagggtgatggtgctgagct

SEQ ID NO: 3412 - DNA, 40 bp, Homo sapiens
  misc_difference 20..21: note = CT->C
  source 1..40: mol_type = genomic DNA
gcaataaatcaaactcaatcttttattattcttagatgaa

SEQ ID NO: 3413 - DNA, 40 bp, Homo sapiens
  misc_difference 20: note = G->A
  source 1..40: mol_type = genomic DNA
taaaaaaaaaaaaaaaaaagaaacagaagtgataactcac

SEQ ID NO: 3414 - DNA, 40 bp, Homo sapiens
  misc_difference 20: note = G->A
  source 1..40: mol_type = genomic DNA
aggggtggggaggctaaccgggccaggactctggccatcc

SEQ ID NO: 3415 - DNA, 40 bp, Homo sapiens
  misc_difference 20: note = C->T
  source 1..40: mol_type = genomic DNA
tatgtgtggccaccccagtccagctccgggtgttccgcga

SEQ ID NO: 3416 - DNA, 40 bp, Homo sapiens
  misc_difference 20: note = G->A
  source 1..40: mol_type = genomic DNA
atgccgtgtcgcccaccccggctcctcgcaacccatccga

SEQ ID NO: 3417 - DNA, 40 bp, Homo sapiens
  misc_difference 20: note = C->T
  source 1..40: mol_type = genomic DNA
ccctgccttcctgtttactcgtggtctcccttcactttca

SEQ ID NO: 3418 - DNA, 40 bp, Homo sapiens
  misc_difference 20: note = T->C
  source 1..40: mol_type = genomic DNA
cccctgtgcccacgcttcctttccctcaggcctatgtgtg

SEQ ID NO: 3419 - DNA, 40 bp, Homo sapiens
  misc_difference 20: note = A->G
  source 1..40: mol_type = genomic DNA
gatctctgcccctgtgcccacgcttcctttccctcaggcc

SEQ ID NO: 3420 - DNA, 40 bp, Homo sapiens
  misc_difference 20: note = C->G
  source 1..40: mol_type = genomic DNA
ggccgtccccgggctctggcgggggtgggtagtcctcaga

SEQ ID NO: 3421 - DNA, 40 bp, Homo sapiens
  misc_difference 20: note = G->A
  source 1..40: mol_type = genomic DNA
aagctttgatggcccctctgatctctgcccctgtgcccac

SEQ ID NO: 3422 - DNA, 40 bp, Homo sapiens
  misc_difference 20: note = G->A
  source 1..40: mol_type = genomic DNA
actccagcctgggcgacagggcgagactctgtctcaaaaa

SEQ ID NO: 3423 - DNA, 40 bp, Homo sapiens
  misc_difference 20..21: note = TA->T
  source 1..40: mol_type = genomic DNA
acaattttaggcttgattataaaaaaaaaaagtctgatat

SEQ ID NO: 3424 - DNA, 40 bp, Homo sapiens
  misc_difference 20: note = G->T
  source 1..40: mol_type = genomic DNA
cctctgttgaaaaacagtggttttttttgttttttttctt

SEQ ID NO: 3425 - DNA, 40 bp, Homo sapiens
  misc_difference 20: note = C->T
  source 1..40: mol_type = genomic DNA
gcctggggcgcctgggggccgccaagggcgcgctgcaccc

SEQ ID NO: 3426 - DNA, 40 bp, Homo sapiens
  misc_difference 20: note = G->A
  source 1..40: mol_type = genomic DNA
caccgacatcacagccgcaggaccaaccgttgctcctgcg

SEQ ID NO: 3427 - DNA, 40 bp, Homo sapiens
  misc_difference 20: note = T->G
  source 1..40: mol_type = genomic DNA
gggcagctcgacctgtgggtgggggagccgctcacctccg

SEQ ID NO: 3428 - DNA, 40 bp, Homo sapiens
  misc_difference 20: note = C->T
  source 1..40: mol_type = genomic DNA
acatcatagtacagttagaccacattttctattttctttt

SEQ ID NO: 3429 - DNA, 40 bp, Homo sapiens
  misc_difference 20..21: note = CA->C
  source 1..40: mol_type = genomic DNA
gatttgacattcttgtcagcaaaaaaaaacttaatttcta

SEQ ID NO: 3430 - DNA, 40 bp, Homo sapiens
  misc_difference 20: note = A->AC
  source 1..40: mol_type = genomic DNA
ccaggtgagtgtcccccccacccccacccccgagcgagcc

SEQ ID NO: 3431 - DNA, 40 bp, Homo sapiens
  misc_difference 20: note = G->GATA
  source 1..40: mol_type = genomic DNA
aaatgaattaaaaggaaaagataatactgttaaaatggtc

SEQ ID NO: 3432 - DNA, 40 bp, Homo sapiens
  misc_difference 20..28: note = CACACACAT->C
  source 1..40: mol_type = genomic DNA
acaatcacgtacatacacacacacacatacacacacacac

SEQ ID NO: 3433 - DNA, 40 bp, Homo sapiens
  misc_difference 20..22: note = CAT->C
  source 1..40: mol_type = genomic DNA
acgtacatacacacacacacatacacacacacacacacac

SEQ ID NO: 3434 - DNA, 40 bp, Homo sapiens
  misc_difference 20: note = C->T
  source 1..40: mol_type = genomic DNA
ttttttttttttttttttgcttttttcatcccaaaccaaa

SEQ ID NO: 3435 - DNA, 40 bp, Homo sapiens
  misc_difference 20: note = G->T
  source 1..40: mol_type = genomic DNA
tttttttttttttttttttgcttttttcatcccaaaccaa

SEQ ID NO: 3436 - DNA, 40 bp, Homo sapiens
  misc_difference 20..22: note = TGC->T
  source 1..40: mol_type = genomic DNA
ttttttttttttttttttttgcttttttcatcccaaacca

SEQ ID NO: 3437 - DNA, 40 bp, Homo sapiens
  misc_difference 20: note = C->CTTAT
  source 1..40: mol_type = genomic DNA
tgtaagatgagtgaaataacttatttatttatttatttat

SEQ ID NO: 3438 - DNA, 40 bp, Homo sapiens
  misc_difference 20: note = G->A
  source 1..40: mol_type = genomic DNA
gcccctggctgacggtgccgcagtccggctggcactggcg

SEQ ID NO: 3439 - DNA, 40 bp, Homo sapiens
  misc_difference 20..24: note = TAATC->T
  source 1..40: mol_type = genomic DNA
tgttatatttaagtgaaaataatcaaataaattatgttac

SEQ ID NO: 3440 - DNA, 40 bp, Homo sapiens
  misc_difference 20: note = G->T
  source 1..40: mol_type = genomic DNA
ggcggggccgaactttcccgccttaggcagggcggcctcg

SEQ ID NO: 3441 - DNA, 40 bp, Homo sapiens; identical to SEQ ID NO: 3339
  misc_difference 20: note = C->T
  source 1..40: mol_type = genomic DNA

SEQ ID NO: 3442 - DNA, 40 bp, Homo sapiens
  misc_difference 20: note = G->A
  source 1..40: mol_type = genomic DNA
gcctgtattattaaaatgggaaaaaaaattgcttttgatg

SEQ ID NO: 3443 - DNA, 40 bp, Homo sapiens
  misc_difference 20: note = T->A
  source 1..40: mol_type = genomic DNA
tggctgtgggcatctgtgcttggcaggccggggcggggca

SEQ ID NO: 3444 - DNA, 40 bp, Homo sapiens
  misc_difference 20: note = C->T
  source 1..40: mol_type = genomic DNA
gagaagtcgcttattctccccaagcctcagtttctacatc

SEQ ID NO: 3445 - DNA, 40 bp, Homo sapiens; identical to SEQ ID NO: 3340
  misc_difference 20: note = T->TGAACAGGCACATGGAAGGCC
  source 1..40: mol_type = genomic DNA

SEQ ID NO: 3446 - DNA, 40 bp, Homo sapiens
  misc_difference 20: note = C->CCAAAGGG
  source 1..40: mol_type = genomic DNA
cctcggggtctttatgtgtccaaaggggagtcctgggagg

SEQ ID NO: 3447 - DNA, 40 bp, Homo sapiens
  misc_difference 20: note = A->ACCCC
  source 1..40: mol_type = genomic DNA
gtccaccaatggttgtgcgaaagccagcccgctttcgcac

SEQ ID NO: 3448 - DNA, 40 bp, Homo sapiens
  misc_difference 20: note = A->AG
  source 1..40: mol_type = genomic DNA
tccaccaatggttgtgcgaaagccagcccgctttcgcaca

SEQ ID NO: 3449 - DNA, 40 bp, Homo sapiens
  misc_difference 20: note = C->CCA
  source 1..40: mol_type = genomic DNA
cagtccaccaatggttgtgcgaaagccagcccgctttcgc

SEQ ID NO: 3450 - DNA, 40 bp, Homo sapiens
  misc_difference 20: note = G->A
  source 1..40: mol_type = genomic DNA
gtgcggggcgcaggggaggggctgggattgggggcgctgg

SEQ ID NO: 3451 - DNA, 40 bp, Homo sapiens
  misc_difference 20..25: note = GCTGGT->G
  source 1..40: mol_type = genomic DNA
aggccctgggctgggctgggctggtctgggctgggctggg

SEQ ID NO: 3452 - DNA, 40 bp, Homo sapiens
  misc_difference 20: note = T->G
  source 1..40: mol_type = genomic DNA
ctgggctgggctgggctggtctgggctgggctggggcagg

SEQ ID NO: 3453 - DNA, 40 bp, Homo sapiens
  misc_difference 20..21: note = GC->G
  source 1..40: mol_type = genomic DNA
tccccgccttcctccgggcgccccctgcgcacctggggcc

SEQ ID NO: 3454 - DNA, 40 bp, Homo sapiens
  misc_difference 20: note = T->C
  source 1..40: mol_type = genomic DNA
aatcccctccccttccccctcccccctttacagtatcccc

SEQ ID NO: 3455 - DNA, 40 bp, Homo sapiens
  misc_difference 20: note = T->A
  source 1..40: mol_type = genomic DNA
taataataataataattattattattattattattattat

SEQ ID NO: 3456 - DNA, 40 bp, Homo sapiens
  misc_difference 20: note = T->A
  source 1..40: mol_type = genomic DNA
taataataataataataattattattattattattattat

SEQ ID NO: 3457 - DNA, 40 bp, Homo sapiens
  misc_difference 20: note = T->A
  source 1..40: mol_type = genomic DNA
cattattattattattatttttttttttttttgtagagtt

SEQ ID NO: 3458 - DNA, 40 bp, Homo sapiens
  misc_difference 20: note = A->T
  source 1..40: mol_type = genomic DNA
ttaccctatctttttttttaattattctgcagtgatcgag

SEQ ID NO: 3459 - DNA, 40 bp, Homo sapiens
  misc_difference 20: note = C->G
  source 1..40: mol_type = genomic DNA
tctcctcggcgccttcatcccgcctcgactcctggcccag

SEQ ID NO: 3460 - DNA, 40 bp, Homo sapiens
  misc_difference 20: note = C->T
  source 1..40: mol_type = genomic DNA
cggggcgccgctgcgctttcacccggcttctcctcggcgc

SEQ ID NO: 3461 - DNA, 40 bp, Homo sapiens
  misc_difference 20: note = C->CTG
  source 1..40: mol_type = genomic DNA
tatgcgtgtgtgtatgcgtctgtgcatgtgtgtatgcgtg

SEQ ID NO: 3462 - DNA, 40 bp, Homo sapiens
  misc_difference 20: note = T->C
  source 1..40: mol_type = genomic DNA
gccccccgccccccccccctgcccgccagccccgcccctt

SEQ ID NO: 3463 - DNA, 40 bp, Homo sapiens
  misc_difference 20: note = A->C
  source 1..40: mol_type = genomic DNA
aggccggcccagtcccccgaaccccgagctgcgcctggag

SEQ ID NO: 3464 - DNA, 40 bp, Homo sapiens
  misc_difference 20: note = A->G
  source 1..40: mol_type = genomic DNA
agaacgagctccttgggccactgtgtgcatggacccacag

SEQ ID NO: 3465 - DNA, 40 bp, Homo sapiens
  misc_difference 20: note = T->G
  source 1..40: mol_type = genomic DNA
gggaaggacaacggtgagctgaggggggacctggcactta

SEQ ID NO: 3466 - DNA, 40 bp, Homo sapiens
  misc_difference 20: note = G->GC
  source 1..40: mol_type = genomic DNA
actgggcgacatgggctgggcctgtcctggttttcctggg

SEQ ID NO: 3467 - DNA, 40 bp, Homo sapiens
  misc_difference 20: note = C->T
  source 1..40: mol_type = genomic DNA
aggaggacctgttgctgcccggcgcctgcccgggcgcgga

SEQ ID NO: 3468-3499 - skipped (32 entries)

SEQ ID NO: 3500 - DNA, 40 bp, Homo sapiens
  misc_difference 20..21: note = AG->A
  source 1..40: mol_type = genomic DNA
catgtcacaaaagactgggagggccctgccctcaggtagg

SEQ ID NO: 3501 - DNA, 40 bp, Homo sapiens; identical to SEQ ID NO: 1008
  misc_difference 20: note = C->G
  source 1..40: mol_type = genomic DNA

SEQ ID NO: 3502 - DNA, 40 bp, Homo sapiens; identical to SEQ ID NO: 3015
  misc_difference 20: note = C->A
  source 1..40: mol_type = genomic DNA

SEQ ID NO: 3503 - DNA, 40 bp, Homo sapiens; identical to SEQ ID NO: 1012
  misc_difference 20: note = G->C
  source 1..40: mol_type = genomic DNA

SEQ ID NO: 3504 - DNA, 40 bp, Homo sapiens
  misc_difference 20..21: note = AG->A
  source 1..40: mol_type = genomic DNA
cagtggtgtcagggatcctagggggttccgtgactctccc

SEQ ID NO: 3505 - DNA, 40 bp, Homo sapiens
  misc_difference 20: note = A->G
  source 1..40: mol_type = genomic DNA
aatgttctgtgattttccaaaaataaaccatggaattcta

SEQ ID NO: 3506 - DNA, 40 bp, Homo sapiens; identical to SEQ ID NO: 1041
  misc_difference 20: note = C->G
  source 1..40: mol_type = genomic DNA

SEQ ID NO: 3507 - DNA, 40 bp, Homo sapiens
  misc_difference 20: note = G->A
  source 1..40: mol_type = genomic DNA
ggcccgggcgcagacaggggcgcggcgggcaccgggttgg

SEQ ID NO: 3508 - DNA, 40 bp, Homo sapiens
  misc_difference 20: note = G->T
  source 1..40: mol_type = genomic DNA
catattgttctttatatgtgtttcttccaagccgagagct

SEQ ID NO: 3509 - DNA, 40 bp, Homo sapiens
  misc_difference 20: note = T->C
  source 1..40: mol_type = genomic DNA
gatgccagaagtttgtagataacactgaatgaataaaaat

SEQ ID NO: 3510 - DNA, 40 bp, Homo sapiens
  misc_difference 20: note = G->A
  source 1..40: mol_type = genomic DNA
gaagggctggatggatagggtgctgtgccagggctttgcc

SEQ ID NO: 3511 - DNA, 40 bp, Homo sapiens
  misc_difference 20: note = T->G
  source 1..40: mol_type = genomic DNA
agggctgtgggcacaactgtttcaggggtcttgacagagg

SEQ ID NO: 3512 - DNA, 40 bp, Homo sapiens
  misc_difference 20: note = C->T
  source 1..40: mol_type = genomic DNA
ggccaacgccactgcctgtcgctgaccccctgacagctgg

SEQ ID NO: 3513 - DNA, 40 bp, Homo sapiens
  misc_difference 20: note = C->A
  source 1..40: mol_type = genomic DNA
tggagggacctcacctccacagcctgggtgaactgcatct

SEQ ID NO: 3514 - DNA, 40 bp, Homo sapiens; identical to SEQ ID NO: 1113
  misc_difference 20: note = C->T
  source 1..40: mol_type = genomic DNA

SEQ ID NO: 3515 - DNA, 40 bp, Homo sapiens
  misc_difference 20: note = G->A
  source 1..40: mol_type = genomic DNA
gtgtcagagatgaaggtgcgacctgcctagcccaggccgg

SEQ ID NO: 3516 - DNA, 40 bp, Homo sapiens; identical to SEQ ID NO: 1185
  misc_difference 20: note = G->A
  source 1..40: mol_type = genomic DNA

SEQ ID NO: 3517 - DNA, 40 bp, Homo sapiens
  misc_difference 20: note = T->A
  source 1..40: mol_type = genomic DNA
tcttaaattatatcatggatacagtgaaagattcatctaa

SEQ ID NO: 3518 - DNA, 40 bp, Homo sapiens; identical to SEQ ID NO: 3214
  misc_difference 20: note = T->A
  source 1..40: mol_type = genomic DNA

SEQ ID NO: 3519 - DNA, 40 bp, Homo sapiens; identical to SEQ ID NO: 1263
  misc_difference 20: note = A->G
  source 1..40: mol_type = genomic DNA

SEQ ID NO: 3520 - DNA, 40 bp, Homo sapiens; identical to SEQ ID NO: 1291
  misc_difference 20: note = G->C
  source 1..40: mol_type = genomic DNA

SEQ ID NO: 3521 - DNA, 40 bp, Homo sapiens
  misc_difference 20: note = T->G
  source 1..40: mol_type = genomic DNA
tcaggcagcggggccttcttggggtgctcgcttagctcag

SEQ ID NO: 3522 - DNA, 40 bp, Homo sapiens
  misc_difference 20: note = C->T
  source 1..40: mol_type = genomic DNA
agaaggacaccatcacccacgccaagctccaggccctgct

SEQ ID NO: 3523 - DNA, 40 bp, Homo sapiens; identical to SEQ ID NO: 3268
  misc_difference 20: note = G->A
  source 1..40: mol_type = genomic DNA

SEQ ID NO: 3524 - DNA, 40 bp, Homo sapiens; identical to SEQ ID NO: 1324
  misc_difference 20: note = T->C
  source 1..40: mol_type = genomic DNA

SEQ ID NO: 3525 - DNA, 40 bp, Homo sapiens; identical to SEQ ID NO: 1325
  misc_difference 20: note = G->A
  source 1..40: mol_type = genomic DNA

SEQ ID NO: 3526 - DNA, 40 bp, Homo sapiens; identical to SEQ ID NO: 3273
  misc_difference 20: note = G->A
  source 1..40: mol_type = genomic DNA
